United States Patent 11,098,302 (IDENTIFICATION OF POLYNUCLEOTIDES ASSOCIATED WITH A SAMPLE) - sequence listing, part 70

SEQ ID NO: 240353 - DNA, 727 bp, Homo sapiens
  misc_feature: GYAE6OF01CB8NA.45.35.D02.1.454.CMB.1.raw
  modified_base (123)..(123): a, c, t, g, unknown or other
  misc_feature (123)..(123): n is a, c, g, or t
  modified_base (208)..(208): a, c, t, g, unknown or other
  misc_feature (208)..(208): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
tcagacgcgatcgacacgaccggtgctcgatttagcacacgatagttgggtttgggggaggaactgctcagttaggacccagagggaaccatggaagccccagctcagcttctcttcctcctnctactctggcctccagacgacctccggaataaattgtcttgaccacacgtctccagcctattctgtctctctcctacgagggacncacgcccaccctctacagtcgcgacggccagtcagtaacgttattaacgaactattacgtacggtcctaggtaatacaacgtacacgtccgacggcccgtaacgggtcccccggtctaccgtactaacttatacgtagtacgtccgtaccgttaccgaacgaccggacggggccctacggtacgacctacccaacccgtcggtaccgtaggttcggtaagggtcggggttcggggttaggtttcggaacgtacgtacgtcttacnccgttanacctaagacgtacacgtaccgactacccttaaccgaacttaagtacgtttacgttacgttactacgttacttacgtacttaacgtcaacttacggacgtaaccgtaggttaacccgtcgggtaccttccgttacgtaccggttccgggaaccggtacgggtaacggtaacggtacggtaagtaccgtaagtaaaccgggttcacggggttcgtacgtacgtacgttaccttatcgttacgtttaccg

SEQ ID NO: 240354 - DNA, 839 bp, Homo sapiens
  misc_feature: GYAE6OF01DF2R8.45.35.D02.1.454.CMB.1.raw
  modified_base (812)..(812): a, c, t, g, unknown or other
  misc_feature (812)..(812): n is a, c, g, or t
tcagacgcgatcgacacgaccggtgctcgatttagcacacgataggttggggtttgggggaggaactgctcagttaggacccagagggaaccatggaagccccagctcagcttctcttcctcctgtctactctggcctccagataccgaaccgtaaaattgtgtagacacgtacgtcctaccgacggtcctcccgttgtcctcgtcgttccaccggaacggggacaccgacgtacccctaccctctccgtacggacggacgggtccgaagggttaggtacgtcggtacgtaaggtaacgttacgttacggtacgtaacggtaaccaaacgaacgtaaccgtacggaccgacggtaccctaccggacggttacctaccgtactaaccgtcgtaacgtcgtacgtaccgtacctaaccgtacccgaaccggtcccggtaccggtaccggttacccacccggtacgtacgggttaaccgggttccggcggtacggtcgggtcgggaacggttagggaaccgtagttaccgtaccctccggtaccgtaccgaacgggtcctacggtccgtacggccgttacgcggtactagtagtcggtttacgtttcgtacttttcggtcttacgtgtaccgtgtaccgtaccgtccgtacccgtaccggtcctccgtaccgttacggttaccgggggaccgggtccggggtacggaacgggtggttacgaggtaacggtaacggtacggttcggaacggtaccggtccggtgtacccgttccgtaccggttccttttacgggtaacctcccgggtttaaccccnccccgtttaaacggtccctttaacggg

SEQ ID NO: 240355 - DNA, 943 bp, Homo sapiens
  misc_feature: GYAE6OF01BD4V2.45.35.D02.1.454.CMB.1.raw
tcagacgcgatcgacacgaccggtgctcgatttagcacacgatagttgggtttggggaggaacttgctcagttaggaccagaagggaaccagtgaagccccgagactcagcttctcttccgccgtcgtcccttacctcctcggcctacccctagtactacccgaccggaagtaagttgtacgttggacctacgacgtctccgaggccacccttggtcctcgtaggtccctacccggaggggacgacccgtacggcccccggacccccgtcgtaccgtcggacccaacgggtcctaaggttacggtgttcgacggaacgttaacgtacgttacgaccgttaacggtaaccaacggaacgtaaccgtggtaaccgtacggtaccgtacccggtacggtacctacccgtacgtaaccgttaccccgaagttacccggacctacggtcctaacgtacccgtaacggtaccgggttacccgacggtccgtaaccgacgtaaccgggttcccggttacccgtagggtaccggttaccgggtccgggaggtaccgaaccgttcggttaccgttcccgaccttaccggtaacccgttcggaccgaaccgtccgtaccggtacccggaacgtcccggtaaccgtaggtaccgttaggttcgtttacccggccgtttaaccggttaccgtagaccgttaggtaccgtaccttacggtacccgtttaacccgcggtaccggttaccgttcggttaacggtaccccggggttcggggaacccggggtaacgttgggaacggtaaccgttcgggtaaaccggtaccggttacccgtaaccgggtcgggtaaccggtccccggttaacggaaacccgttcccgggttaaccgtttccggtaacccggttaccctttaaccccggaccccggttttaaccccgacccccggtttaccg

SEQ ID NO: 240356 - DNA, 833 bp, Homo sapiens
  misc_feature: GYAE6OF01AUUAP.45.35.D02.1.454.CMB.1.raw
tcagacgcgatcgacacgaccggtgctcgatttagcacacgatagttgggtttgggggaggaactgctcagttaggacccagagggaaccatggaacgccccagctcagcttctcttcctcctgctactctggcctcccgagacgaccctccggaagtaaatttgtgttcgaacctacgtagttcctaccgacggtcctacccctgttcctcgtcgtcctaccggagggacacacgccctacctccgtccgtgacgacggcctaggtaggtacgtcgtacgaagttaacgtacgttcggcttaacggaaccaacgtaacgtaaaccgtcggaaccgacgtcccgtaccgtacggtccttccgtacaacttccgaacttcgggtaacctacggaccctaacttacccggaacggtacccgggttccgtaccggcccgttacccggaagtaacccgttcgggtttccggcggtaccggttacgggtccggttacgtacgggaacgtacggttaccttacggtacctccggaccgtacgtcaacggtccgacgtccgtacgggcgttactagttacgtcgttttaacgttggtaaccctttacggtttcgtacgtttacgtccgaaagtccgtttaaacccggttccggtcccgtaacgtccccgggttttaccgaccgttttacccggggtttaccgggggacccggggtacggggtaaccgtttaggggacgtaacgggttaccctaggggaaacccttagtttcggtacggccgtaccacggttccaaccttggttacccttgacccctttaggtactccccggggttccaag

SEQ ID NO: 240357 - DNA, 351 bp, Homo sapiens
  misc_feature: GYAE6OF01BJ40X.45.35.D02.1.454.CMB.1.raw
  modified_base (308)..(351): a, c, t, g, unknown or other
  misc_feature (308)..(351): n is a, c, g, or t
tcagacgcgatcgacacgaccggtgctcgatttagcacacgatagggtgggtttggcacagacttcactctcacaatcagcagcctccaacctgaagattttgcagtctattactgtcaacagcgtacagattggccgctcacgtttcgggcggagggaccaagggtggagatcaaacgctgtggcgtcgcaccactctcgtcttcctactcttcccgtcccgactcttgactacgtacgtccgtccggtcgtggacgggcggggccggtcggtcggaaacgggacgcccgataagtacggagcatgnnnnnnnnnnnnnnnnnnnnnnnnnnnnnnnnnnnnnnnnnnnn

SEQ ID NO: 240358 - DNA, 903 bp, Homo sapiens
  misc_feature: GYAE6OF01D32Z5.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagacgaccgtccggaagtaaattgtcttagacactagtcctccagcctattctgtctctctctaccgaggggacgacacgccctacctctcatcggacgacggacctagtacaaggtagttaagtaacgaactagttacgttcggaccttaggtaatactaacgtaacgaccgccgtacggccggtaccggggtccccgtcttcctactacgtacttagtacgtacgtaccgtccgttaccgacggtccggtaccgggtacctaaccggtcgggaccctaacccgtacccgacgtaccgggttacggttaccgggtacggggttcggggttccggggtttacggggtttacggaaccgtaacggtaccgttacccgttacctaaccgttacctaaaccgtaaactaacgtaccgaaccgtaacccgtaaccgtaccccgttaacccggtaaccgttaacggttaacgtttaccggtttacgtaaccgtttaaccggtttaactttaaccgtttacgtttaaccgtaaccgtaacgtaaccgttaacggtaacggttaacgggttaccggtttaccgggtacccgttaaccggttaccggttaaccggggttacccggggtaaccggggtaaacggggtaaccgggtaaacggggttaacgggaaaccggttaaaccggttaaccgggtaaaacggttcgggtaaccgggtcggtaacccggtaccctaacccggttaccttaccggtttccgtaccgttttacccg

SEQ ID NO: 240359 - DNA, 1041 bp, Homo sapiens
  misc_feature: GYAE6OF01BONM4.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttgggggaggaactgctcagttaggacccagagggaaccaatggaagccccagctcagcttctcttcctcctgctactctggctcccagataccaccggtaaaattgtgttgacacagtctccaggcacctgtctctgtctcgaggganacacgccaccctctcctgacgagggaccaggtaggagtcgtacgaaggtaacgttacgttaggcttacggtaaccaaacgaacggaaacccgtgggacccgacgggtccctaccccgaacgggtcccttacccgtactaacctacccgtagttacggtacttacggacctaaccgttaacccgaaaccggtacccgggggtttccccgtacgggtaccccggttaccccgaagggtaaccccggttacggggttttacccccgggtaggggtacccggttaagggggtttaccgggggtttacccggttaaacggggggtaacccgtaaacgggggttttaccgtttacccggttaacccccgtttacccgtaaccccggttaaccccggttaccggaaacgggtccccggtaaacccgggttcccgggttacgggggtaaacccgttccggttacgggtaacgttttaacgggttttaacgttttttcccggggtaaccgttttttaacgggtttttaaccccgtttccggtttaaccgttacccggacggttacccgtaaccgggttttcccccgggtacccccggtacccggtaaccccgtcccccgggtttccggtttaaccccggttacccggggggttttccccggggggggaacccggggggtaaccggttaggggggtaccggtaacgggttacgggtacgggacccgggttaaacggtaccgggttcgggtccgggtacccggttacgtacccggtaacccttcggttaccgtttcccgtttaaccggttacccgttaacccgtttccccggttccccgtacgttaacccgg

SEQ ID NO: 240360 - DNA, 876 bp, Homo sapiens
  misc_feature: GYAE6OF01EZQCM.45.35.D02.1.454.CMB.1.raw
  modified_base (239)..(239): a, c, t, g, unknown or other
  misc_feature (239)..(239): n is a, c, g, or t
tcagacgcgatcgacacgaccggtgctcgatttagcacacgatagttgggttggggaggaactgctcagttaggacccagagggaaccatggaacgccccagctcagcttctcttcctcctgtcctactcgtcggcctcccgaggacgtacccgtacggaagtaaattcgttcttagaactacacgttcctaccgagtcctattctcgtcctactcctcgtaccggagggacacgaccnccctacctctaccagtcggaccggacggtacctagttacgaaggttaacttaaacgtaaacgtaacgttacgtttaaccggttacggtaccgtttaaggtaaaccttaaacctaaaacggttaacgaacccgggtcccggtaaccgggtaaccccgggtaccccggggtcccccctaccgttaccccttagtacggtttaccgttaacggtacggtacccttcccgggttacccgttaccggaaccgggtaaccggtcccgggtacctaaccggtggacccctacccgtacccgtacggtaccgttacgggtcggtaggggttacggggttgggttccggtacaaccgtaaccgtctttaaccgtccccttaagtaccgtaacccttaaagtcccgtaccgtacgtaacccgacccttacccgtaaccgttagtaacgttaagttcgttaccgtattacgttacttaacttacgtacacgttaccgacgtcgttaacgtacggttacgttccggtaccgttcggttacggtacgggtaccggaggttaaccggtaggtaacgtaacgtaacggtaacgtaacggttaggtcgacgtaccgaacctaccgtacttacttctttccggttactacccgg

SEQ ID NO: 240361 - DNA, 727 bp, Homo sapiens
  misc_feature: GYAE6OF01AVLYK.45.35.D02.1.454.CMB.1.raw
  modified_base (113)..(113): a, c, t, g, unknown or other
  misc_feature (113)..(113): n is a, c, g, or t
  modified_base (214)..(214): a, c, t, g, unknown or other
  misc_feature (214)..(214): n is a, c, g, or t
tcagacgcgatcgacacgaccggtgctcgatttagcacacgatagttgggtttgggggaggaactgctcagttaggacccagagggaaccatggaagccccagctcagcttcncttcctcctgctactctggctccagagacctccggagaaattgcttgacacagtctccagccattctgtctctctctccgaggggatacacgcccaccctntcagtgccacgggccagtcaggagtattagaacatacgttggacctggtatccaataccgaaggtcctagggcccgtaggggttcccccgacttccgtacgacttcgtatcgaatcgtcttccaggtccgagggtcccagttcgggcctaacgtcccgaaggcctaggttaccgtacgggtcggggtcggtttagggtcgaccgtaacgtaacggtcctttaccgcttccgtaccaactaacgtccgtaacgacccgtacctaccccgttacccgtaaaccctacggtaacgtttacgttttacggacctttaacggttacctaacgtttaaccttcggtaactaaccgaacgttaacgtaaccgtaaggtccggtttcgggacccgttagttaccgttaccgggttacgggcggtaaccgggacggttacgggacgggtacgtaacgtaccggaaacgtacggttcggtacccgtacggtaaccgtacctaccgacttccggttacgttacc

SEQ ID NO: 240362 - DNA, 795 bp, Homo sapiens
  misc_feature: GYAE6OF01CAW79.45.35.D02.1.454.CMB.1.raw
  modified_base (179)..(179): a, c, t, g, unknown or other
  misc_feature (179)..(179): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagcgaccctccggaagtaaattgtcttgacacagtcctccancctattctgtctctctctcgaggggacacacgcccaccctctacatcgaccgacggaccagtactaacgaagttaattaaacgtaactaagttaccgttcggtaccgttagtactaactaaataaccaacggtccgtcggtacccggtacccggggtcccccggtccttaccccgtcctacgttaccttagtcgtacgttcgtaccgttacccgacggaccggtaaccggggccctaacggtccgggtacctaacccgtcccgacggtacccggttaacggttaccgaaggggttcggggtcggggtttggggtttaccggaccgtaacgtacggtaccttacccgacgttacctaaccaactaagtaccacggtaccaccgtacccctaccgaactaggtaacttcttcgactattaccttattacacgtaccaagtaccgtacgtaagacgtcgtaccgtcctaccgttacggttaccgggttcggaccggggtaacgggtaaccgtaaggggtaaggtaacggtaaaccgtaaaccggtaaaaccgggttcgtaacgggttaccggtactaaccggtaacccttaacgtccgtttacgttcccggtttaaccc

SEQ ID NO: 240363 - DNA, 906 bp, Homo sapiens
  misc_feature: GYAE6OF01A1VF4.45.35.D02.1.454.CMB.1.raw
  modified_base (210)..(210): a, c, t, g, unknown or other
  misc_feature (210)..(210): n is a, c, g, or t
tcagacgcgatcgacacgaccggtgctcgatttagcacacgatagttgggtttgggggaggaactgctcagttaggacccagagggaaccatggaacgccccagctcagcttctcttcctcctgctactctggcctaccagacgacctccggagtaacttgtcttgacgacagtcctccagcctattctgtcctctctcgtccgaggganacacgcccaccctctacatcgacgcgggaccagtacgagtagtactaagaactattacgtggaccgttaggtaactacgtaaatacacggtccggtacggaccgtaccgggttcccccgtaccttacccgtacgtacttacgtacgtacggtacttcccggtacttaccggacgttaccgggaccggtcctaacggtccggtaccctaccccgttacccggacggttacccgtagggtttaccgtaagggggtttccgggtacgggggtttcgggtacccggaaactaccgggtacgttacccttaccgtaacccgttccgaaccgtaacccttaagtaacccgtacccggttccctacccggttacccccggttaaacccgtaacccggtaaaggtttaacccgggtttaaccgtttaccggtaaccgtttaaccggtttaccgtttaaaccgttacccgggttaaccgtaccgtaaaccgttaccggggttaccccttaaagggtaccggtttacccggtccgtttaaccccgtaccgtttaccgggttccgggtaccgggaaaccggggtaacccgggttaaaccgggagggttaacggaaccggttaacccggaagttaaaccggtcggttaacgggtacccggaccttaccgggaaaccttacccgttacgtcccgtttaaccgttacccg

SEQ ID NO: 240364 - DNA, 760 bp, Homo sapiens
  misc_feature: GYAE6OF01EYD3G.45.35.D02.1.454.CMB.1.raw
  modified_base (202)..(202): a, c, t, g, unknown or other
  misc_feature (202)..(202): n is a, c, g, or t
  modified_base (424)..(424): a, c, t, g, unknown or other
  misc_feature (424)..(424): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatcgcagtcggaccagtcaagagtatagaactatacgttcggctaggtactacaatacaagccgtggaccgacgggtccccgctcctactactctatgatcgtccttaccgagtccgacgggccacgttcggacctacgtcccgagcccgtaggttcgagggttcgggtcgggttagggttcgaccgtaacgtacgtaccttaccnccgttactacgaactaacgtccgaacgtaccgaccggtacccctaacccgtaaaccgtaggtaaacgtttacgttttacgaccgtttaacggttaacctttaacgttaaccgttcgtaacccgtaacgtaacggtaaccggttaacgtacgggttaacggtttacccgggtccgttaccgttaccggttaaccgggtttccgggggaacccggggttaaacgggggtacccgggtaagggggttaacggaacggttaacgggaacggaaaccgggttaacggtaacgggttcggtaacgggtccgtaaaccggtaccgtaaccgttacgttaccgg

SEQ ID NO: 240365 - DNA, 675 bp, Homo sapiens
  misc_feature: GYAE6OF01ENQ6V.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggaagaaattgtcttgacacagtctccagcctattctgtctctctctaccgaggggacacgacgccaccctctcatcgacgacgggccagtcagagttattagaacaagttacgtcggccgtggtatacaagtacaacgcctcggccgacgggtccccgctccgtctatctagtgactcgcttccgagccgacggccacgtgcacgtcccgagccgtaggtcgaggtcgggtacggttgggtttcgacgtacgagtaccgtactacctctaccaacgtaactcgacgccgtacgtacccttaccgtaaccgttagaacgtttagtttacgacgttacgttacttacttaccgttacgtaccgtaacgacgtaccgtaacgtaggtacgttccgggccgtacgttaccgtacggtttacgggaccgggtaacgggtaacgaacggggttaggaacgtaacgtaaccgtaaacgggtaacttcggggtacgtaccgtacgacccgtaacgtaacgttccgtagttacccg

SEQ ID NO: 240366 - DNA, 824 bp, Homo sapiens
  misc_feature: GYAE6OF01ADJGN.45.35.D02.1.454.CMB.1.raw
  modified_base (199)..(199): a, c, t, g, unknown or other
  misc_feature (199)..(199): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaattgtcttgacacagtctcagcctattctgtctctctctccgaggganacacgccacctctacactcgacacgggcagtccaagtagttacttaacgactaacgtacgttcggaccgttaggttactacaaacgtacctaaacggtcccggttccgggaccggtaacccgggggttcccccgacctttacccggtacccttaacgtacgtttacgttaccggaacgtttccggttacccgttacccgtaacgggtaaccggacccggggtaccctaaccgggttcggaacccttaccgttccccggaacggtacccggtttacggtacccggtaagggttcgggtacccggggggttttgggttaaccggtacccgaacgtaccggtttaccgtttaccgaccttacgttaccggaaccctttaaggacctacgggaccctaccggtacccttaccgtaacgttaacgtaacgtttacgtttacgacgttagttcccttaacgtttcacggttaacaacgttaaccgataacgtacgtacgtttccggaccttcggtcgttaccgtacggggtaccgtaaccgggacttacgggtaggtcaaccggttaaccgaaacggttcgaccggttacggtctaacccggacttacccgggacttacgggtccgttacc

SEQ ID NO: 240367 - DNA, 788 bp, Homo sapiens
  misc_feature: GYAE6OF01CCST5.45.35.D02.1.454.CMB.1.raw
  modified_base (235)..(235): a, c, t, g, unknown or other
  misc_feature (235)..(235): n is a, c, g, or t
tcagacgcgatcgacacgaccggtgctcgatttagcacacgatagttgggtttgggggaggaacctgcgtcagttaggaccccagacgggaaccatggaagccccagtctcagtcttctcttcctcctgctactcgtggcctcccgagacgacccgtccggaagtaaagttgtacttggacaccgtagtctcccagtcctagttcctagtctacgtctcgtccgaggggtacacncggtcccacctgtcagtcgacgtaacggcccaggttccgaaggtattaacgttaacgactagttcgttcggccttaggtactacgtaagtaaccaacggtccgttacggtaccgtaacccgggttccccgaccttccccgttacgtacgttaccgttacgtcggtaactcggtacccgttacgcggtaccgtaccggtaccgtaccgtacggtaccgtaccgtacccggtacgtaccgttaccggttacgacgggttcggtccgggtttacgggtttaccgacgtaaaccgtacggttaccttaccggtaccttaccgtaaccgaaccgttaactaccgaaaccgtaccgtacccgtaccccgtaacctacccgtaaagtaccgtttacgttaacggtccttaacggttacttaaccgtacttacgtacctaacgtacgtacgtatacgtacgtccgtccgtacgtaccgttcgtacggggacctacgggtaactcgggtagtaagtacgaactacgagtcgactcgtaaacgtcgaactcgtcgtcgttccg

SEQ ID NO: 240368 - DNA, 795 bp, Homo sapiens
  misc_feature: GYAE6OF01CCL54.45.35.D02.1.454.CMB.1.raw
  modified_base (346)..(346): a, c, t, g, unknown or other
  misc_feature (346)..(346): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagacgacctccggagaaattgtcttgacacagtctccagccattctgtctctctctccaggggacacacgcccaccctctcatgccgaggccagtcaagtacgtatagaactatacgttggccttaggtatctaaagtaccaagtcccgtcggaccgtacgggtcccccggcttcccacacttccgtaagtcgtatcgtaccttacccgnggtcgaacgggcccacggtccggtaccaacgtcccgaacgtcccgtaggttccgaggggttcgggacggggtttcggggtttacggaccctaacggtaacgtcgtttaccgaacctttcccgaactaacccaacttacccggaacacccgtaaccggtcccctaacccgtaaacccgtacggtaaagtttaccgtttacgggaccttaacggttaccgttaacgttttaccttaacgggtaaccctaaacggtaacggtcccgtttaaacggacgttacccgttaccggggtccccgttacgttaaacccgtttccggggttaacccggtacgggggtaacccggaaccgggttaaaggggtaccgtacggttaaaccgtaacgaaaacggttccggttaacggtacggtacgtcggtaacccgaacttcgttacgttcgtttacccgg

SEQ ID NO: 240369 - DNA, 836 bp, Homo sapiens
  misc_feature: GYAE6OF01BYLOO.45.35.D02.1.454.CMB.1.raw
tcagacgcgatcgacacgaccggtgctcgatttagcacacgatagttgggtttgggggaggaactgctcagttaggacccagagggaaccatggaacgcccagctcagcttctcttcctcctgctactctggcctccagacgaccgtacggaagtaattgtcttgacacagtctccagcctattctgtctctctcgtcgagggacacacgcctacctcgtacacgtcggacgacgggaccagtacgaaggtacgttaataaggaactacgtttacgttcgggccttaggtaactactaaacgtacgtaacgccggtacggacccggtaccggggtccccgtcctccctacgtacttactagtacgtactcgtaccgttacacggaccggacgggtaccacggtcggacctaaccgtcccgaaggtcccgtaagggttcgagggttcggggtacggggttcggttcggactaacgtaccggttaactaccgtacgttaccgaactaacgaacgtaccgaacgtaccgtaccgtaccccgtaactaaaccggttaacgttaaacgtttacgtttaacggtaccttaacgttaaccgtttaacgtttaccgtacgtaaaccgtaacgtaaccggttacgttaacggaacggttacggtacccggttacccgtaccggtttaaccgggttaccggttaccgggggaacgggggttaaacgggtaaccggtaaacggggttacggtaaaaccgggtaacgttaaaccgggtaaacgggttacgggttacggtaacggtaccgttacggtaccctaaacggtcgttaccgttcggttaaccc

SEQ ID NO: 240370 - DNA, 719 bp, Homo sapiens
  misc_feature: GYAE6OF01CN0P4.45.35.D02.1.454.CMB.1.raw
  modified_base (152)..(152): a, c, t, g, unknown or other
  misc_feature (152)..(152): n is a, c, g, or t
  modified_base (236)..(236): a, c, t, g, unknown or other
  misc_feature (236)..(236): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagacgacctccgganaaattgtcttgacacagtctccagcctattctcgtctctctctccgaggggacacacgcccacctctcatcgcagggccacgtnacgtagtataagaactatacgttcggctaggtactacaactacaacgccgtcggaccgacgggtccccgacttccgtctactctactgcgtcgtccttaccgacggtaccgacgggtccaacgtcgggtaccaccgtacccgtacgtaccgtacggttacggacgggttcgggggttccgggttggggtttacggcctaacggtaaccgttaccgtttacaacccgttacttaccaacgtaactccgaacggtccaacccgtaccctaaccgtaacccgttaagtaacgtttaacgtttcgtacgttaacgtttacctttaacgtttacgtaccgttaaacgaaccgtaggtaaccgtacgtaaccgtacgtttccgggaccttccgttaccgttaccggttcggaaccgggacggtacggaggtaggacgtacgtaacgaacggtcgtcggtacgcgtacacgtacctattcgttcggtacc

SEQ ID NO: 240371 - DNA, 865 bp, Homo sapiens
  misc_feature: GYAE6OF01BQ0AN.45.35.D02.1.454.CMB.1.raw
  modified_base (407)..(407): a, c, t, g, unknown or other
  misc_feature (407)..(407): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagacgacctcggagtaattgtcttgacacagtctccagctacttctgtcttctctccgtcggaggggacacgacgccctacctcgtcacgtcgaccgacgggcctatacggaagtagtaattaacggaactacgttcgttacggccttaggtaactaactaataccgtaacggcccgtacggaccgtacccggggtccccgcttcccgcgtactcgtagcgtagtaccgcttaccgacggtccgacggtacccgtacgtacgccgtaccnccggaaccgtccggtacggttacgtacgggttcggggttacggggttcgggttcgaccgttacgtaacgggtccttacctcccggttacctaacccggtaactacgttaacccggacgtaccggtaacccgtaccccttaacgtaacccggttaaagttacgtttaacgtttaccggtaccgtttaaccgttttaaccgtaaccgtttactaacccgggtttaaaccacccgggtttaaaccgttacccggaaacggtttaacccgggttacggttaccccggttacccggttacccgtttacccgggtttacgggttacccgggtacccggggtaaaccgtaacggggttaaacgggacggttaaacggtaaaacccgttaaccgtaaacgggttacggacgtttacggtaacggtccccttaacgggtaccctggtttacccgtcgtttaaccccg

SEQ ID NO: 240372 - DNA, 777 bp, Homo sapiens
  misc_feature: GYAE6OF01BY2EE.45.35.D02.1.454.CMB.1.raw
tcagacgcgatcgacacgaccggtgctcgatttagcacacgatagttgggtttgggggaggaactgctcagttaggacccagagggaaccatggaacgccccagctcagcttctcttcctcctgctactctcggctcccagacgacctcggaagtaattgtcttagactacacgtctccagcctattctgtctctctctacgagggacacacgtaccaccgtctacagtcgacggacggcctagtacgaagtagttaactaacgtaactagttacgtcggacgttaggtactacaatacaacgtcgtcggaccgtacgggtccccgtacttaccgtactacgtacgttagtacgtacgtaccgtacctacccgaggtccgaaccgggcctaaggtacgaccaccgtaccgtacgaccgttaacggttcgacggggttacggggtaggtttcggtaacggaccaacggtacttaccgttacaccgtttacaacctacgtaacgtacgaaccggtccaaccttccccgaaagttaacgtagtaaccgtttatttaccggacttaacggtttactaacgtttccgacgttaaacacggttaactaacgttaacgagttaccggttcggaccttacgtttaaccggtcggggtaacggaacggggtaaaccgggtaagtacggtaacggtaaagtaccgttaaaacggggttaacccaaggggtttacggaccggaccggtaacctaacccgttaagttaccccgtttagttccgtaaccc

SEQ ID NO: 240373 - DNA, 674 bp, Homo sapiens
  misc_feature: GYAE6OF01BBOZJ.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgaggganacagcccacctctcatgcgagggccagtcaggagtattagaactatacgtgtccgtgtatactaatacgaagtccgtcggccgacgggtccccgctccgtcgactctagtgtatcgtctaccgagcgacgggcacgtcggcaccgtcccacgccgtaggttccgagggtcgggtacgggttcgggttacgacgtacgtacgtaccttactaccttactacgaactaagtccgaagacctaccgtaccctaccgtaaccgtagtaacgttacgtttacgacttacgttaacttaaccttacgtactacgaacgtaccgtacgtaacgtacgttacgttccgggtacctaccgtacgttaccgttaccgggacgggtaacgggaccgtaagggtacggtaacggtacgtaacggaaacggttacggttcggtacggaccgtcggtaccgtaaccgttacgttccgtcggtttaccc

SEQ ID NO: 240374 - DNA, 802 bp, Homo sapiens
  misc_feature: GYAE6OF01C4OYN.45.35.D02.1.454.CMB.1.raw
  modified_base (233)..(233): a, c, t, g, unknown or other
  misc_feature (233)..(233): n is a, c, g, or t
  modified_base (542)..(542): a, c, t, g, unknown or other
  misc_feature (542)..(542): n is a, c, g, or t
  modified_base (551)..(551): a, c, t, g, unknown or other
  misc_feature (551)..(551): n is a, c, g, or t
  modified_base (772)..(772): a, c, t, g, unknown or other
  misc_feature (772)..(772): n is a, c, g, or t
tcagacgcgatcgacacgaccggtgctcgatttagcacacgatagttgggttgggggaggaactgctcagttaggacccagagggaaccatggaagccccagctcagcttctcttcctcctgcctactctggcctcccagactaacccgaacggtaaaaattgtgttagacacagttctccgaggcctaccctgtctctgtctaccgaggggacacacgcccaccgtctccgnggcgacgggcctaaggtacggtagttcgtacgaaggttaacgttacgtttagggaccgttacgggtaaaccccaacgaacgtaaaaccccgttggggaccccaacgggtcccttacccccggaaggtcccccttcccgactaactccccaggttagtacacggtcctaaatcccccggaaacggttaccggggtcccctcgggggtaccctttcccggaaagtaacccgggtggggtttcccccaggggggtcctacggggttggtccgacggggtactaacgtcgtttccaacgtttcacgacccgtnagtacccgngtaccgtggctcgtacgtacgttgttacttcgtacgtttacgtttacgttcgtacgttacgtacgtcgtacgtcccgttacccgcccgtaccgtcccgcggttaccgtaccggggtttccggggaccgggggtaccggtacggggttacgggtaacggtacgggtacggacggtaccggtaaaccgggtggtaccggtgtaccgacgtacctacggttacncgttctacggttctacccttccgtaccgtc

SEQ ID NO: 240375 - DNA, 626 bp, Homo sapiens
  misc_feature: GYAE6OF01B2FM6.45.35.D02.1.454.CMB.1.raw
  modified_base (203)..(203): a, c, t, g, unknown or other
  misc_feature (203)..(203): n is a, c, g, or t
  modified_base (441)..(441): a, c, t, g, unknown or other
  misc_feature (441)..(441): n is a, c, g, or t
  modified_base (599)..(599): a, c, t, g, unknown or other
  misc_feature (599)..(599): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtcctctctctccgagggganacgacgcccaccctctcatgcgacgggccagtcagagtatagaacatacgtggcctggtatcaaatacaacgccgtaggccgacggggtcccccgcttcctcactctagtgactcgccttaccgaggcgacgggccacgtcggacctacgtacccacggccgtaggttccgagggtcgggtccgggttgggttcgacgtacgacgtaccttcacgttcctacaactatccgacgaccncgaccctaccgaaccctagaacgtttattcgacttagttactacgttacttagaacctagaccgtatacgaacgtgttaccggccgtctaccgttcggttaccgggacggtaccggaacgtagggagtaacgactaacgaacgtgtcggtacggtacncgtacccaagttcgttcgtagttaccc

SEQ ID NO: 240376 - DNA, 836 bp, Homo sapiens
  misc_feature: GYAE6OF01BIWE0.45.35.D02.1.454.CMB.1.raw
  modified_base (184)..(184): a, c, t, g, unknown or other
  misc_feature (184)..(184): n is a, c, g, or t
  modified_base (205)..(205): a, c, t, g, unknown or other
  misc_feature (205)..(205): n is a, c, g, or t
tcagacgcgatcgacacgaccggtgctcgatttagcacacgatagttgggtttgggggaggaactgctcagttaggacccagagggaaccatggaagcccagctcagcttctcttcctcctgctactctggcctccagacgacctccggaagaattgtcttagacacagtctccagcctattcngtctctctcgtccgagggganacacgccctaccgtctcagtacgcgagggcctagtacgagtaagtattaagaactattacggttcggaccttaggtaactactaagtacaacggtccgtacgggccgtaccgggttccccgccttaccgtctacgttctacgtagtacgtccgttcgtcaacggaccgtacggcccacggtcggacctaccgtacccgaccggtaccgtacggttacgacggggttcggggtacgggttcgggtttacggacctaacggtaccgttacgttacccacgttactaccgaacttagaccgtaccggaccctaaccggtcccctaaaccgttaaacgtagggttaacctttacgggtttacaccgtttaacgtttaacttaaccggttttacgaccgttaaacgaaccgttagggttaaccgtacggttaacgttcgggttaacccggttcctaccggttacggtttccccggggtacgggtaaaccgggaaccgggttaaaaccgggttcggggttaacccgaaacgggtttaaacccgtaaacgggtaacccgggttacggtaccggttacgggtaacccggtacccgttaaccgaccccggttttaagtcccgggtttaaccttacccggg

SEQ ID NO: 240377 - DNA, 715 bp, Homo sapiens
  misc_feature: GYAE6OF01EJMIQ.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctggcactctggctcccagataccaccggagaaattgtgttgacacagtctccagcccaccctgtctttgtttccaggggaagagccaccctctcctgcagggccagtcagggtcgttaacaggcttacttacgcctaggtaaccaaacaaaaacctggaccaggcctcccaggcctcatcatctatgacgcatacgaacgacgggaccacgtggcactcccgagaccaggttcaggtcggctaggtcggtcgtaggggactagacttcacctcctacgacctacgtaccgacgccgaacgtcccgtcggtacccgtggtacggttacgttttcgacctttactttaaccgtacgtttcgtaccgtagtccgacggtccggtacgggcccggaaccggtacggacccgtcgtacccgttaacccgggttttaccggggaccggggtaaccggggtaacccggttaagggggtacgggaacggtaacgtaaccggaaaccggttaaccggttagggtacgggtaccgtacggacccgtaccctacgttaccgttcgtttaccttaccgtaccttcccggttccccgtccgttaccg

SEQ ID NO: 240378 - DNA, 770 bp, Homo sapiens
  misc_feature: GYAE6OF01DTOAM.45.35.D02.1.454.CMB.1.raw
  modified_base (716)..(716): a, c, t, g, unknown or other
  misc_feature (716)..(716): n is a, c, g, or t
  modified_base (757)..(757): a, c, t, g, unknown or other
  misc_feature (757)..(757): n is a, c, g, or t
  modified_base (764)..(764): a, c, t, g, unknown or other
  misc_feature (764)..(764): n is a, c, g, or t
tcagacgcgatcgacacgaccggtgctcgatttagcacacgatagttgggtttgggggaggaactgctcagttaggacccagagggaaccagtggaacgccccagctcagcttctccttcctccgtgctactctcggcctaccgagaactaccaaaccggtaaaattgtgtacgacacacgtcaccgaggccctaccgtcgtctacgtcgtccgtcggaaggggacaccgaccgcccctacctctccgcgaccggacgggacgaaggttaggacgttaggaacgtaaacgttaaggttaacgttacggtaccgtaacggtaaaccgaaaaacggtaccgtaacccggtacggacccgtacgggtcccgtaaccggacggttccgtaccctaacgtaccttacctacggtagtaaccgtctaccggaaacccttacccgggaaccggttccggttacccggtaccggttacccaccggtaacggtaccggtacgggttccggtacgtccggacggtcgggtacggtaccggaagtcggtaacgtccgtaactccgtaccgtacgcgtaccggagtcccgttcgagggtccgtcgttaggtacctcggtttagtttccggtaactttacggttcgttcgtacggtcgtaccgtcgaccgtccgttccgacccgtacgcctcgttacggtcgggtcgggaccggtagcggtagtcgagngtacgtcgagtctaggccagtcgtatctgtcctgtacctcnccgttcncgtacg

SEQ ID NO: 240379 - DNA, 680 bp, Homo sapiens
  misc_feature: GYAE6OF01C7R7Z.45.35.D02.1.454.CMB.1.raw
  modified_base (204)..(204): a, c, t, g, unknown or other
  misc_feature (204)..(204): n is a, c, g, or t
  modified_base (240)..(240): a, c, t, g, unknown or other
  misc_feature (240)..(240): n is a, c, g, or t
  modified_base (262)..(262): a, c, t, g, unknown or other
  misc_feature (262)..(262): n is a, c, g, or t
  modified_base (346)..(346): a, c, t, g, unknown or other
  misc_feature (346)..(346): n is a, c, g, or t
  modified_base (478)..(478): a, c, t, g, unknown or other
  misc_feature (478)..(478): n is a, c, g, or t
  modified_base (581)..(581): a, c, t, g, unknown or other
  misc_feature (581)..(581): n is a, c, g, or t
  modified_base (631)..(631): a, c, t, g, unknown or other
  misc_feature (631)..(631): n is a, c, g, or t
  modified_base (660)..(660): a, c, t, g, unknown or other
  misc_feature (660)..(660): n is a, c, g, or t
  modified_base (675)..(675): a, c, t, g, unknown or other
  misc_feature (675)..(675): n is a, c, g, or t
tcagacgcgatcgacacgaccggtgctcgatttagcacacgatagttggggtttgggggaggaactgctcgagttaggacccagagggaaccatggaacgcccccagctaccagcttctccttcctcctgcctactcgtcgcctccgagacgacctcggaagtaaacttgttacttcggacaaccgcgtctccagtccatttcngtctcgtctcgccggaggggacacacgtccaccctntcatcgcgcggcacgtacgagngtataacgactaacgtccttcggctaggtataccaacgacacgccgtaggcccgtaccggtccccgtctccgtacacttacgtntacgatccgtacctacgcgtaccggaccgtccgtacgcgaccctaccgaccgtacggtccgtaacgtcggtacggggtcgggttacgggttcgggttacgactacgttacggtaccttcaacgtttccgaanaaaccgtcgtcgacgaccggtaccgtacctacggaaacgttgaaccgtttgttcacgttaaatacccgtttgtacccttaggtacctacggtactacggtaanagttaccggtccgtcgtcgtacgtcgggttacggaccggtaacgtacggnggtaacgtgaacaacgtacgcgtggcccngtacactatctcgtnttccg

SEQ ID NO: 240380 - DNA, 856 bp, Homo sapiens
  misc_feature: GYAE6OF01COMXA.45.35.D02.1.454.CMB.1.raw
  modified_base (191)..(191): a, c, t, g, unknown or other
  misc_feature (191)..(191): n is a, c, g, or t
tcagacgcgatcgacacgaccggtgctcgatttagcacacgatagttgggtttgggggaggaactgctcagttaggacccagagggaaccatggaagccccagctcagcttctcttccctcctgctactctggctcccagacgacctccggaagaaagtttgtctttagaacactacgttcctacccaacncttacttcgtctccttccgtccttccgacggggaagggtaccacgaccgaccctacctccgtactagccggacggaccggtacgtacgaacggtagtaagttaacgtaaacaacgttaacgtttcgggtaccggtgttaacggtttacctaaacgtaacgtaaaccgtacggtccggtacccggtacccgggtaccccgggtaccccgttaccttcccgttaaagtccgttacttaggtaacttcggtaccgttacctacgacgggccggaccgtcggtacgcccggaacctaccgaccggtacgtacggttacggtacgggtagggttcccgggggtagggtttcgggacttaacgacggtttaccacgttcaccgttaactaccaaggtccctagacgtcctacccgtaacccgtaacgtaaccggttaattacgtttacgtagtaccggttaatttaaccgttaacttacggttaaccaagttaacctaccggtaactaaggtaccggttacgtacccgtcctaccggttaaccgttacgggccgggaacggttacccgggaaaggtccggtaaggtaaaccgtaaccgtaaaacgggaaccggttggttacccggtaagcccggtaccctaggttaccgtttacctggttacctaaccccg

SEQ ID NO: 240381 - DNA, 706 bp, Homo sapiens
  misc_feature: GYAE6OF01BDX2V.45.35.D02.1.454.CMB.1.raw
  modified_base (199)..(199): a, c, t, g, unknown or other
  misc_feature (199)..(199): n is a, c, g, or t
  modified_base (323)..(323): a, c, t, g, unknown or other
  misc_feature (323)..(323): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaattgtcttgacacagtctccagccattctgtctctctctcgaggggnacagccacctctacatgcgagggccagtcagtagtattaacgaactattacgttggccttggtaactacaacgtacaacgcctcggccgacgggtccccgctcctcatctatgtatcgtctccnggcgacgggcctacgtcggccaacgtcccgaggtccgtaggttcgaggtcggggtcgggttcgggtttcggacgtaacgtacggtaccttcgtaccgtactacaacgtaacgtccacgaccaccgtccctaacccgtaacgtaacggttaacttacgtttcggaccttaggtttacttaactttacgtacgtaaccaaacgtacggtacgtaacgtacggttacggttccgggtacccttacggttaccggttaccgggttaccggggacggggtaaccgggtaaccgtaagggtacgggaacgtaaccgtaaacggtaaaccggttacggtcggtacccggtacgtacccgaacctaacccgttacgttcgtcccgtttacg

SEQ ID NO: 240382 - DNA, 964 bp, Homo sapiens
  misc_feature: GYAE6OF01EGW14.45.35.D02.1.454.CMB.1.raw
tcagacgcgatcgacacgaccggtgctcgatttagcacacgatagttgggtttgggggaggaactgctcagttaggacccagagggaaccatggaacgccccagctcagcttctcttcctcctgctactctggcctcccagacgtaccgtccgggaagtaattgtcttagactacagtccctacactactcttctcgtcctcctccttcgacgggacggggacaccgaccgcccctaccctcctactagtaccggaccggtaaccgggtaccgtaacgttaggtaacggttaacgttaaacggttaacctaaacgtttaacgtttaccggttcgggtacccggtttacggttaactaaacgtaaacgtttaaaccgaccggttacccggtacccgggtacccggggttaccccgggggtaccccctccccgtacccgttaccctaacgtacctacgtacggtaacgtccgtaacgtacccgtaacccggttaaccggggtaccccgggttaccgtacccgggtaaccccgtacggtaaaccgttaccgggtaccggtttcccggggacggtacggggttaacgggttcgggggttacgtaacgggtaccgttaacgggttacctaccccgttaccgttcccggtaaccccggtacgaacccttacggcccggtaaccgggtccggtaccgggtaaccgtcgtaacggttacgtttcgtttaacccgtttaccggttaaccttttaaccgttacgttccggttaacgtcgtaaccgtcgggtaaccgtcgggtcgaccggaccggttaccgacggttaccccgttaggttaacccggggcggggtaaccgggtacgggaggttaaccggggacgtaacgtaaacgtaaacgggtaacgttacgggtcttaccggtaccggaccgttagaaaccccgttgtttacgttaccgtttcgttaccccgg

SEQ ID NO: 240383 - DNA, 709 bp, Homo sapiens
  misc_feature: GYAE6OF01EW82H.45.35.D02.1.454.CMB.1.raw
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccgggagaaattgtcttgacacagtctccagccattctgtctctctctccgagggganacncgccaccctctcatgcgagggccagtcagagtatagaacattactggcctggtactacaatacaagcctggaccgacggggtccccgctcctacntctagtgancgtctaccagacgcgggccacggtgactacctcccgacgccgtaaggttcgagggtcggggtcgggttgggtttcggactacgtagtacctcacttcctacgaactaacgtcacggacaccggttcctaacccgtaaaccgtaaggtaaacgtttgtttaccggaccttaaacgtttaccttaaagttttaccgtacgttaaccaaaccgtacggtaacggttaaacctaagggttaccgtttccgggaaccccttcgttacccgttacggtttacccggggggaaccgtacggggtaaaccggtaaggggtacgggaaagtacgtaaaccggtaaaaccgggtcgttcgggtacgtccgtaaacggtcctaaaccgttcgttaccgttggtttacccg

SEQ ID NO: 240384 - DNA, 819 bp, Homo sapiens
  misc_feature: GYAE6OF01AROQX.45.35.D02.1.454.CMB.1.raw
tcagacgcgatcgacacgaccggtgctcgatttagcacacgatagttgggtttgggggagaactgctcagttaggacccagagggaaccatggaacgccccagctcagcttctcttcctcctgctactctggctcccagagacctccggagaattgtgttgacacagtcctccaggcctaccctgtctcgtcgtcctacgaggggacacgacgccctaccctctcgtggccgacgggcctaggtacggagtacgtactaagttaacgtacgttaggtcgtacgtaccaaacgtacgaaccgtcggccgacggccctacccgaggtcctccgtacactacccgtagtacgacgtacgctaaccacccgaacgccggaccgtacggcgactacctaccgaacgtacgacgggttactaggtacggacgtagggtttcggggtaccgtacggacgtaacgtaaccgtcccttaaccgtcttaaccccgaacgttaccgtacggacgtaaccgtccggtaaccggtaccggggtactaacccggttaaaaggttaacggtttcgttttaaccggaacgtttacggtttacgtttaaactacggttacggtaaaccgtagtttaaccgtaccggttttacggtaaccgttacccggttttaccccgtttaccgggtttaccgtttaccccggggacccgttaacgggtaacccgttaacggttaccgaaccgttaactaaccggtaaacggtaccgttccggtacggtcccggacgtaaccctacgttacgttcctaaggtttccctaagtcccgtttaacccg

SEQ ID NO: 240385 - DNA, 900 bp, Homo sapiens
  misc_feature: GYAE6OF01BQ414.45.35.D02.1.454.CMB.1.raw
tcagacgcgatcgacacgaccggtgctcgatttagcacacgataggttggggtttgggggaggaactgctcagttaggacccagagggaaccatggaacgccccagctcagcttctcttcctcctgctactctggcctcccagacgacctccggaagtaattgtcttgacacagtcctccagtcctattctcgtcctctcctccgtccggaggggacaccaccgccctaccctctacagtcggacgacgggcctaagtacgaaggtaagttaagtaacgaactaacgttaccggttacgggtaccgttacggttaactaacgtaaacgtaaccgtaacggtacccggtaccgggtacccggtaacccggggacccccggtttttttttttttccccgaccccgttacctaccgttaccgttacgtacgttaacgttccgttacccgttacccgtaccggaccggtaccgggtacccgtaccggtaccggaccgtaccgtaacccgtaacggtaccggtaacggttacggtaacgggttacggggtcgggtttacggggtttaccgggtaacgtaacggtaaccgttaaccgttaccgttaccgttaccgtaactaaccgtaacgtaccgacgtaccgtaccgtacccgtaccgtaacgtacgtaacgttaacgtttacgtacgtacgttacttacgttacgtacgtaaccgtaacgtaacgtaacgtaacgtaacggtacggttaccggtaccgttaccggttacggttaccgggttaccgggtaaccgggtaaccgggtaacgggtaacgggtaacggtaacggtaacgtaacgggtaaacggttaacggtacgggtacggtacgtaccgtaccgtacgtacgttacgttccgttaccg

SEQ ID NO: 240386 - DNA, 701 bp, Homo sapiens
  misc_feature: GYAE6OF01DRABR.45.35.D02.1.454.CMB.1.raw
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (686)..(686): a, c, t, g, unknown or other
  misc_feature (686)..(686): n is a, c, g, or t
tcagacgcgatcgacacgaccggtgctcgatttagcacacgatagttgggtttgggggaggaactgctcagttaggacccagagggaaccatggaacgccccagctcagtcttctcttcctcctgctactctggcctcccagacgacctccggaagtaaattgtcttcgacacgagtctccgagcctattctgtctctctcctcgaggggactacacgcccacctcnctancgcagggccagtcagtagtatacggactatacgttcggcttagtactactaatacgacgtccgtacgtaccggtaccggttccccgctccctagtactctagtcgacgtctccgtcacgacgtacggccctagcggtacctacgtacccacggtacgtgtacgtagggtcgggtacgggttgggtttcgacgtctacggtaccctccgtaacgttccgtaactaaccgactaccgtacgaccggtacctcccctaaccgtacgttaagtaacgtttacttcgtaaccgtaactttcgttaaacgtacgttacgtaacgtacgtacgtacgtaacggtaagtctaccgggtacctacgttcgtacggtcggtaacggggtacgaacggtaccgggtagtagtaacccgtagtaaacccgtagggtccgttaaccgtcggtaccaacgttaccccgnttcgttccgttaccg

SEQ ID NO: 240387 - DNA, 823 bp, Homo sapiens
  misc_feature: GYAE6OF01BZ5G5.45.35.D02.1.454.CMB.1.raw
  modified_base (772)..(772): a, c, t, g, unknown or other
  misc_feature (772)..(772): n is a, c, g, or t
  modified_base (815)..(815): a, c, t, g, unknown or other
  misc_feature (815)..(815): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctccagagaccgtaccggagtaattgtcttgacacagtctccgagcctatttctcgtctctctctccgaggggacacacgcccaccctctacgtatcgcgacgggcctagtacaagtagttataacgaaactactacgttggtaccttaggttaactactaaacgtaaccaacggtcccgtacggggacccgtaaccggggtcccccggtccttaccccgttactacgttacgtacgttagacgttaccggttccttacccgaggtaccggaacgggacccgtacgtcgggaccctaaccgtcccgacggtacccggtaaggttccggagggttcggggttcggggttcggggtttacggacctacgtacgtaccttacgtaccttccgtaccaacgtacgtccgaacgaccgtacccgtaacccctaacccgttaaacggtagtttaacgtttcgttttaccgacgtttaactttaccgttaacgtttaccgtaacgttaacaacggttaccggtacgttaacgtacgggtacggttcggacccttacggttccgtttaacggggtaccggggaaccgggtaacggtaaccggtaaggggtacggtaaacggtaccgttaaaccggaacggttacggngttacccggtaccgtacgtaacccgaactttcgtacccggttntttacccc

SEQ ID NO: 240388 - DNA, 647 bp, Homo sapiens
  misc_feature: GYAE6OF01D8WM1.45.35.D02.1.454.CMB.1.raw
  modified_base (177)..(177): a, c, t, g, unknown or other
  misc_feature (177)..(177): n is a, c, g, or t
  modified_base (187)..(187): a, c, t, g, unknown or other
  misc_feature (187)..(187): n is a, c, g, or t
  modified_base (223)..(223): a, c, t, g, unknown or other
  misc_feature (223)..(223): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (507)..(507): a, c, t, g, unknown or other
  misc_feature (507)..(507): n is a, c, g, or t
  modified_base (628)..(628): a, c, t, g, unknown or other
  misc_feature (628)..(628): n is a, c, g, or t
  modified_base (640)..(640): a, c, t, g, unknown or other
  misc_feature (640)..(640): n is a, c, g, or t
tcagacgcgatcgacacgaccggtgctcgatttagcacacgatagttgggtttgggggagaactgctcagttaggacccagagggaaccatggaagccccagctcagcttctcttcctcctgctactctgcctccgagagaccctcgggataaattgtcttagacacagtcctacancctattcgtntctctctctacggagggacacacgccctaccctctnagtcgacggcggcctagtacaaggttaacgtaattaagaaactcgttacgtacgggtcctaggtaatactaaagttaccaaggtccgtcggccggtaaccgggtcccccgctacctctacgttctagtcgatcgtccttccgaagtccggacggtcacgtacgcctaccgtcccacgtaccgaggttcgtacggtggggtcggttgggtcgaccacgtactaccgttcaccttcgacacgtaacncgacnccgtaccacttaccacgtaactattgttacactnttaacgttatctacgactaccgtatacgtattaggacttccgggtacctccgtacggtttcgtaccgggcggttaacggcaacgggtagactaaccgaacaggtacgtcggtagcccgtanaccctagttctntccgtcc

SEQ ID NO: 240389 - DNA, 767 bp, Homo sapiens
  misc_feature: GYAE6OF01BF5E2.45.35.D02.1.454.CMB.1.raw
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttagacacagtctccagcctattctgtctctctctccgagggganacncgcccaccctctcatcgcgacgggccagtcagtagtattaacgaactattacgttggtcctagtactacaagtacaacgtccgtcggccgaccggggtcccccgtccttcccgtacactcctatcgtcgtcgtccttaccgacggaccgacgggtaccctacgtcgggaccctaccgtaccccgaggcccgttaacggttccggaacgggttggggttaccggggtttcgggggttttcggaccgttaaccgtaacgttacccttaccgtacgttaccgtacctaaacgtaccgtaccgaacgtacccgaaccggtccccttaacccgaaacccgttacgtaagtttactttaccgggactttacggttaccttaagtttacccgtataaccgaacgtagtaccggtaacgtacgtacggtcggtacccgttcgttacccgtacgggttccgggaacggaccgggtacgtaagggtaccggtaacgtaccgaaccggtaacggtaaacggttcgggtacgtaccggtcgtaacctaccctcgttacccggtgttttacccg

SEQ ID NO: 240390 - DNA, 729 bp, Homo sapiens
  misc_feature: GYAE6OF01CHSVX.45.35.D02.1.454.CMB.1.raw
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggcctcccagagacctccggaagaaattgtcttgacacagtcctccagcctattcgtgtcctctctctccgagggganacacgcccaccctctcatgaccgngggccagtcagattatagaactatacgttggccttggtactacaaactacaaggtcccgtggacccgtaccggggtccccccgcttccctacgacttactatggacttcgtccttccgaggccgacgggtcccaagtcggaccaccgtacccagtccggtacggttcgagggtcgggtcgggttgggttcgacgaactagtacctttccgacttccgtaaaccactaagtaccgacgtacccgtaccgtacccctaacccgaaccgtacggtaagtttacgtttacgtacgtaacgtttacgttacttaccgttaccgtacgaaacggttaccgtacgtaaacgtacgttacggtaccggtccctaccgttaccgttaccgggtttccgggaaccgggtaccgggtacggtaaagggttcggaaggttaaccgtaacgtaaccggtaggttaccggtacgtccgtaccgtaccctaaccgtcgttccgtcgtttaccc

SEQ ID NO: 240391 - DNA, 832 bp, Homo sapiens
  misc_feature: GYAE6OF01BCPBZ.45.35.D02.1.454.CMB.1.raw
  modified_base (164)..(164): a, c, t, g, unknown or other
  misc_feature (164)..(164): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggaagaattgtcttgacncagtctccagcctattctgtctctctctccgaggggacacacgccctaccctctccatcgacgacgggcctaagtcaagtacgttaattaacgaaactattaccgttcggtaccttaggttaactaccaaacgttaacgaaacggtcccgtacggtccgtaccggggtcccccggacctccccgtaccattactatcggtactcgtcccgtttacccaggtccggaccggggtccctaaacggtcggacctacccgtacccgaacggcccgttaacggttccgtaaggggttcggggttcccgggtttaggggtttcgaccgaacgtaccgtacttaccgtactacctacaaccgtaatccaacgtaccacgtaccccctaacgaaaccgttacggttaaagtcgttttaccgacgtttaacgtttaacgttacgtttaacgtacgtttacaaccgtaacgttacggtaacgtaacggtaccggtttccgggtacccttaccgttacccggtttaaccgggttaccgggaacgggggtaacccgggggtaaaccggtcggggttaaccggaaacgggtttaaactaaacccggtaaaacggtaccggtttacgggaacgtacccggtaccggtaaccctacgtaacggtttccgttacggtttacccg

SEQ ID NO: 240392 - DNA, 772 bp, Homo sapiens
  misc_feature: GYAE6OF01DHW9S.45.35.D02.1.454.CMB.1.raw
  modified_base (556)..(556): a, c, t, g, unknown or other
  misc_feature (556)..(556): n is a, c, g, or t
tcagacgcgatcgacacgaccggtgctcgatttagcacacgatagttgggtttggggaggaactgctcagttaggacccagagggaaccatggaagccccagctcagcttctccttcctcctgcttactctcggcctcccagagaccctcggaataattgtcttgacacagtcctcagcctatttcgtcgtctcttctccgtcggaggggacacaccgccctacctctacgagcggacggacgggacctaggtacgaagtagttaagttaacgaactagttacgtcggtactaggtaactactaaacgtaacgaccggtaccgtccgggaccggtcccggggtccccgtacctaccttacgtaccgttacgtacgttacgtacgttaccggttacccttaccgaacggaccggtacgggcctaacggtccgacctaccgtaccgacggtaccggtacggttaggtcggggttcgggggttagggttcgggttacgaccgttaaccgttacggtaccctttaccgtcgttacaaccgtactaacacgtaaccgtacncccgtaacttaccggtaataacggtactttaccgtttagaaccgtttacttaccgttaaacgttctaaccggtacctaacggaccgttaacgttaccgaagttcccggtccggaccttcgttaccgtttcgggacgggaagtacggtaccgggtagagtaacgaccgtaagaccggtagtcggtacgtaccgagaccttatcggtccttgttaccg

SEQ ID NO: 240393 - DNA, 873 bp, Homo sapiens
  misc_feature: GYAE6OF01AQITM.45.35.D02.1.454.CMB.1.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccagagacctccggaagtaaattgtcttgacacagtcctccagcctattctgtctctctctccgagggganacagccaccctntcatcgcgacgggccagtcgaacggtagtaagttaacgaaactagttaccgttcggtaccgttaggtaactactaaacgttaacgaaccgtacccgttacgggacccggaccgggggttaccccccggtcgttccccgtactaacgttaccttaacgttacggtaacgtttaccgtccgtttacccggaacggtaccggaaccggggtaccctaccggtacggtacccgaaccgttaccccgaacggttacccggttaacgggtttaccggtacgggtttcggggtaccgggggtttcggggttttacggacctaaccggtacgttacccgtttacctacccttaaccggtaccctaaaccgtaacgttaccgaacgtaccgtaaccccgtaccccgtacccccgttaaacgtacggtaaacggtttaactttccgacgttaaccgtttacgttaacttaacgtcggtaaccaacgtaccgttaacgtacccgtaagggtccgtttaccggggtacccttaccgttaccggttaccggttaccggggacgggtaaccgggtacgtaacgggggtgaaacgttacgtaaccggaaacggttacggtccggtagtcccgtaacgtacccgtaaccgtacgttggttccgtttaccg

SEQ ID NO: 240394 - DNA, 807 bp, Homo sapiens
  misc_feature: GYAE6OF01ASLNL.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctacagtcgacgacgggaccacggtcaaggagttaattaagaacagttacgttcggccttaggtaactacgaaattacgaacggcctacgggaccgtaccggggttcccccggccttcccgtacacttccgtaagttggacttccgtcccgttaccgacggtaccggacggggacccctaacggttcggacctacgtaccccgacggtcccgttaagggttccgtacggggtcggggttcggggtttaggggtttcggacctaacggtaacggttaccttccgtaacttcccgtaactaacgtaactccgaacgtaccgtaaccgtacccccgtaaccccgtaaacgttaacggtaacgtttacggtttttacccgaccgtttaacgtttaccttaaccgtttacgttaccgttaacgaaaccgtaccgtaacggttaaccgtaacgggttaccgttcccgggaccgttacccttaccggttaccggtttaccgggaccggggtaacgggtaaccgtaagggtacggtaacgtaacgtaaccggaaacgtacgtaggtacgtacgtacgaccctacgtacgttcgttccgtacc

SEQ ID NO: 240395 - DNA, 258 bp, Homo sapiens
  misc_feature: GYAE6OF02HYX6J.45.35.D02.1.454.CMB.1.raw
  modified_base (253)..(258): a, c, t, g, unknown or other
  misc_feature (253)..(258): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgccatctgatcgatcgcgtctgagcgggctggcaaggcgcatagnnnnnn

SEQ ID NO: 240396 - DNA, 256 bp, Homo sapiens
  misc_feature: GYAE6OF02G3U4T.45.35.D02.1.454.CMB.1.raw
  modified_base (252)..(256): a, c, t, g, unknown or other
  misc_feature (252)..(256): n is a, c, g, or t
tcagacgcgatcgacacgaccggtgctcgatttagcacacgatagttgggtttggcacagacttcactctcacaatcagcagcctccaacctgaagatttgcagtctattactgtcaacagcgtacagattggccgctcactttcggcggagggaccaaggtggagatcaaacgaactgtggctgcaccatctgtcttcatcttcccgccatctgatcgatcgcgtctgagcgggctggcaaggcgcatagnnnnn

SEQ ID NO: 240397 - DNA, 509 bp, Homo sapiens
  misc_feature: GYAE6OF02IPRJ5.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttggcacagacttcactctcacaatcagcagcctccaacctgaagtattttcgctagttctatttactgtcaacagcgtacagattaggccgtctctacgtttcggcggacggaccgaggtaggagatacgaaacgaactggtagctcgcaccatctgtc

SEQ ID NO: 240398 - DNA, 503 bp, Homo sapiens
  misc_feature: GYAE6OF02F55QL.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatacttggcctggtatcaatacaagcctggccagggtccccggctcctcatatatgatgcttccagcagggccactggcatcccagccaggttcagtggcggtgggtttggcacagacttcactctcacatcagcagcctccaacctgaagtattttgctagttctattactgtcaacagcgtacagtattggccgctcactttcggcggagggaccaggtggagatacgaaacgaactgtaggctgccacactctgttcc

SEQ ID NO: 240399 - DNA, 497 bp, Homo sapiens
  misc_feature: GYAE6OF02GNF1T.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttgcacagacttcactctcacatcagcagcctccaacctgaagtatttgctagtctattactgtacaacagcgtacagtattggccgctcacgtttcggcggagggaccaggtggagatacaaacgaactgtggctgcaccatctgtc

SEQ ID NO: 240400 - DNA, 560 bp, Homo sapiens
  misc_feature: GYAE6OF02JI94F.45.35.D02.1.454.CMB.1.raw
  modified_base (203)..(203): a, c, t, g, unknown or other
  misc_feature (203)..(203): n is a, c, g, or t
  modified_base (273)..(273): a, c, t, g, unknown or other
  misc_feature (273)..(273): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggcctccagagacctccggaagaaattgtcttgacacagtctccagcctattctgtctctctctccgagggganacagccaccctctcatgcagggccagtcagagtatagaacatacttgcctggtatcaatacaagccgtcnggcccaggtcccgctcctcatctatgatcgctcaggcaggcactgccatccagtccaggtcaggtggtcggtggttcggcgtactacgacttcgactctacgtacaagtccaagccacgaccctcgaacctgtaacgtactttagcttagttcttattacctagtacaacgtagcgtactagtacttcgccgtacttcgacgttcgggacgtagggtaccgtaaggtcggaacgaacgtacgtaaacggtacgtacggtacggactacgactaccgtagtccgtacg

SEQ ID NO: 240401 - DNA, 263 bp, Homo sapiens
  misc_feature: GYAE6OF02F8UQP.45.35.D02.1.454.CMB.1.raw
  modified_base (255)..(263): a, c, t, g, unknown or other
  misc_feature (255)..(263): n is a, c, g, or t
tcagacgcgatcgacacgaccggtgctcgatttagcacacgataggtgggtttggcacagacttcactctcacaatcagcagccctccaacctgaagattttgcagtctattactgtcaacagcgtacagattggccgctcactttcggcggagggaccaaggtggagatcaaacgaactgtggctgcaccatcctgtcttcatcttcccgccatctgatcgatcgcgtctgagcggctggcaaggccgcatagnnnnnnnnn

SEQ ID NO: 240402 - DNA, 495 bp, Homo sapiens
  misc_feature: GYAE6OF02GPFF5.45.35.D02.1.454.CMB.1.raw
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatacttggcctggtatcaatacaagcctggccagggtccccggctcctcatctatgatgcttccagcagggccactggcatccagccaggttcagtggcggtgggtttggcacagacttcactctcacatcagcagcctccaacctgaagattttgcagtctattactgtcaacatcgtacagattggccgctcactttcggcggagggaccagggtggagatacgaaacgaactgtggctgcaccatctgtcc

SEQ ID NO: 240403 - DNA, 255 bp, Homo sapiens
  misc_feature: GYAE6OF02HRSDG.45.35.D02.1.454.CMB.1.raw
  modified_base (252)..(255): a, c, t, g, unknown or other
  misc_feature (252)..(255): n is a, c, g, or t
tcagacgcgatcgacacgaccggtgctcgatttagcacacgataggtgggtttggcacagacttcactctcacaatcagcagcctccaacctgaagatttgcagtctattactgtcaacagcgtacagattggccgctcactttcggcggagggaccaaggtggagatcaaacgaactgtggctgcaccatctgtcttcatcttcccgccatctgatcgatcgcgtctgagcgggctggcaaggcgcatagnnnn

SEQ ID NO: 240404 - DNA, 504 bp, Homo sapiens
  misc_feature: GYAE6OF02GROWW.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttgcacagacttcactctcacaatcagcacgcctccaacctgaagtattttgctagttctattactgtcaacagcgtacagattggccgctcacgtttcggcgagggaccagggtggagatacaaacgaacgtgtaggctgaccaccgatctgtc

SEQ ID NO: 240405 - DNA, 503 bp, Homo sapiens
  misc_feature: GYAE6OF02IU1DH.45.35.D02.1.454.CMB.1.raw
  modified_base (200)..(200): a, c, t, g, unknown or other
  misc_feature (200)..(200): n is a, c, g, or t
  modified_base (423)..(423): a, c, t, g, unknown or other
  misc_feature (423)..(423): n is a, c, g, or t
  modified_base (471)..(471): a, c, t, g, unknown or other
  misc_feature (471)..(471): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatccccagccaggttcaggtggcggtgggtttgcacagacttcactctcacaatcagcagccctccaacctgaagtatttgctagttctatttactgtcaacngacgtacagatggccgctcgactttcggcggacggaccgaggtggagntacaaacgaacgtgtggctgcaccatctgttc

SEQ ID NO: 240406 - DNA, 254 bp, Homo sapiens
  misc_feature: GYAE6OF02GO205.45.35.D02.1.454.CMB.1.raw
  modified_base (252)..(254): a, c, t, g, unknown or other
  misc_feature (252)..(254): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgccatctgtcgatcgcgtctgagcgggctggcaaggcgcatagnnn

SEQ ID NO: 240407 - DNA, 537 bp, Homo sapiens
  misc_feature: GYAE6OF02I93II.45.35.D02.1.454.CMB.1.raw
  modified_base (200)..(200): a, c, t, g, unknown or other
  misc_feature (200)..(200): n is a, c, g, or t
  modified_base (376)..(376): a, c, t, g, unknown or other
  misc_feature (376)..(376): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttcagcagggccactggcatcccagccaggttcaggtggcggttgggtttgcacgagacttcactctcacatcancacgcctaccaacctagaagtacttttgactagttcttaattacttgtactaactacgacgtacagtagttcggccgtctctaccgttcggacgggacgggaccgtagggtggaacggataccgaaacggtacgtaggtaggcgtcgacaccactcgtgtc

SEQ ID NO: 240408 - DNA, 535 bp, Homo sapiens
  misc_feature: GYAE6OF02I3C2M.45.35.D02.1.454.CMB.1.raw
  modified_base (201)..(201): a, c, t, g, unknown or other
  misc_feature (201)..(201): n is a, c, g, or t
  modified_base (341)..(341): a, c, t, g, unknown or other
  misc_feature (341)..(341): n is a, c, g, or t
  modified_base (523)..(523): a, c, t, g, unknown or other
  misc_feature (523)..(523): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccaggcaccctgtctctgtctccagggganacagccaccctctcctgcagggccagtaggagtgtcagtaagtacttaggctggtaccaacagaaacctggccaggcctcccaggctcctcatccatgatgcatccaacgagggtccctggcgtcccagacaggttccgnggcaggtggtctggggacagagttcactctcaccgtcagcagcctggacgcctgatgtattttgactagtttacttcgtgtcagtcagtccgttccgccaccgccgctcctacgtttccgggcgggggtaccaggggtggagtagtggagacgaacgtggtcggctgccacatctgtcttcncttcctcccgcc

SEQ ID NO: 240409 - DNA, 564 bp, Homo sapiens
  misc_feature: GYAE6OF02JDQ3M.45.35.D02.1.454.CMB.1.raw
  modified_base (201)..(201): a, c, t, g, unknown or other
  misc_feature (201)..(201): n is a, c, g, or t
  modified_base (393)..(393): a, c, t, g, unknown or other
  misc_feature (393)..(393): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtattagaacatacttggcctggtatcaatacaagcctggccagggtccccgctcctcatctatgatgcttccagcaggccactggcatcccagccaggttcagtggcggttgggtttggcacgagacttcactctcacaatcagcagcctcaacctgaatntttcgctagtctattacgtgtacaacagtacgtacagtacgttcggcccgtacttccgtacgtttcgggaccgggaagggtacccgtagggtcggaacgtacgttaacgaaaaccggtaacgttggtacggtaccttacggaccgtaccgtaagtttccgtacggtttacc

SEQ ID NO: 240410 - DNA, 514 bp, Homo sapiens
  misc_feature: GYAE6OF02G40SO.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttggcacagacttcactctcacatcagcagccctccaacctgaagtattttcgctagttctattactgtcaacagcgtacagtatcggccgtctctacgtttcggcggacggaccgagggtggagatacgaaacgtaactgtcggactcgaccaccgatctgttc

SEQ ID NO: 240411 - DNA, 541 bp, Homo sapiens
  misc_feature: GYAE6OF02I0N91.45.35.D02.1.454.CMB.1.raw
  modified_base (201)..(201): a, c, t, g, unknown or other
  misc_feature (201)..(201): n is a, c, g, or t
  modified_base (424)..(424): a, c, t, g, unknown or other
  misc_feature (424)..(424): n is a, c, g, or t
  modified_base (450)..(450): a, c, t, g, unknown or other
  misc_feature (450)..(450): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggttagggtttggctacgacgtacttcacgtctcgaacatcagcagccctacaacctgaagtatttgacagttctagttacngttacaacagctacagtattcggccnctctacgtttcggacggtagggaccgtagggtcggacgagtaacaacggtaacgtggtaggactcggaccaccaacgttccgtggttaccc

SEQ ID NO: 240412 - DNA, 515 bp, Homo sapiens
  misc_feature: GYAE6OF02HP926.45.35.D02.1.454.CMB.1.raw
  modified_base (376)..(376): a, c, t, g, unknown or other
  misc_feature (376)..(376): n is a, c, g, or t
  modified_base (470)..(470): a, c, t, g, unknown or other
  misc_feature (470)..(470): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacagggtccctggccgtcccagacaggttccgtggcagtggtctggggacagagttcactctcaccgtnagcagcctggacgcctgatgatttgctagtttacttctgtcagcagcgttccgccacgccgctctactttcgggcgggggccgagggtgagagngagagacgtgtggctgcaccgatctgtcttcatccttcccgctac

SEQ ID NO: 240413 - DNA, 504 bp, Homo sapiens
  misc_feature: GYAE6OF02IN2O9.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccactggcatcccagccaggttcagtggcggtgggtttggcacagacttcactctcacaatcagcagcctccaacctgaagtatttgctagttctattacttgtacaacagcgtacagattggccgtctctacgtttcggacggagggaccgaggtggagatacaaacgtaactgtaggctgcaccatctgtc

SEQ ID NO: 240414 - DNA, 532 bp, Homo sapiens
  misc_feature: GYAE6OF02IWBJH.45.35.D02.1.454.CMB.1.raw
  modified_base (261)..(261): a, c, t, g, unknown or other
  misc_feature (261)..(261): n is a, c, g, or t
  modified_base (472)..(472): a, c, t, g, unknown or other
  misc_feature (472)..(472): n is a, c, g, or t
tcagacgcgatcgacacgaccggtgctcgatttagcacacgatagttgggtttgggggaggaactgctcagttaggacccagacggaaccatggaagccccagcgcagcttctcttcctcctgctactctggctccagaaaccattggagaaatactgatgacgcagtttccagccaccctgtctgtgtctccaggggagacagccaccctctcctgcagggccagtaggagtgtcagtaagtacttaggctggtaccaanagaaacctggccaggctcccaggctcctcatccatgatgcatccaacagggtccctggctcccagacaggttccgtggcaggtggtctggggacagagttcactctcaccgtcagcagcctggacgcctgattgtattttgtagtttacttcttgtcagtcagtcgttccgccaccgccgtctccgtacgtttccggggcggggggtaccnggggtggagagtggagacgagtgtggctgcaccagtctgttcttcactccttcccgctac

SEQ ID NO: 240415 - DNA, 254 bp, Homo sapiens; identical to SEQ ID NO: 240127
  misc_feature: GYAE6OF02GSWJQ.45.35.D02.1.454.CMB.1.raw
  modified_base (253)..(254): a, c, t, g, unknown or other
  misc_feature (253)..(254): n is a, c, g, or t

SEQ ID NO: 240416 - DNA, 519 bp, Homo sapiens
  misc_feature: GYAE6OF02GTE7P.45.35.D02.1.454.CMB.1.raw
tcagacgcgatcgacacgaccggtgctcgatttagcacacgatagttgggtttggggggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacagggccactggcatcccagccaggttcagtggcagtgggtctgggacagacttcactctcaccatcagcagcctggaccctgacggtattttcgcctatttactactgtcagcagcgtggcgaccgagcgctcactttcggcggaggaccgaggtggagactacgaacgactgtgcgtgccacatctgtcttcacttccttcccgcctatcg

SEQ ID NO: 240417 - DNA, 507 bp, Homo sapiens
  misc_feature: GYAE6OF02HEBI1.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttcagcagggccatggcatcccagccaggttcagtggcggtggtttgcagagacttcactctcacatcagcagcctccaacctgaatatttgctagtcttattactgtacaactagtcgtacagtagttcgccgtctctaccgtttcggacggtacggaccgaggtggacgatacgaaacgtacgtgtagtctgcactatcgtgtc

SEQ ID NO: 240418 - DNA, 672 bp, Homo sapiens
  misc_feature: GYAE6OF02HQLCZ.45.35.D02.1.454.CMB.1.raw
tcagacgcgatcgacacgaccggtgctcgatttagcacacgatagttagggtttgggggaggaaacgtcgaacctcacgttaggacccgagaggaacccatggaagccccagctccagccttctcttcctccgtcgcgtactctggccttcccaggagacccgtccggagaaacttgtcgttgaccacacgtctccagccaattctgtctctctctccgagggagacgacgccgaccctctcgatgcacgggccagtcagtacgtattagaactattacgtggcctggtactcaatacaaggcctggccgacgggtcccccgctcctacgacttctagtgagtcggcttccagcgacgggccagtgcactccacgccgaggttccagtcggacggttgggttcgacgacgagtacgttccactctacgacaactcgacgtaccaacgtcccctaaccaaccgtagaaacgttacgtttacgactacgttacttaacgttaacgtcgtaacgtaacgagtccgttaaaccaaggttaccgtcgggaccctaccgtttaccgtaccggttttacgggaccggttaagggtacccgtagggtacggaacggtacgtaaccgaaacggtaacgttcggtaggtcgtacgaccgtaccgtacgtcggttacgttccg

SEQ ID NO: 240419 - DNA, 497 bp, Homo sapiens
  misc_feature: GYAE6OF02GSUXT.45.35.D02.1.454.CMB.1.raw
  modified_base (438)..(438): a, c, t, g, unknown or other
  misc_feature (438)..(438): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatacttggcctggtatcaatacaagcctggccagggtccccggctcctcatctatgatgcttccagcagggccactggcatcccagccaggttcagtggcggtgggtttggcacagacttcactctcacatcagcagcctccaacctgaagtattttgctagttctattactgtacaacagcgtacagattggccnctctacgtttcggcggagggaccaggtgagatacaaacgactgaggctgcacatctgtc

SEQ ID NO: 240420 - DNA, 710 bp, Homo sapiens
  misc_feature: GYAE6OF02FUK5Q.45.35.D02.1.454.CMB.1.raw
  modified_base (213)..(213): a, c, t, g, unknown or other
  misc_feature (213)..(213): n is a, c, g, or t
tcagacgcgatcgacacgaccggtgctcgatttagcacacgatagttgggttggggaggaacgtgctcctagtttaggacccagagggtaaccatggaaggccccaggctcagccttctcttcctcctagctactctggcctcccagagacctccggagaaattgtcttagacacagtctccagccagttctggtctctctctccgtaggggntacagcctaacctgtcatgcagggccagtcagtagtagttagaactaggtacgttggccgtggtatccaagtacaagcctggccagggtccccggctccgtcatcccagtcggatcgcctactaccaaacgacgggttacccctgggtccgtaccccagtaccgtacgggttcccgtacggcctacggtggggtcctagggggacaggtacgttcgaccgtctccgacccgttcaggtccgtaggtcccgtaggacggtacccgttagtacgtacgtaattttcggacttacggtttacttacgtgttccgagtcgtacggtccgttacccgtccctacggtcccgacgttacccgtacgttttccggggaccgggggtaacccgtaggggttacggaaggtacggtacgggtaacggtaaccggtaaccgttcgggttacggtaccgttaggaccctaccggtaccgttaccgtacggtttccgttaccgtaaccg

SEQ ID NO: 240421 - DNA, 555 bp, Homo sapiens
  misc_feature: GYAE6OF02F96TO.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccactggcctcccagactaggttccgtggctaggtgggtctgggacaggagttcacttctcacccgtcagcacgcctggacgcctgatgtattttgctagtttactctgtcagcagtcgttccgcctacgccgtctcgtacgtttccgggcggggtaccgaggggtcggaggtacgtacggacggtacgtaacgttgggtacggcgtcggacctacccgtagttccgtacggttccttacccg

SEQ ID NO: 240422 - DNA, 508 bp, Homo sapiens
  misc_feature: GYAE6OF02HEVPT.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccggctcctcatctatgatgcttccagcagggccactggcatcccagccaggttcagtggcggtgggtttggcacgagacttcactctcacaatcagcagcctccaacctgaagtattttgctagttctattactgtcaacagcgtacagtattcgccgtctctactttcggcggtagggaccgagggtggagatacgaaacgaactgtaggctgcaccatctgtcc

SEQ ID NO: 240423 - DNA, 546 bp, Homo sapiens
  misc_feature: GYAE6OF02G9BGY.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtggtctgggacagtagttcactctcaccatcagcagcctgcagtctgaatatttgcgtatttattattgtctgctaattataatgctcggtcccttgggtaccgttcggacccgtaggggtaccctaggggtttacgaaactaccgaaaacggtacgttacggttacggaccttaggtacccaaccgttattccgtagttcc

SEQ ID NO: 240424 - DNA, 497 bp, Homo sapiens
  misc_feature: GYAE6OF02FY5VE.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttgcacagacttcactctcacaatcagcagcctccaacctgaagattttgctagttctattactgtacaacagcgtacagattcggccgctcacttcggcggagggaccgaggtggagatacaacgaactgtggctgcaccatctgtc

SEQ ID NO: 240425 - DNA, 491 bp, Homo sapiens
  misc_feature: GYAE6OF02F187K.45.35.D02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtattagaacatacttggcctggtatcaatacaagcctggccagggtccccggctcctcatctatgatgcttccagcagggccactggcatcccagccaggttcagtggcggtgggtttgcacagacttcactctcacaatcagcagcctccaacctgaagattttgcagtctattactgtcaacagcgtacagattggccgctcactttcggcgagggaccaggtggagatacaacgaactgtggctgcacatctgtc

SEQ ID NO: 240426 - DNA, 510 bp, Homo sapiens
  misc_feature: GYAE6OF02G4EMB.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttcagcagggccactggcatcccagccaggttcagtggcggtgggtttgcacagacttcactctcacaatcagcagcctccaacctgaagtatttcgctagttctattactgtacaacagcgtacagattggccgtcttcacgtttcggcggtacggaccgaggtcggagtacgtacgaaacgaactgtaggcttcgcaccatctgtcc

SEQ ID NO: 240427 - DNA, 531 bp, Homo sapiens
  misc_feature: GYAE6OF02HVP61.45.35.D02.1.454.CMB.1.raw
  modified_base (286)..(286): a, c, t, g, unknown or other
  misc_feature (286)..(286): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcatgcagggccagtcagagtattagaacatacttggcctggtatcaatacaagcctggccagggtcccccggntcctcatctatgatgcttccagcagggccactggcatcccagcccaggttcaggtggcggtgggtttgcacagacttcactctacacaatcgagcacgccctccaacctgaagtattttgctagttcttattactgtcaacagacgtacagtagttggccgctctacgtttcggcggacggaccgaagggtggagagtacgaaacggtaacgtggtacggctcgacaccatcttcgtcttctacg

SEQ ID NO: 240428 - DNA, 506 bp, Homo sapiens
  misc_feature: GYAE6OF02GFUBZ.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttgcacagacttcactctcacaatcagcagcctccaacctgaatatttgctagtctattactgtacaacagacgtacagtattcggcgcttctacgtttcggcggacggaccgaggtggagactacaaacgtaacgtgtggctcgacaccatctgttc

SEQ ID NO: 240429 - DNA, 550 bp, Homo sapiens
  misc_feature: GYAE6OF02G34B1.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcacgggccacgtgcactccagccaggttcagtggcggtgggtttgcacgagacttcactctcacatcagcacgccctaccaacctgaacgtatttcgactagttcttatttactgtacaacagtacgtacagtacttcggcctctctacgtttcggacgggtacgggaccgagggttcggaagtacgtaaccgtaaaacggacgttaggtcggtacgtcggacctaccgacttcgtagttcc

SEQ ID NO: 240430 - DNA, 538 bp, Homo sapiens
  misc_feature: GYAE6OF02IOUHJ.45.35.D02.1.454.CMB.1.raw
  modified_base (200)..(200): a, c, t, g, unknown or other
  misc_feature (200)..(200): n is a, c, g, or t
  modified_base (283)..(283): a, c, t, g, unknown or other
  misc_feature (283)..(283): n is a, c, g, or t
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccagggganacagccaccctctcatgcagggccagtcagagtattagaacatacttggctggtatcaatacaagcctggccagggtccccgntcctcatctatgatgcttccagcgagggccagtgcatccagccaggttcaggtggcggtggtttggcacgagtacttcactctnaacatcagcacgcctaccaactgaagtntttgctagttctattactntacaacagtcgtacaagtattcggcctactcgtacgtttcggacggtacgggtaccgaggggtagaggtaacgtaacgaaacggtactaggtaggcgtacggcctaaccgtactccgtgttacc

SEQ ID NO: 240431 - DNA, 265 bp, Homo sapiens
  misc_feature: GYAE6OF02GF7VU.45.35.D02.1.454.CMB.1.raw
  modified_base (262)..(265): a, c, t, g, unknown or other
  misc_feature (262)..(265): n is a, c, g, or t
tcagacgcgatcgacacgaccggtgctcgatttagcacacgatagttgggtttggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgccatctgatcgatcgcgtctgagcgggctggcaaggcgcatagnnnn

SEQ ID NO: 240432 - DNA, 508 bp, Homo sapiens
  misc_feature: GYAE6OF02IUTRV.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttggcacagacttcactctcacatcagcagcctccaacctgaagtatttgctagtctattactgtcacagcgtacagtattggccgctctaccgtttcggcggacgggaccgagggtggaggatacgaaacgtaacgtgtggctgaccaccgatctgtc

SEQ ID NO: 240433 - DNA, 503 bp, Homo sapiens
  misc_feature: GYAE6OF02GRCWP.45.35.D02.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccggntcctcatctatgatgcttccagcagggccactggcatcccagccaggttcagtggcggtgggtttgcacagcttcactctcacatcagcagcctaccaacctgaacgtattttcgctagttcttattactgtacaacagtacgtacagtattggccgctctactttcggcggaggaccagggtgagatacaaacgactgtggctgacacatctgtc

SEQ ID NO: 240434 - DNA, 509 bp, Homo sapiens
  misc_feature: GYAE6OF02FSE4V.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccggctcctcatctatgatgcttccagcagggccactggcatcccagccaggttcaggtggcggtgggtttggcacgagacttcactctcacaatcagcagcctccaacctgaagtattttcgctagttctattactgtacaacagcgtacagtatggccgctcacgtttcggcggacgggacagggtggagacgtacaaacgtaactgtaggctgcacatctgtcc

SEQ ID NO: 240435 - DNA, 577 bp, Homo sapiens
  misc_feature: GYAE6OF02ITTPJ.45.35.D02.1.454.CMB.1.raw
  modified_base (200)..(200): a, c, t, g, unknown or other
  misc_feature (200)..(200): n is a, c, g, or t
  modified_base (461)..(461): a, c, t, g, unknown or other
  misc_feature (461)..(461): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttcagcagggccactggcatccagccagttcaggtggcggtgggtttgcacgagacttcgactcgtcaacgtaatcagcagccctacaactgaaagttatttcgactaagttctacttactgtactaacgacgtacgtactaacgtaacgttcgggacccncgtttacgtaaccggtttcggaccggggtaacggaaccgtagggtaggaacgtaagtaccgaaaacggtaacgtggtacggccgttacggacctaaccgaatttccgtattacccg

SEQ ID NO: 240436 - DNA, 541 bp, Homo sapiens
  misc_feature: GYAE6OF02HLLDN.45.35.D02.1.454.CMB.1.raw
  modified_base (201)..(201): a, c, t, g, unknown or other
  misc_feature (201)..(201): n is a, c, g, or t
  modified_base (411)..(411): a, c, t, g, unknown or other
  misc_feature (411)..(411): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccacgggtccccggctcctcatctatgatgccttccagcgacgggccacgtggcactcccagccaggttcaggtgggcggttgggtttcgcgacgagtaccttcactctacactatcagcacgcctaccaactgaagttntttgactagttcttattactgtacaacacgtactatagtagttcggcctcgtctaccgttcggacggacggacgagggtgacgtaactacgaaacgtacgtagtagcgtcgacgacctactcgtacttcc

SEQ ID NO: 240437 - DNA, 603 bp, Homo sapiens
  misc_feature: GYAE6OF02GVNGU.45.35.D02.1.454.CMB.1.raw
  modified_base (201)..(201): a, c, t, g, unknown or other
  misc_feature (201)..(201): n is a, c, g, or t
  modified_base (344)..(344): a, c, t, g, unknown or other
  misc_feature (344)..(344): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccaggctcctcatccatgatgcatccaacgcgggtccctggccgtcccagaccagggttccgnggcaggtgggtctgggacagtgttcactctcaccgtcagcagcctggacgcctgatgtatttgcttagtttacttctgtcagcagtccgttccgccaccgccgtctccgtaccggtttccggggccggggggtaccgtacggggttcgggaaggtagtacggacggaccggtaacgttcgggtacggtcgtacggaccgtaaccgtacgttccgttacggttcctttaccgtacgtttcccgtttccccgaccttaccg

SEQ ID NO: 240438 - DNA, 515 bp, Homo sapiens
  misc_feature: GYAE6OF02IP00F.45.35.D02.1.454.CMB.1.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
  modified_base (376)..(376): a, c, t, g, unknown or other
  misc_feature (376)..(376): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatgcagggccagtcagagtattagaacatacttggcctggtatcaatacaagcctggccaggtccccggntcctcatctatgatgcttccagcagggccactggcatcccagccaggttcagtggcggtggtttggcacagacttcactctcacaatcancagcctccaacctgaagattttgctagtcttattactgtcaacagcgtacagtattggccgtctctacttcggcggtagggaccgaggtcggagagtacaaacgtaacgtgtaggcttcggacctaccattcgtgttcc

SEQ ID NO: 240439 - DNA, 592 bp, Homo sapiens
  misc_feature: GYAE6OF02I3SWJ.45.35.D02.1.454.CMB.1.raw
  modified_base (201)..(201): a, c, t, g, unknown or other
  misc_feature (201)..(201): n is a, c, g, or t
  modified_base (585)..(585): a, c, t, g, unknown or other
  misc_feature (585)..(585): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtattagaacatacttggcctggtatcaatacaagcctggccacgggtccccggctccctcactctatgatgccttccagcacgggccactggcactcccagcccaggttccaggtgggcgggttggggttttggcaacgacgtacttcacgtctcaacaatcaagccagccctaccaacctgaaacgtatttcgctagttcttattactgtaccaacacgtacgtaacagtacttcggccgtcttccgtacgtttccgggacgggtacggacccgaagggttcggaagtaacgtaaccgaaaaccggtaacgttcggttagggacgtacggtacccgacgtacttaccggttnttacccg

SEQ ID NO: 240440 - DNA, 512 bp, Homo sapiens
  misc_feature: GYAE6OF02GV07H.45.35.D02.1.454.CMB.1.raw
  modified_base (201)..(201): a, c, t, g, unknown or other
  misc_feature (201)..(201): n is a, c, g, or t
  modified_base (369)..(369): a, c, t, g, unknown or other
  misc_feature (369)..(369): n is a, c, g, or t
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
  modified_base (508)..(508): a, c, t, g, unknown or other
  misc_feature (508)..(508): n is a, c, g, or t
tcagacgcgatcgacacgaccggtgctcgatttagcacacgatagttgggtttgggggaggaactgctcagttaggacccagagggaaccatggaagcctcagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccggctcctcatcctatgatcgcttccagcaggccactggcatcccagccaggttcaggtggcggtggttgcacgagacttcactcncacatcagcagcctcaactgaactatttnctagtcttatactntacacancgtanacgtattcggcctctctacgttcgcggacggacgaaggtggaacgacgtacaaacgtaacgtaggtcgcgtacgacgactactntacg

SEQ ID NO: 240441 - DNA, 488 bp, Homo sapiens
  misc_feature: GYAE6OF02G8T38.45.35.D02.1.454.CMB.1.raw
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatacttggcctggtatcaatacaagcctggccagggtccccggctcctcatctatgatgcttccagcagggccactggcatcccagccaggttcagtggcggtgggtttggcacagacttcactctcacaatcagcagcctccaacctgaagatttgcagtctattactgtcaacagcgtacagattgccgctcacttcggcggaggaccaggtggagatcgaaacgatgtggctgcacatctgtcc

SEQ ID NO: 240442 - DNA, 581 bp, Homo sapiens
  misc_feature: GYAE6OF02HLY1B.45.35.D02.1.454.CMB.1.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (373)..(373): a, c, t, g, unknown or other
  misc_feature (373)..(373): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctgtctccgagggganacagccacctctcctgcagggccagtaggatgtcagtaagtacttaggctggtaccaanagaaacctggccaggcctcccaggctcctcatccatcgatgcatccaacacgggtccctgggcctcccagcctaggttcaggtcggcggtgggttgctacagtacttcactcncaacatcagcagtctaccaactagaagtatttgactagtcttattactgtactacagacgtacagtagttcggccgtactcgtacgttcgggacggacgggaccgtaaggtacggtaagtacgtacgaaacggtacgttaggtaggtccgtacgtaccgtaaccgtacgttacgttacgttactttaccgtacgttcccgttaccccg

SEQ ID NO: 240443 - DNA, 511 bp, Homo sapiens
  misc_feature: GYAE6OF02IO0RK.45.35.D02.1.454.CMB.1.raw
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccaggggagacagccacctctcatgcagggccagtcagagtattagaacatacttggcctggtatcaatacaagcctggccagggtccccggctcctcatctatgatgcttccagcagggccactggcactcccagccaggttcagtggcggttgggtttgcacgagacttcactctcacatcagcagcctaccaactagaagtatttgactagtctattactgtacaacagtacgtacagtacttggccgtctctacgttcggcggaggaccgaggtggagatacaacgtactaggtagcgtagcaccgatcgtagttc

SEQ ID NO: 240444 - DNA, 528 bp, Homo sapiens
  misc_feature: GYAE6OF02H0CY2.45.35.D02.1.454.CMB.1.raw
  modified_base (338)..(338): a, c, t, g, unknown or other
  misc_feature (338)..(338): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacagggtccctggcctcccagacaggttccgnggcaggtgggtctgggacagagttcactctcaccgtcagcagcctggacgcctgatgtatttcgcctatttactactgtcagcagcgtggcgaccgagcgctcgacgttcggcggacgggaccgagggtaggagagtacgaacgacgtggtggctgcaccagtctcgtccttctacttccgtcccgtacc

SEQ ID NO: 240445 - DNA, 502 bp, Homo sapiens
  misc_feature: GYAE6OF02F0HUE.45.35.D02.1.454.CMB.1.raw
  modified_base (213)..(213): a, c, t, g, unknown or other
  misc_feature (213)..(213): n is a, c, g, or t
  modified_base (286)..(286): a, c, t, g, unknown or other
  misc_feature (286)..(286): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctntcatgcagggccagtcagagtattagaacatacttggcctggtatcaatacaagcctggccagggtccccggntcctcatctatgatgcttccagcagggccactggcatcccagccaggttcagtggcgtgggtttgcacagcttcactctcacatcagcagcctccaactgaagtatttgcagttactattactgtacaacagactacagattcggccgtctcactttcggcggacgggaccaggtagagatacaaacgaacgtagtaggctggccacatctgtacc

SEQ ID NO: 240446 - DNA, 553 bp, Homo sapiens
  misc_feature: GYAE6OF02GNA24.45.35.D02.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
  modified_base (448)..(448): a, c, t, g, unknown or other
  misc_feature (448)..(448): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccggntccctcatctatgatgcttccagcagggccactggcatcccagccaggttcagtggcggtgggtttggcacgagacttcactctcacaatcagcacgcctaccaacctgaagtatttgctagttctaattactagtcaacagtcgtaacagtattcggccncttctacgtttcgggacggtacgggaccgtagggtacggaagtacgtacgtaaaacggtaacgttcggtacggtcgtacggaccaaccgtagttcgtcgttaccg

SEQ ID NO: 240447 - DNA, 523 bp, Homo sapiens
  misc_feature: GYAE6OF02FXGY6.45.35.D02.1.454.CMB.1.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggntcctcatctatgatgcttccagcagggccactggcatcccagccaggttcagtggcggtgggtttggctacagacttcactctcacaatcagcagccctccaacctgaacgtattttgctagttctattactgtcaactagcgtacagacgttgccgtctcactttcggcggtagggaccagggtggacgtagtacaaacggtaacctaggtaggcgtgaccaccgtatcgtgttcc

SEQ ID NO: 240448 - DNA, 495 bp, Homo sapiens
  misc_feature: GYAE6OF02HE65R.45.35.D02.1.454.CMB.1.raw
  modified_base (201)..(201): a, c, t, g, unknown or other
  misc_feature (201)..(201): n is a, c, g, or t
  modified_base (466)..(466): a, c, t, g, unknown or other
  misc_feature (466)..(466): n is a, c, g, or t
  modified_base (491)..(491): a, c, t, g, unknown or other
  misc_feature (491)..(491): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactgcatcccagccagttcagtggcggtgggtttggctacagacgttcactctcacatcagcagcctccaacctgaagatttgctagtctattactgtcaactgacgtacagtattggcctctctactttcggcgaggaccgaggtggagntacaaacgactgtgctgcacatctnttcc

SEQ ID NO: 240449 - DNA, 526 bp, Homo sapiens
  misc_feature: GYAE6OF02I4ES3.45.35.D02.1.454.CMB.1.raw
  modified_base (310)..(310): a, c, t, g, unknown or other
  misc_feature (310)..(310): n is a, c, g, or t
  modified_base (380)..(380): a, c, t, g, unknown or other
  misc_feature (380)..(380): n is a, c, g, or t
  modified_base (442)..(442): a, c, t, g, unknown or other
  misc_feature (442)..(442): n is a, c, g, or t
  modified_base (505)..(505): a, c, t, g, unknown or other
  misc_feature (505)..(505): n is a, c, g, or t
  modified_base (515)..(515): a, c, t, g, unknown or other
  misc_feature (515)..(515): n is a, c, g, or t
  modified_base (523)..(523): a, c, t, g, unknown or other
  misc_feature (523)..(523): n is a, c, g, or t
  modified_base (526)..(526): a, c, t, g, unknown or other
  misc_feature (526)..(526): n is a, c, g, or t
tcagacgcgatcgacacgaccggtgctcgatttagcacacgatagttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacngggccacgtggcactccccagcctaggttcaggtggcaggtgggtctggggacagacttcactctcaccntcagcagcctggaccctgagtatttgcctatttactactgtcagcagcgtcgggccgaccgngctcgtcgtacgttcggcgggaggacgaagggtggagagtacaacgacgtgtcggctgcaccntgtcgtctcntccgtccnctn

SEQ ID NO: 240450 - DNA, 590 bp, Homo sapiens
  misc_feature: GYAE6OF02I94RS.45.35.D02.1.454.CMB.1.raw
  modified_base (346)..(346): a, c, t, g, unknown or other
  misc_feature (346)..(346): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctccaggctcctcatccatgatgcactccaacgtcgggtccctggccgtcccagaccgtacggttccgnggccaggttcggggtctggggacaggtacgttcactctcaccgtcagcagcctggacgcctgagtgtatttgcttagttttacttctcgtctagcgtacgtccgttccgccgaccgcccgctcgtaccggtttcggggccgggggtaccgaggggtcggaggtagtaggacgacgtacgtggtcggcgtcgacctaccgtacgtaccgttcgttcttaccgtacttcccgttacccgtcctacg

SEQ ID NO: 240451 - DNA, 671 bp, Homo sapiens
  misc_feature: GYAE6OF02JFIHO.45.35.D02.1.454.CMB.1.raw
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccacctctcatgcnggccagtcagagtatagaacatactgcctaggtatcaatacaagcctggaccgacgggtccccgactcctcgactctatgtactcgccttcgagtccgacgggccacgtggacctaccgtaccccgaggtcccgtacggttacgaacggttcggggtcgggttggggtttacggacgtacggtacgtaccttaccgacttccgtacctaactaactcgacgtaccacggtaccctacccgtaacgtacgtaagttactttcgacttacgttacgtttacttacgtactacgaacgtacggtacttacgaacgttcgtaccggcccgttacctacggttaccggtttaccggaacgggggtaacggtaacccgtagggttacggaagtaaccgtaacgaaacgtcggtacggtacgtacgtacgtccgaaccggtcttacggtacgttaccg

SEQ ID NO: 240452 - DNA, 697 bp, Homo sapiens
  misc_feature: GYAE6OF02JXLXA.45.35.D02.1.454.CMB.1.raw
  modified_base (200)..(200): a, c, t, g, unknown or other
  misc_feature (200)..(200): n is a, c, g, or t
  modified_base (280)..(280): a, c, t, g, unknown or other
  misc_feature (280)..(280): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaattgtcttgacacagtctccagccattctgtctctctctccgagggganacagccaccctctccatcgcgagggccagtcagagtatagacatactgctggtatcaatacaagtcctgccaggtcccgntccgtcatctatgactgcttccagtcaaggccacgtggctactcccgagcctacggttacacggttgggcggttaggggtttggaccgtactacggtactttaccgaacgttcctaaccgtaactaaacgttccgaacggtaccgtaaccggtaccccgttaacccgtaaacccgttaggtaaaacgttacgtttttacggaaccgttaacgggtttaccttaacgtttaaccgttacgtaccgtaaacctacgggttaccgtaacgtaacgttaaccgtttaacgggcccgtacttaccgttaaggttttccggaacgggtacggtaacccgtagggttacgaacggtacttaacggaacggtaaccgttaggtacggacttcggaaccgtacctacgttaccgtcgtttaacccg

SEQ ID NO: 240453 - DNA, 502 bp, Homo sapiens
  misc_feature: GYAE6OF02F69ER.45.35.D02.1.454.CMB.1.raw
  modified_base (201)..(201): a, c, t, g, unknown or other
  misc_feature (201)..(201): n is a, c, g, or t
  modified_base (412)..(412): a, c, t, g, unknown or other
  misc_feature (412)..(412): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccactggcatcccagccaggttcagtggcggtgggtttgcacagacttcactctcacatcagcagcctccaacctgaagtattttgcagttctattactntcaacagcgtacagattggccgtctcactttcggcggtacgggaccagggtggagatacgaaacgaactgtggctgaccaccactctgtc

SEQ ID NO: 240454 - DNA, 255 bp, Homo sapiens
  misc_feature: GYAE6OF02GB7JY.45.35.D02.1.454.CMB.1.raw
  modified_base (251)..(255): a, c, t, g, unknown or other
  misc_feature (251)..(255): n is a, c, g, or t
tcagacgcgatcgacacgaccggtgctcgatttagcacacgatagttgggtttggcacagacttcactctcacaatcagcagcctccaacctgaagatttgcagtctattactgtcaacagcgtacagattggccgctcactttcggcggagggaccaaggtggagatcaaacgaactgtggctgcaccatctgtcttcatcttccgccatctgatcgatcgcgtctgagcgggctggcaaggcgcatagnnnnn

SEQ ID NO: 240455 - DNA, 544 bp, Homo sapiens
  misc_feature: GYAE6OF02GF3JV.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccggctcctcatctatgatgcttccagcagggccactggcatcccagccaggttcagtggcggtgggtttgcacagacttcactctcacatcagcagccctaccaacctgaagtattttgactagttactatttactgtcaactagacgtaacagtattcgggcccgtcttctaccgtttcgggaccgggtacgggaccgtagggtggacgtaagtaccaaacggtaacgtggtggcgttcggacctaccgattcgtgttcc

SEQ ID NO: 240456 - DNA, 283 bp, Homo sapiens
  misc_feature: GYAE6OF02HBOM1.45.35.D02.1.454.CMB.1.raw
  modified_base (261)..(283): a, c, t, g, unknown or other
  misc_feature (261)..(283): n is a, c, g, or t
tcagacgcgatcgacacgaccggtgctcgatttagcacacgatagggtggggtttggcacacgacttcactctcacaattcagcagcctccaacctgaagattttgcagtctattactgtcaacagcgtacagattggccgctcactttcggcggagggaccaaggtggagatcaaacgaactgtggctggcaccatcgtgtcttcatccttcccgccatctgatcgatcgcgtctgagcgggctggcaaggcgcagtagnnnnnnnnnnnnnnnnnnnnnnn

SEQ ID NO: 240457 - DNA, 581 bp, Homo sapiens
  misc_feature: GYAE6OF02HR1RJ.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagacatacttggcctggtatcaatacagcctggccagggtcccccggctcctcatctatgatgcttccagcagggccactggcactcccagccaggttccagtgggccggtgggtttcggcacgagacttcactctcacatcagcacgcctccaacctgtaagtattttgactagttcttattacttagtcaacagcgtaacagtacgttcggcccgtcgttactaccgtttcgggacgggtaacgggacccgtaaggggttcggaacggtaactaaccgaaaccggtaaccgttggtacgggtaccgttacggacccaacccgtacgttacctcggtttaccg

SEQ ID NO: 240458 - DNA, 543 bp, Homo sapiens
  misc_feature: GYAE6OF02G87W5.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccactgcatccagccaggttcagtggcggtgggtttgcacgagacttcactctcacatcagcagcctaccaacctgaagtattttgactagtcttattactgtacaacagacgtacagtagtcggaccgtcttactacgtttcggacgggtacgggaccgtaagggtgggaacgtaacgtaccgaaacggaacgtaggtaggcgtacggaccaccgtattccgtgttaccg

SEQ ID NO: 240459 - DNA, 518 bp, Homo sapiens
  misc_feature: GYAE6OF02FZR4W.45.35.D02.1.454.CMB.1.raw
  modified_base (201)..(201): a, c, t, g, unknown or other
  misc_feature (201)..(201): n is a, c, g, or t
  modified_base (355)..(355): a, c, t, g, unknown or other
  misc_feature (355)..(355): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttgcanagacttcactctcacaatcagcagcctccaacctgaagtattttcgcagtctattactgtacaactagcgtacagtacttggccgctctacgtttcggcggacgggaccagggtggaggtatacgaaacgtacgtaggtggctcgccaccattcgtgttaccc

SEQ ID NO: 240460 - DNA, 494 bp, Homo sapiens
  misc_feature: GYAE6OF02G1YC5.45.35.D02.1.454.CMB.1.raw
  modified_base (201)..(201): a, c, t, g, unknown or other
  misc_feature (201)..(201): n is a, c, g, or t
  modified_base (436)..(436): a, c, t, g, unknown or other
  misc_feature (436)..(436): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctgccagggtccccggctcctcatctatgatgcttccagcagggccactggcatcccagccaggttcagtggcggtgggtttggcacagacttcactctcacaatcagcagcctcaacctgaacgattttgctagtctaattactgtcaacagcgtacagattggccnctcacttcggcgaggaccaggtgagatacaaacgactagtggactgccacatctgtcc

SEQ ID NO: 240461 - DNA, 568 bp, Homo sapiens
  misc_feature: GYAE6OF02IJO0D.45.35.D02.1.454.CMB.1.raw
  modified_base (201)..(201): a, c, t, g, unknown or other
  misc_feature (201)..(201): n is a, c, g, or t
  modified_base (510)..(510): a, c, t, g, unknown or other
  misc_feature (510)..(510): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggganacacgcccaccctctcatgcgacgggccagtcagagttattaagaacatacttggcctggtatacaataacaagcctggccgacgggtccccggctcctcatctatgatgcttcagcagggccacgtggcactccagccaggttcaggtggcgggttgggtttggcgacgagtacttctactctaccaacaatcagcacgccctaccaacctagaagtattttgactagttacttattactgtacaacacgcgtacagtagtcgccgtctctaccgtttcggcggtacggaccgtaggtagggtaacgngtaaccgaaacggtaacgttagtacggcgtacgaccgaaccgtattccgtgttacccg

SEQ ID NO: 240462 - DNA, 545 bp, Homo sapiens
  misc_feature: GYAE6OF02H5ZP6.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccagttcagtggcggtgggtttggcacagacttcactctcaacaatcagcagccctccaacctgaagtattttgactagtcttattactgtacaacagacgtacagtacttggaccgtctctacgtttcgggacggacgggaccaaggggttggaagtacgtaccgaaaacggtaacgttaggtcggactcggaccaacccgtagttccgtgttaccc

SEQ ID NO: 240463 - DNA, 738 bp, Homo sapiens
  misc_feature: GYAE6OF02JU5BG.45.35.D02.1.454.CMB.1.raw
tcagacgcgatcgacacgaccggtgctcgatttagcacacgatagttgggtttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggcctcctcatccatgatcgcatacccaacgtacggggtccctgggccgtacccgaaggtaccgtacgggtttccgtggccgtaggttcggggtacgtggggaacctaggtacgtttccaacgttccgtaccgaccggtcacggccgacggcccgtagggacgtcccgttaggactttcggttaacgtttttcggacgtttacggtttttaaccgttcgttacggttaccgtaacgggtccgtaacgggttccccggttttaccccggacccgtaaccgggtccccggttacgttcccgttaaccgggttttcccggggggaccggggggtaccgtacgggggttcggaaggtaccgtagggaaccggtaccggtacgtcgggtacgggtcctacggtaccgtaaccgtacgttccgttcggttcttaccgaccgtttcccgttcccgaccttacg

SEQ ID NO: 240464 - DNA, 533 bp, Homo sapiens
  misc_feature: GYAE6OF02G3JJ0.45.35.D02.1.454.CMB.1.raw
  modified_base (201)..(201): a, c, t, g, unknown or other
  misc_feature (201)..(201): n is a, c, g, or t
  modified_base (526)..(526): a, c, t, g, unknown or other
  misc_feature (526)..(526): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccggctcctcatctatgatgcttccagcagggccacgtggcactcccagccaggttcaggtgggcggtgggtttggcacgagtacttcactctcaacaatcagcacgccctaccaacctagaacgtattttgactagttcttattactgtacaacagtacgtacagtacgttcggccgtctctacgtttcgggacggacgggaccgagggtggagatacgaaacgacgtgtggctggaccactntctgtcc

SEQ ID NO: 240465 - DNA, 591 bp, Homo sapiens
  misc_feature: GYAE6OF02JDYOS.45.35.D02.1.454.CMB.1.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctnatctatgatcgcttccagccgagggccacgtggctactcccagcctaggttcaggtcggcggttgggttgcatagtcttcgactctcactatacagcacgcctccctaactagtaatattttcgactagttacttattactgtactaacacgtacgtacagtacgttacggccgtactcgttaccgtttcgggaccgggtaacgggtaaccgtaggggtcggaacggtaacgtaaccgtaaaaccggtaacgtacggttaggtaccgttacgaccgaacccgtacttccgttacgttaccg

SEQ ID NO: 240466 - DNA, 656 bp, Homo sapiens
  misc_feature: GYAE6OF02JUL8L.45.35.D02.1.454.CMB.1.raw
  modified_base (408)..(408): a, c, t, g, unknown or other
  misc_feature (408)..(408): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctccctggcagggccagtaggagtgtcagtaagtacgttaggctggtaccaacagaaacctggccaggctcccgaaggcctcctcactccgatcgatcgcactccaacgcgggtccctggccgtacccagacgtcggttccgtcggctaggttcgggacgtagggactagtacggtttacacgtccgtacaccgtnacgcacgtccgtggactcccgtagacttgtagttttcgacttacgttttacgttcttggttaccagtccgtacggtcccgtttcccgacgacccggtcccgtcgttaccgtaccggttttccggggccggggggtaacctcgggggtacgtacggacgttacgggaagtaacggtactcgggttggaccgttaggaccgtaccgagttccgttcgtacctttcgtacgttccccgttaccgccttacg

SEQ ID NO: 240467 - DNA, 540 bp, Homo sapiens
  misc_feature: GYAE6OF02IEPEP.45.35.D02.1.454.CMB.1.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggntcctcatctatgatgcttccagcagggccacgtggcatcccagccaggttcagtggcggtgggtttgcacagacttcactctcacatcagcacgcctaccaactgaacgtattttgactagttctattactgtacaacagtcgtacagtattcggccgtctcctacgtttcggacgggtacgggaccgtagggtaggaggtactaccgaaacggtaacgttggtacggctacggcctaccgtacttcgtgttcc

SEQ ID NO: 240468 - DNA, 539 bp, Homo sapiens
  misc_feature: GYAE6OF02HXD7E.45.35.D02.1.454.CMB.1.raw
  modified_base (304)..(304): a, c, t, g, unknown or other
  misc_feature (304)..(304): n is a, c, g, or t
tcagacgcgatcgacacgaccggtgctcgatttagcacacgatagttgggtttgggggaggaactgctcagttaggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagccctccaggctcctcatctatggtncatcctccagggcctcgtggtcgtccccgcaggttcagtggcaggtgggtctgggacaggtagttccactctacaccatccagcacgcctgctagtctagaagtattttgacgttattttattagtttgtctgtactattataatgtctcggcctggtaccgttcgccgagggaccgtagggttacgaaacgtcgaaacgtacgtggtacggtctcgactacctatcgtgtcttc

SEQ ID NO: 240469 - DNA, 513 bp, Homo sapiens
  misc_feature: GYAE6OF02GM7X2.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggttttggcacagacttcactctcacatcagcagcctccaacctgaagtattttcgctagttctattactgtacacagcgtacagtattgccgtctctacgtttcggcggacgggaccagggtggagtagtacgaaacgaacgtgtaggctgcaccactctgttacc

SEQ ID NO: 240470 - DNA, 587 bp, Homo sapiens
  misc_feature: GYAE6OF02H6QRE.45.35.D02.1.454.CMB.1.raw
  modified_base (200)..(200): a, c, t, g, unknown or other
  misc_feature (200)..(200): n is a, c, g, or t
  modified_base (352)..(352): a, c, t, g, unknown or other
  misc_feature (352)..(352): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccagggganacagccaccctctcatgcagggccagtcaagagtattagaacatacttggcctggtatcaatacagcctggccaggtccccgctctcatctatgatgcttcagcaggcactggcactccagccaggttccaggtgggcggtgggtttgcacngtaacctttcgactcgtacacaatcagcacgtcctaccaactgaacgtatttgactagttcttattactcgttacaagacgtacgttaacgagtacgtttacggcctccgttactacccggtttacgggaccgggtacgggacccgtaagggtacgggtacgaacgttaaccgaaaccgtaaccggttcggtacggtaccgttacgacctaacccgtacgttccttacggttacc

SEQ ID NO: 240471 - DNA, 596 bp, Homo sapiens
  misc_feature: GYAE6OF02HPPSU.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccagtggcactccagccaggttcaggtgggcggttggggtttggcacgacgtacttcaacgttctacaactaactcagccacgccctaccaaccgtagaacgttattttgacttacgttacgttaattactcgttacaacacgtcgtaacagtagttcggccgtacttcgtaccgtttcgggaccggaacgggtaccgtaaggggtcggaaggtaactaaccggtaaaaccggtaacgttggtacgggtactcggaacccgtacctacgttccgttgttaccc

SEQ ID NO: 240472 - DNA, 502 bp, Homo sapiens
  misc_feature: GYAE6OF02G8HAM.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccgctcctcatctatgatgcttccagcagggccactggcatcccagccaggttcagtggcggtgggtttggcacagacttcactctcacaatcagcagcctaccaacctgaagtatttgctagtctattactgtacacagcgtacagtagttgccgtctcactttcggcggtagggaccaggtggagatacaacgtaactgtaggctgaccacatctgtc

SEQ ID NO: 240473 - DNA, 510 bp, Homo sapiens
  misc_feature: GYAE6OF02FZE0K.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgtagggccagtcagagtattagaacatacttggcctggtatcaatacaagcctggccagggtccccggctcctcatctatgatgcttccagcagggccacgtggcatcccagccaggttcagtggcggtggttggcacagacttcactctcacaatcagcagccctccaacctagaagtatttgcagttcttattactgtacaacagcgtacagtattggaccgctctacgttcggcggaggaccgaggtggagatacgaaacgtacgtgtgctcgacaccatctgtcttacg

SEQ ID NO: 240474 - DNA, 552 bp, Homo sapiens
  misc_feature: GYAE6OF02ITZ0E.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcaggccagtcagagtatagaacatactggcctggtatcaatacaagcctggccagggtccccgctcctcagtctatgatcgtcttccagcacgggccacgtcggacactcccgagccaggttcagttcgggtcggtgggtttgctacgagtacttcactcgtcacctatcacgtcacgtcctcggtacccgtgtacggtatttgacctatttactacttcgtctacgtctacgcgttcggaccgtacgtacgcgtacctctaccgttcggaccgagggaccagggttcggacgaactacgaaactagtgtacgcgtagccgactagtctcgttac

SEQ ID NO: 240475 - DNA, 596 bp, Homo sapiens
  misc_feature: GYAE6OF02HQF6X.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccacgggtccccggctcctcactctatgatgcttccagcagggccacgtggcactcccagccaggttcaggtcggcggtgggtttgcacgagtacttcactctccaactaactcacgacgacgcctaccaacctagaaacgttattttacgctagttacttattacttacgtacaactacgtacgtaacgtagtagtcggccgtacttaccgtacgtttcggaccgggtaacgggaccggtaacgggtggaacggtaacgttacgaaaccgtaacgttacggtacggtacgtacgaccgtaaccgtacgttaccgttgttacccg

SEQ ID NO: 240476 - DNA, 556 bp, Homo sapiens
  misc_feature: GYAE6OF02JOZMV.45.35.D02.1.454.CMB.1.raw
  modified_base (200)..(200): a, c, t, g, unknown or other
  misc_feature (200)..(200): n is a, c, g, or t
  modified_base (411)..(411): a, c, t, g, unknown or other
  misc_feature (411)..(411): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgctcagcaggccactgcactccagccaggtcagtgcggtggttggctacagacttcactctcactatcagtcacgcctacacctgaacgtatttcgctagttctaattactntacaacagtacgttacagtagttcggcctctacgtaccgtttcggacggtaacgggacctagggtacgtaaggaacgttaacgaaaacggtaaccgttaggtacggtacgttaccggacctaccgtaacttccgttacggttccc

SEQ ID NO: 240477 - DNA, 570 bp, Homo sapiens
  misc_feature: GYAE6OF02GTLE7.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgcgggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcaggccagtcagagtatagaacatactggcctggtatcaatacaagcctggccagggtccccgctccgtcactctatgatcgcttccagcagggccacgtcggcactccgagccctaggttcaggtggcggttgggttggcacgagtacttcgactctacaacactacacgcacgaccctaccaacctacgaacgtacgttttacgacttacgttacttattacgtacgtacaactacgtacgtacagtagttcggccgtctcctacgtttacggacggtacgggaccgaggtacggaacgtactaacgaaacgtaacgtaggtacggtcgtacgacctacgtactcgttacg

SEQ ID NO: 240478 - DNA, 678 bp, Homo sapiens
  misc_feature: GYAE6OF02G379P.45.35.D02.1.454.CMB.1.raw
  modified_base (162)..(162): a, c, t, g, unknown or other
  misc_feature (162)..(162): n is a, c, g, or t
  modified_base (219)..(219): a, c, t, g, unknown or other
  misc_feature (219)..(219): n is a, c, g, or t
tcagacgcgatcgacacgaccggtgctcgatttagcacacgataggtttggggtttggggaggaacgtgctcacgttaggacccagagggaaccagtggaagtccccagcgtcagcttctcttcctcctcgctactctggctcccagaggaccttccggganaattggtcttggtacactagtctcctaagccattcctgtctctctctccaggggtanacgaggtccgaccctctcgatcgctaggggccagtcagagtacttacgaacatactggcctggtatcaatacgaagcctggcctacgggtccccggcgtccctccagtctactggactggcttcgagcgtagggcctactggtcatcccagcctagttcagtcggcggttgggtttacgcgtacgtagtaccgtttacgaccttcgtaccaacgtaacttcaacgtcaacggtaccctacctaaccgtagtaacgtaacttttacgactacgttacttaatttacttagtaacctaacagtaccgtaagaacgtacttcgggacccgtacgttccgtacggtttccggacggttaacgggtaaccgttagggtggtaacggtaacgttaaccggtaaacggtaacgttacggtaggttacggttacggtaccgtaaccgtacttcggttactttacccg

SEQ ID NO: 240479 - DNA, 523 bp, Homo sapiens
  misc_feature: GYAE6OF02HGB2O.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccacgtggcatcccagccaggttcaggtgggcggttggggtttggcacgagacttcgactctcacaatcagcacgcctcccaacctgaagtattttgctagttctaattactgtacaacacgacgtacagtagttcggccgtctctacgtttcggcgggagggaccgaggtggagactacgaaacgacgtgtggctgaccactatctgtc

SEQ ID NO: 240480 - DNA, 570 bp, Homo sapiens
  misc_feature: GYAE6OF02F2W4Z.45.35.D02.1.454.CMB.1.raw
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
  modified_base (341)..(341): a, c, t, g, unknown or other
  misc_feature (341)..(341): n is a, c, g, or t
  modified_base (389)..(389): a, c, t, g, unknown or other
  misc_feature (389)..(389): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccaggcaccctgtctctgtctccaggggagacagccaccctctcctgcacgggccagtaggagtgtcagtaagtacttaggctggtaccaanagaaacctggccaggctcccaggctcctcatccatgatgcatccaacgngggtccctggccgtccagacagggttccgnggcaggtcgggtctggggactaggtagtttcacttcgtccgaaccgtnacggcagcccgtggacgtccgtgatgtattttgctagtttacttcgtgtctagtctacgtcgtccgcctaccgtccgcctccgtaccgtttcggggccgggggtaccgtacggggtcggagtagtggagacgtaacgtggtggcgtcgcacgtacgtcgtcgtcttctacttcctccgtcc

SEQ ID NO: 240481 - DNA, 501 bp, Homo sapiens
  misc_feature: GYAE6OF02FKHNA.45.35.D02.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccggntccctcatctatgatgcttccagcagggccactggcatcccagccaggttcagtggcggtgggtttgcacagacttcactctcacatcagcagcctccaacctgaacgtattttgctagttctattactgtcaacagctacagtattgccgctcactttcggcggaggaccaggtggagagtcaaacgtaactgtggctgaccaccgatctgtc

SEQ ID NO: 240482 - DNA, 525 bp, Homo sapiens
  misc_feature: GYAE6OF02GWCPT.45.35.D02.1.454.CMB.1.raw
  modified_base (523)..(523): a, c, t, g, unknown or other
  misc_feature (523)..(523): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatacttggcctggtatcaatacaagcctggccaggggtcccccgctcctcatctatgatcgccttccagccaggggccacgtggcatcccagccaggttcaggtgggcggttgggtttcggacacgagtacttcactctacacaatcagcacgcctaccaactgaagtattttcgctagttctattactcgtacaacagcgtacagtactggccgctctacgttcggcggacggtaccgaggtggagtatacgaacgacgtgtagctcgaccactactcgtntc

SEQ ID NO: 240483 - DNA, 550 bp, Homo sapiens
  misc_feature: GYAE6OF02HGSVW.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccaggggtcccccgctcctcatctatgatgcttccagcgagggccagtggctacgtcccagcctaagttcagtgggcggttgggttcgcacgagtacttcactcacacaatcagcacgccctaccaaccgtgaacgtatttacgctagttcttattactgtacaacagcgtacagtattcggacctctcgtacgttcgggacggacggaccggtaggtggtaagacgtaccgaaacgtaacgtgtacggcttacggacctacgtacttcgtacgttcc

SEQ ID NO: 240484 - DNA, 590 bp, Homo sapiens
  misc_feature: GYAE6OF02FUP4M.45.35.D02.1.454.CMB.1.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttcagcagggccacgtggcactcccagccgtaggttcaggtcgggcgggttgggtttcggctacgagtacttcactctcaactatcagtcacgccctaccaaaccgtgtaaagtacttttagaccgtagttctactttactagtacaactagtacgtacgagtacgttcgggacctcttaccgtacgtttacgggcgggtaacgggtaaccgtaagggtcggaacgtaacgaacctaaaacggtaacgtaggtacgggtactacgtacgaccgaacttccgtacgttcc

SEQ ID NO: 240485 - DNA, 596 bp, Homo sapiens
  misc_feature: GYAE6OF02IU4O2.45.35.D02.1.454.CMB.1.raw
  modified_base (200)..(200): a, c, t, g, unknown or other
  misc_feature (200)..(200): n is a, c, g, or t
  modified_base (362)..(362): a, c, t, g, unknown or other
  misc_feature (362)..(362): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatactggcctggtatcaatacaagcctggccagggtccccggctcctcatctatgatgcttccagtcacggggccactcggcactcccagccagttcaggtggcgggttgggtttggctanacgtcttcactctcaactactcagccacgccctaccaaacctgaaacgttacttttgctacgttcttaacgtttacctgtacctaacacgttaccgtacacggttacttcgggaccgtcttacctacgttttaccgggccggaacggggtaccgaagggttcggaacggtacgtaaccaaaccggtagttacggtagggtacctcggacctacccgtacgttcgtgtttacccg

SEQ ID NO: 240486 - DNA, 653 bp, Homo sapiens
  misc_feature: GYAE6OF02JKKOP.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccagggganacagccaccctctcatcgcagggccagtcagagtattagaacatacttggcctggtatcaatacaagcctggccacgggtccccgctcctcactctatgatcgcttccagcagggccagtggcactcccgagccaggttccaggttgggcggttgggtttgcacgtaggtacctttcaccttctcaacgtactcacgcgactccctaccaaccgtgtaacgttacttttcgactagttacttacgtttacttacgttaccaaacgtacgtacgttaacgtacgttacgtttcggacccgtccgttaccgtaccggttttaccgggaccggggttaaccgggtaaccggtaggggttacgggtaacggtaacgttaaccgtaaaaccgggtaaccgttacgggttacggtaccggtacggtaccgtaacccgttacgttacgttcggtttaccg

SEQ ID NO: 240487 - DNA, 594 bp, Homo sapiens
  misc_feature: GYAE6OF02GFYGA.45.35.D02.1.454.CMB.1.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccaggcaccctgtctctgtctccagggganacagccaccctctcctgcagggccagtaggagtgtcagtaagtacttaggctggtaccaacagaaacctggccaggctcccaggcctcctcactccatgatgcatccaacgngggtccctggccgtcccagacctagggttcccgnggcgtaggtcgggtctggggacnggagttcactctacaccgtcagcacgcctgggacgccgtgtagttgtagtttttgcttacgtttacttcttcgttcagctacggtccgttccgccaccgtcccgtcctccgtaccggtttccggggccggggggtaaccgtaggggtcggacggtacgtggacggtacgaacgtggtcggctcggacctaccgagttcgtgtccttctacttccgtcccgtccg

SEQ ID NO: 240488 - DNA, 709 bp, Homo sapiens
  misc_feature: GYAE6OF02H1HBR.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggagacagccaccctctcatgcagggccagtcagagtattagaacatacttggcctggtatcaatacagcctggccgacgggtccccggctccgtcatcctaatgactgcttccagcacgggccacgtggcactcccagccaggttcaggttcgggcggttgggtttcggcgtaacgtacggtaccttccgtaaccttccgtactaacaaacgttccgaacggtacctacggtcccctaacccgaaaccgttacggtaaacgttactttttacggacgtaacgttacctttaacgtttacgttacgttaactaaaccgacggttacgtaaaccgtaaggtaacgtttcgggtacccgttcccgttaccgtaccggttttaccgggaccggggttaaccggggtaacccgtaaggggttacggtaacgggtaacgttaacccgaaaacggtaaccgttaggtcgggtacgtacggtacccgtaacccgttacgttaccgttcgtttaacccg

SEQ ID NO: 240489 - DNA, 670 bp, Homo sapiens
  misc_feature: GYAE6OF02HTPXZ.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaactatacttggcctggtatcaatacagcctggccagggtccccgctcctcatctatgatcgcttccagcacgggcccacgtggccacgtcccagtcccaggttccgaggttcgggtcggttgggttttcggcgtaacgacgtacctttcaaccgttccttacaacctaatccaggccaacgtccctaccctaaacctaggtaaacttagttttcgactaggttaccttaatttaccttagtaccgaaacctacgaccgttaacgaacggtatttccgggacccgtccttaccgttaccggttttaccgggacgggtaacgggtaacccgaagggtttacggaacggtaacgttaaccgaaaaccggttaacgttacgggtacggtaccgttacggaccaaccccgttaacgttcccgtttagtttacccg

SEQ ID NO: 240490 - DNA, 527 bp, Homo sapiens
  misc_feature: GYAE6OF02JCGO9.45.35.D02.1.454.CMB.1.raw
  modified_base (202)..(202): a, c, t, g, unknown or other
  misc_feature (202)..(202): n is a, c, g, or t
  modified_base (354)..(354): a, c, t, g, unknown or other
  misc_feature (354)..(354): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagacgacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccactggcatcccagccaggttcagtggcggtgggttgcanagcttcactctcacaatcagcagcctaccaacctgaagtatttcgactagttcttattactgtcaacagcgtacagtattcggccgtctctacgtttcggcgggtacgggaccgaggtggagtacgtaacgaaacggaacgtggtcggacgtcgaccacctagttctgttacc

SEQ ID NO: 240491 - DNA, 525 bp, Homo sapiens
  misc_feature: GYAE6OF02HGRWH.45.35.D02.1.454.CMB.1.raw
  modified_base (201)..(201): a, c, t, g, unknown or other
  misc_feature (201)..(201): n is a, c, g, or t
  modified_base (354)..(354): a, c, t, g, unknown or other
  misc_feature (354)..(354): n is a, c, g, or t
  modified_base (360)..(360): a, c, t, g, unknown or other
  misc_feature (360)..(360): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggtcagtggcggtgggtttgcanagctcnctctcacatcagcagcctaccaacctgaagtattttgctagttctattactgtcaacagacgtacagtattggccgtctcctacgtttcggcgggagggtaaccgagggtggagtacgtacgaaacggtactacggtaggtcgtcgaccgacctagtctgttacc

SEQ ID NO: 240492 - DNA, 615 bp, Homo sapiens
  misc_feature: GYAE6OF02H9A2V.45.35.D02.1.454.CMB.1.raw
  modified_base (202)..(202): a, c, t, g, unknown or other
  misc_feature (202)..(202): n is a, c, g, or t
  modified_base (328)..(328): a, c, t, g, unknown or other
  misc_feature (328)..(328): n is a, c, g, or t
tcagacgcgatcgacacgaccggtgctcgatttagcacacgatagttgggtttgggggaggaactgctcagttaggacccagagggaaccatggaagcccccagctcagcttctcttcctcctgctactctggctcccagagacctccggagaaattgtcttgacacagtctccagccattctgtctctctctccagggganacagccaccctctcatgcagggccagtcagagtattagaacatacttggccttggtatcaatacaagtcctggccacgggtccccggctcctcatctatgatgcttcagtcgacggccacgcgacnctcccgagccgacgttcgagggtgggcgggttaggggtttcggaccacgtagtaccttcgtaccttcctacaacgtaactcaagtcccaagtccctaccctaaacgttgaaacgtattttgactacgttactttattacttcgtacaacgtagcgtacaagtcttcggacgtcctacttaccgttcgggaccgggtaacgggaccgtaagggtcggaacggtacgtaacgaaacggtaaccgttggtacggtcgtacgaccgtaacccgtattaccgttggttaccc

SEQ ID NO: 240493 - DNA, 514 bp, Homo sapiens
  misc_feature: GYAE6OF02FEQMF.45.35.D02.1.454.CMB.1.raw
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
  modified_base (402)..(402): a, c, t, g, unknown or other
  misc_feature (402)..(402): n is a, c, g, or t
  modified_base (478)..(478): a, c, t, g, unknown or other
  misc_feature (478)..(478): n is a, c, g, or t
  modified_base (506)..(506): a, c, t, g, unknown or other
  misc_feature (506)..(506): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccactggagaaatagtggtgacgcagtctccaggcaccctgtctgtgtctccaggggagagagtcaccctctcctgcacggccagtcaaagtgtcgcaccggatacttagcctggtacccagcagagacctggccagccctcccaggcctcctcatctatggtgcatcctccgagggcctctggtcgtcccccgcaggttcagtggcagtgggtctgggacagntcactctcaccntcagcagcctgcagtctagaagtnttttgcgttatttattattgtctgctaatttataattgctggtcccttgggacttccggccagggacctagggtanaatacgaaacgtaactggtgctgcaccntctgtctc

SEQ ID NO: 240494 - DNA, 499 bp, Homo sapiens
  misc_feature: GYAE6OF02FWOPG.45.35.D02.1.454.CMB.1.raw
  modified_base (200)..(200): a, c, t, g, unknown or other
  misc_feature (200)..(200): n is a, c, g, or t
  modified_base (414)..(414): a, c, t, g, unknown or other
  misc_feature (414)..(414): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccacgtggcatcccagccaggttcagtggcggtgggtttgcacgagacttcactctcacatcacgcacgcctccaacctgaagtatttgctagtctattactntcaacagcgtacagtagttgccgtctctacgttcggcgacgggacgaggtggagtagacaacgaactggtgctgccacatctgtc

SEQ ID NO: 240495 - DNA, 521 bp, Homo sapiens
  misc_feature: GYAE6OF02F1YK8.45.35.D02.1.454.CMB.1.raw
  modified_base (308)..(308): a, c, t, g, unknown or other
  misc_feature (308)..(308): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccacctctcctgcagggccagtaggagtgtcagtaagtacttaggctggtaccaacagaaacctggccaggctccaggctcctcatccatgatgcatccaacngggtccctggcgtcccagacaggttccgtggcagtgggtctgggacagagttcacgtctcacgtcagcagcctggacgcctgatgattttgctagtttacttctgtcagcagtcgttccgccacgccgctcacgtttcgggccgggggtaccgagggtcggagagtgagtacgacgtgtggctgcaccatctcgtcttctatccttccgctac

SEQ ID NO: 240496 - DNA, 640 bp, Homo sapiens
  misc_feature: GYAE6OF02I5J6X.45.35.D02.1.454.CMB.1.raw
  modified_base (208)..(208): a, c, t, g, unknown or other
  misc_feature (208)..(208): n is a, c, g, or t
tcagacgcgatcgacacgaccggtgctcgatttagcacacgatagttggggtttggggggaggaactgctctagttaggacccagagggtaaccatggaagccccagctcagcttctcttcctcctgctactcgtggctccagagacctccgggagaacttgtacttgacacagtctccagccattctgtctctctctccgagggganacacgccaccctctcactgcagggccagtcagtagtattagaactatacttggcctggtatcaatacaagcctggcctacgggtccccggctcctactatcgtagtcgatcgccttccagccgtacgggccacgtcggaccacgtcccagccgtaggttcaggtcgggtacgggttgggtttcggcaacgtacggtaccttcgtaacttcctacgtaacaactcgacgtcaacgtccctaccgaacgtacgaacgttagtttcgactagttcttattaccgtgtacaactacgtacgtaacgtacgtacggttcggtaccgtccgtaccgttaccggtttaccgggacgggtacgggtaccgtacgggtacggtacgtagtaccgaaacgtacgtacggtacggcgtacggcctaccgtcgtactcgtaccc

SEQ ID NO: 240497 - DNA, 581 bp, Homo sapiens
  misc_feature: GYAE6OF02HTBCD.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggganacagccaccctctcatgcagggccagtcagagtattagaacatactgctggtatcaatacaagctggccgaggtccccggctccccatctatgatcgacttccgagcacggccacgtggcactcccagcctaggttcaggtcggcggttgggtttcggcgtacgagtacttacactctcaacatcagcagcctaccactgaactgtttcgactatcttaacttactacgttacaaacgtagaccgtaatagtagttcggacccgtcttaccgttacgtttccgggacggtaacgggacccgtaaggggtacgagtaacgtaaccgaaacgtaacgtaggttacgcgtacgaccgtaaccgtattaccgttgttaccttacg

SEQ ID NO: 240498 - DNA, 540 bp, Homo sapiens
  misc_feature: GYAE6OF02IFD5M.45.35.D02.1.454.CMB.1.raw
  modified_base (200)..(200): a, c, t, g, unknown or other
  misc_feature (200)..(200): n is a, c, g, or t
  modified_base (453)..(453): a, c, t, g, unknown or other
  misc_feature (453)..(453): n is a, c, g, or t
  modified_base (527)..(527): a, c, t, g, unknown or other
  misc_feature (527)..(527): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccacgggtccccgctcctcatcctatgatgcttcagcgagggccacgtggcactcccagcctaggttcaggtcgggcgggttgggtttggcacgagtacttcactctacacatcagcacgcctaccaacctgaatctttgctagttctattactctacaacagtcgtactagtacgtggccncttactacgtttcggacgggacgggaccagggtcggagacgtaccgaaacgtacgtgtgcgtagaccgtacctnttccgtgttaccc

SEQ ID NO: 240499 - DNA, 758 bp, Homo sapiens
  misc_feature: GYAE6OF02GN6I9.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatactggcctggtatcaatacaagctggccaggcctccaggcctcctcatccatgatgcactccaacgtcggggtcccctgggcccgtacccaaggaccgtacgggtttcccggtggaccgtaggttcgggggttactagggggacctaggtacgtttccaaccgttcctaccgaccgtcgaacgtccgacggtcccgttgggacgtcccgtagtacgttaggttaactttttcggacgtttaacgtttttacccgtttcgttcggttacaacggttccgtaacgggttcccggtttaccccgaccccggtacccggcccggttcccttacccgttacccgggttttacccgggggggaccccgggggggggtaaacccgttagggggggttacgggacgggttaacggttacgggggtaaaccgggttaaccgggtaaaccggtttcggggttacggggtacccgttcgggtaacccgtaaccccgttaacgtttcccggtttcggtttaacccg

SEQ ID NO: 240500 - DNA, 736 bp, Homo sapiens
  misc_feature: GYAE6OF02IL06A.45.35.D02.1.454.CMB.1.raw
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcctgcagggccagtggagtgtcagtaagtacttaggctggtaccaacagaaacctggccaggctcccgaggctcctcatccatgatgcatccaacgtacggtccctggccgtcccaagtaccgtacggttccggtggacaggttcggggtcgttaggggacctaagggtacgtttcaccgttccgtaccacctaatccgagccacgtcccgtacgggacccctgggtaacggtacgtttttcgacccgttaattttaaccgttaccgttaggttccgtaacgtaccgtacgggtaccggttagggaccccggtaaccgggtagggacccgttcccgttacccgttaaaccggtttttcccgggggaccgggggtaaacggggtaaccccgtaaagggggttaccgggaaaggtaccgtaaccggtaaaacggtaaccggtacggttcggggtaccgtacggacccgtaaccgttaagttcccgttacggttacctttccgtaccgtttcccgttaccccccgg

SEQ ID NO: 240501 - DNA, 792 bp, Homo sapiens
  misc_feature: GYAE6OF02G6XV9.45.35.D02.1.454.CMB.1.raw
  modified_base (201)..(201): a, c, t, g, unknown or other
  misc_feature (201)..(201): n is a, c, g, or t
  modified_base (385)..(385): a, c, t, g, unknown or other
  misc_feature (385)..(385): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcaggagtattagaactatacttggcctggtatcaatacaagcctggccgacgggtcccccggctccctcactctatgtatcgtccttccagccgacgggccacgtggcactcccgaagccgaggttcaggttcgggcgggttgggtttcggctacgngtacttcactcacacatcacgcacgtccctaccaacgtagtaacgttacttttacgacttacggttacctttaatttaccgttacgtaaccctaaaacgtacgtaacccggttaaacgtaaacggttacggtttaccggggtacccgttaacccgttaccctttaacccggggtttttacccgggggaaccgggggttaaacccggggggtaacccggggttaaacggggggttaaccggggggtaaaccgggttaaacccgggtttaaaaaccccgggtaaaaaacccgggggttaaccccggtttaaacgggggtttacccggggtaacccggtttaccgggtaacccccggttaaacccccggttaacggttttaccccgggtttaccggtttttaacccccgg

SEQ ID NO: 240502 - DNA, 1009 bp, Homo sapiens
  misc_feature: GYAE6OF02IZC7Q.45.35.D02.1.454.CMB.1.raw
tcagacgcgatcgacacgaccggtgctcgatttagcacacgatagttgggtttgggggaggaacgtgctcagttaggaccagagggaaccatggaagccccagctcagcttctcttcctcctgctactctggctccagagacctccggagaattgtcttgacacagtctccagccattctgtctctctctccgaggggacacgacgccctaaccctcttcaagttcggactacggggcccaagttccgaagacggttaattaacggaaactagtttaccttgggacccgttaggttaactaccgtaaagtaacctaacggtaccccgttagggaccccggtaacgggggttacccccccgggtcttaccccgttcccgtaaacgttaccgtttaacgttacggaacgtttaccggtacccgttttcccgaaacgggtacccgtaaacgggggtacccctaaacggtttccgggtaacccgtaaaccgttccccggaaacggtacccggtaaacgggttttaccggaacgggttttccgggggcccgggggtttacggggggtttttccggaacccggtaaccgtaaacggttcccgttttacccgtaaccggtttacccttaacccgtaaccggtaaacgtttacgaacccggtacctaaccggtaccccctttaaccccggaaacccgtttaagggaaaaccgttttggttttaacccggaccgttaaacgtttaccgtttaaactttttaaccggtaccgtttaacctaaaaccggttaccggtaaccgtttaacggaacggttttaccgttacggggtaacccttcccggttttaaaccttacggggttttaccccgggaaaccggggtaaacgggtaacccggttaacggggttacggtaaacggtaaccgtttaacccgaaaacggggttaaccgtttacgggtaacggttcccggttaacggacccgtaacccgttaacggtttcccgttacgggtttaaccc

SEQ ID NO: 240503 - DNA, 568 bp, Homo sapiens
  misc_feature: GYAE6OF02H9LEF.45.35.D02.1.454.CMB.1.raw
  modified_base (310)..(310): a, c, t, g, unknown or other
  misc_feature (310)..(310): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (437)..(437): a, c, t, g, unknown or other
  misc_feature (437)..(437): n is a, c, g, or t
  modified_base (477)..(477): a, c, t, g, unknown or other
  misc_feature (477)..(477): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagataccactggagaaatagtggtgacgcagtctccaggcaccctgtctgtgtctccgaggggagagagtccaccctctcctgcacggccagtcaaagtgttcgcacggatacttagcctggtaccagcagagacctggccagccctcccgaggcctccctcactctatgggtnccatccctccgagggtcccttcgtgggtccgtcccccgcctagggttccaggtcgcgtaggttggggtctgggacaggtcgttcacttcctcacctntacngcacgtcctgactagtctagaagttntttgacgttattttattattgtctgacttattaataagtntcgtcggtcctagggtccgttccggaccgagggacctagggtacaaacgtcgaaacgacgtcgtggctcgaccaccgtatctcgttctacc

SEQ ID NO: 240504 - DNA, 555 bp, Homo sapiens
  misc_feature: GYAE6OF02IOH0F.45.35.D02.1.454.CMB.1.raw
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
tcagacgcgatcgacacgaccggtgctcgatttagcacacgatagttgggtttgggggaggaactgctcagttaggacccagacggaaccatggaagccccagcgcagcttctcttcctcctgctactctggctcccagaaaccattggagaaatactgatgacgcagtttccagccacctgtctgtgtctccaggggaaanagccacccctctcctgctgggccagtcagagtgttagcaaccacttagcctggtaccagcagaaacctggccaggcctccagactcctcatttatggttcttctaccaggggccnctggtactcccagccaggttcagtgccagtggtctgggacagagttcactctcaccatcagcagcctgcagtctgaagtattttgacttagtttactttcgtgtcagtctagttatactataactggtacttagttagtagttttcggaccgtaggggacctaagtcgtagaaatacgaaacgtacgtggtacgctgacctacctagttcttcgttactttactacttccttaccccg

SEQ ID NO: 240505 - DNA, 698 bp, Homo sapiens
  misc_feature: GYAE6OF02JGECH.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagacatacttggcctggtatcaatacagcctggccagggtccccgctcctcatctatgacgtcgcttccagccagggaccactggctagtcccagccaaggttcaggttggcggtgggtttggctacgagtacttcactccgtcaacgtaatcgtaacgctacgccccttaccaaacccgttaggaaacgttacgtttttacggaacctaggttacccttaatttaacccgttgttacccgaaaacgtacggtaccgttaaaccgtacgtaaccgtttacgggacccgggttaccctttaccgtaacccggtttttaccggggtaccgggtaacgggggtaacccgttaacggggttcggggaaacgtaaccggttaaccggtaaaacccgggtaaacgttacggtaacgggacccggtttacggaaccgtacccgtaacgttacccgtggttttaaccccg

SEQ ID NO: 240506 - DNA, 509 bp, Homo sapiens
  misc_feature: GYAE6OF02GL6QN.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactggcatcccagccaggttcagtggcggtgggtttgcacgagacttcactctcacatcagcagcctccaacctgaatatttgctagttctattactgtacaacagcgtacagagtcggccgtctctacgtttcggacggacgggaccagggtggagtatacgaaacgtacgtgtggctgaccaccactctgtc

SEQ ID NO: 240507 - DNA, 548 bp, Homo sapiens
  misc_feature: GYAE6OF02H1R8I.45.35.D02.1.454.CMB.1.raw
  modified_base (199)..(199): a, c, t, g, unknown or other
  misc_feature (199)..(199): n is a, c, g, or t
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcgacgggccacgtggcactcccagccgtaggttcaggttgggcggttggggtttcgcacaggtaccttcacgttctacaactaactcacgcacgccctaccaactgaaagtntttgctagtctattactntacaacngactanagtntcggcctctcgtacgtttcggcggacgggaccagggtggacgtagtaaccgaaacgtacgtggtacggcgtacgcctaccgtattccgtgttacc

SEQ ID NO: 240508 - DNA, 807 bp, Homo sapiens
  misc_feature: GYAE6OF02IY89Y.45.35.D02.1.454.CMB.1.raw
  modified_base (185)..(185): a, c, t, g, unknown or other
  misc_feature (185)..(185): n is a, c, g, or t
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaattgtcttgacacagtctccagccattctgtcnctctctccagggganacagccctacctcncatcgcaggccagtcagagtactagaacatctggcctagtatcaatacagcctggccgtacgggtcccccggctccgtcacttacgtacgtgagtcgtcgttaccaggcccgtacgggtcccaacgtcgggcctaccttaccccgaggtccctaacgggttccgtaacgggttccgggaccgggggttttcgggttttacgggaccgtaacgttaacggtaacgggttttccctaaacccggtcccggtttacccaacccgggtttccgaaccgggttcccgtaaccgggtacccgttacgggtaacggtcccgttaacggtacgttacgggtttaacgttttccggtaccggtttaaccggtttttaaccgtttccggttacggttacctacggtaccgttacggttaccggtttacccggccccgttaacccggtcccggttacttccccgggttaacgtttcccggggtaccgggggtaccgtacgggggttcggaaacgggcggttacgggtaaccgtacgggtaacccggttggtacgggttacgtaccggtacccgtaccggtaccgtttaccggtaccgtttaccg

SEQ ID NO: 240509 - DNA, 535 bp, Homo sapiens
  misc_feature: GYAE6OF02GWPV1.45.35.D02.1.454.CMB.1.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (525)..(525): a, c, t, g, unknown or other
  misc_feature (525)..(525): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggtanaccagcccaccctctcatgcagggccagtcagagtattagaacatacttggcctggtatcaatacaagcctggccagggtccccgntcctcatctatgatgcttcagcagggccacgtcggcatcccagccaggttcagtggcggttgggtttcggctacagtacttcactctacaacaatcagcacgccctccaaccgtgaacgtactttcgctagttactattactgtacacgagcgtacagtattcggccgtctccgtacgtttcggcggtacggaccgaggtggacgactacgaaacgtactgtcggcgtggccacgtntcgtgttccg

SEQ ID NO: 240510 - DNA, 571 bp, Homo sapiens
  misc_feature: GYAE6OF02HQ013.45.35.D02.1.454.CMB.1.raw
  modified_base (200)..(200): a, c, t, g, unknown or other
  misc_feature (200)..(200): n is a, c, g, or t
  modified_base (376)..(376): a, c, t, g, unknown or other
  misc_feature (376)..(376): n is a, c, g, or t
tcagacgcgatcgacacgaccggtgctcgatttagcacacgatagttggggtttgggggaggaactgctcagttaggacccagagggaaccatggaagccccagctcagcttctcttctcctgctactctggctccagagacctccggagaaattgtcttgacacagtctccagccattctgtctctctctccagggganacagccaccctctcatgcagggccagtcagagtattagaacatacttggcctggtatcaatacaagctaggccagggtccccgctcctcatctatgatgcttcagcagggccatggcactccagccaggttcaggtgggcggttgggtttggctacgacgtacttcacgttcctanaccaatcagtcacgcctaccaactagtaagtacttttacggactagttactaatttacctagtacaacgtacgtacgttaacaagtagttcggaccgtctcctacgtttcggacggacgggtaccgtaagggtcggaagtaagtaccgaaacggtacgtaggtacggtcgtagaccgacctagttcctagttacc

SEQ ID NO: 240511 - DNA, 685 bp, Homo sapiens
  misc_feature: GYAE6OF02IOL8N.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaattgtcttgacacagtctccagccattctgtctctctctccgaggggacacagcccacctctcatgcaggccagtcagagtattagaacatactggcctggtatcaatacaagcctggccacgggtccccgctcctcatcctagtaggatcgtcttccagtccgaggggccctacgtgggcctactaccccgaagtcccgaagggtttccaaggttcgggcgggttaggggttttcggactacgagtacctttaccacgttcctaccgaactaactcacgacacgtcccctaccctaaaccttacgaaacgttacttttacggacctaacggtttacctttaaacttaccgttagttaacctaaaccgtacgtaccgttaactaacggttacgtttacgggacccgttacgttaccgttaacgttttccgggaccggggtaacgggacccgtaaggggtaggaacggtaacgtaaccggaaaccggttaacgtggtacggtcctacgtcccgacctacgttccgtgttacccg

SEQ ID NO: 240512 - DNA, 573 bp, Homo sapiens
  misc_feature: GYAE6OF02IH7QT.45.35.D02.1.454.CMB.1.raw
  modified_base (342)..(342): a, c, t, g, unknown or other
  misc_feature (342)..(342): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccgaggctcctcatccatgatgcatccaacacgggtccctggcctcccagaccaggttccgnggctaggtgggtctgggacagacgttcactctcgaccgtcacgcacgcctggacgcctgattgtacttttgcttagtttacttcgtgtcagctagtccgtccgccaccgccgtctccgtacgtttccgggacggggaccgtagggtacggtagacgtgacggtacgacgtgtcggcgtcgactacctagtcgttcgttcgttacgtacgttacccgttccccggactaccg

SEQ ID NO: 240513 - DNA, 565 bp, Homo sapiens
  misc_feature: GYAE6OF02GRUJ5.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcacgggccacgtggcactcccagccgtaggttccaggtcggtcgggttggggtttggcgtacgagtaccttctactctacaacatcacgcacgcctccaactgaagtactttgctagttactattactgtacaactacgactacagtactcggcctctctacggtttggtacgggaggacgtagggtggaacggtagtaaccgaacggtaacgttggtacggacgtcgtacctaacccgtagttccgtgtttacccg

SEQ ID NO: 240514 - DNA, 755 bp, Homo sapiens
  misc_feature: GYAE6OF02JFSOQ.45.35.D02.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagacgcgatcgacacgaccggtgctcgatttagcacacgatagttgggtttgggggaggaacgtgctcagttaggacccagagggaaccatggaagccccagctcagcttctcttcctcctgctactctggctccagagacctccggagaattgtcttgacacagtctccagccattctgtctctctctccgagggganacagccacctctcatgcagggccagtcagagtattagaacnttacgttggcctggtatactaatacgaagtcctcggacctacggggtcccccggacttccctacagttcctaatcgtaacgttcgccttccgagtccgaagggtcccacggtggaccacgtcccgaagccgtaacggtttcaggttcgggcgggtttacgggtttcgggactaacgtaggtaccttttccgaacctttccgttacgaaacgttaacgttacgacgtaccgaccgtacccgttacccgaaccgttaacgtaaacgttacgtttttacgaccgttaacgttacctttaacgtttaacgttacgttaccgtaaccgtaacggttaccgttaaccgtaacggtacgtttaccgggtacccgtaccgttaccgttaccgttttacggggaaccgggtacgggtaaccggaggggttacgggacgtaaccggttaacggtaaacggttaaccgtacgggttacggtaccgtacggtacccgtaaccgtacggttaccgttacgttcccg

SEQ ID NO: 240515 - DNA, 711 bp, Homo sapiens
  misc_feature: GYAE6OF02JVAJ9.45.35.D02.1.454.CMB.1.raw
  modified_base (200)..(200): a, c, t, g, unknown or other
  misc_feature (200)..(200): n is a, c, g, or t
  modified_base (307)..(307): a, c, t, g, unknown or other
  misc_feature (307)..(307): n is a, c, g, or t
tcagacgcgatcgacacgaccggtgctcgatttagcacacgatagttgggtttgggggtagggaacgtgctcagttaggaccagagggaaccatggaagcccagctcagcttctcttcctcctgctactctggctccagagacctccggagaattgtcttgacacagtctccagccattctgtctctctctccagggganacagccacccttctcatcgcgagggccagtcagagtacttagaactatacttggcctggtatcaatacaagcctggccgagggtccccggctcctcatctatcgtancgcttccagcgacgggcctacgtcggacacgtcccagcctaggttcaacggttcgggacgggtttcggggttttcggacgtaactacgggtaacctttccgaacctttcctaccgaactaacgttcgacggtcctacggtacccctaccaaacccgttggtaaacgtttacgttttacgcgttaacggttccttaaacttttaccgtacgttacctaaacgacggtaccggtttaacaacggttaacgtttccgggtacccgtacttaccgtaaccggttttccggaacgggggtaacggtaccggtaacggggttggtaacggtaactttaaccggaaaacggttaacgttcgggtacggtacttccgggaaccttaaccggacgttaccgttggtttaaccc

SEQ ID NO: 240516 - DNA, 697 bp, Homo sapiens
  misc_feature: GYAE6OF02GW222.45.35.D02.1.454.CMB.1.raw
  modified_base (693)..(693): a, c, t, g, unknown or other
  misc_feature (693)..(693): n is a, c, g, or t
tcagacgcgatcgacacgaccggtgctcgatttagcacacgatagttgggtttgggggagggaactgctcagttaggacccagagggaaccatggaagccccagctcagcttctcttcctcctgctactctggctcccagataccaccggaaaaattgtgttgacacagtctccaggcaccctgtctctgtctccgaggggacacagccaccctctcctgcacgggccagtaggagtgtcagtaacgtcttaggctaggtaccaacgagaaacctggccaggctaccgagctccgtcactccatgactcgcactccgaacgtacgggttcccctagggtaccgtacccgaggtaccgtacgggttttccccggaggggtcctaacgggttcgggggtccgttaagggggacctaaggtacggtttaccaccgttccgtaccggtaacccgtgtacggaccgtaccggtccgttgggaccgtccgtacggtagttcgttacgttttcggaccgttaagttttaccttcggttacggtcctagtcgtacggtccgttcccggccacgtcccgcgtcgtaccgggttccggggacgggggaccttaggggtcggacgtaggtacgaggtaccggtacgtgggttcgccgtacgccgtaccgtattcgtcgttcttccgactttccgttaccccgtntacg

SEQ ID NO: 240517 - DNA, 758 bp, Homo sapiens
  misc_feature: GYAE6OF02I96K3.45.35.D02.1.454.CMB.1.raw
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattggtcttgacacagtctccagccattctgtctctctctccagggganacagccaccctctcatgcagggccagtcagagtatagaacatacttggcctggtatcaatacaagcctggccgagggtccccgctccgtcatctangatgccttccagcgacgggccacgtcggacactcccgagccaggttcaggtgggtccgggttaggggtttcggaccgtacgtaacggtcctttaccgtaccgttccttacgaacctaacttaccgaacgcctaaccggtacccccttaccccgaaaccgttacgggtaaaacgtttacgtttttacggaccgttaacgtttacctttaaacgttttaccgttacggttaacctaaacggtaacggtaccggttaaacgtaacggttacgtttaaccgggccccgttacgtttaacccggtttaccggttttacccggggaccggggttaaccgggggtaaacccggtaagggggttaaccgggtaacggtaaacggttaacccggaaaaacgggttaacggttacgggttaaccggtccgtttacggacccgtaaccgtacgtttaccgtagtttaccccg

SEQ ID NO: 240518 - DNA, 648 bp, Homo sapiens
  misc_feature: GYAE6OF02J0KSP.45.35.D02.1.454.CMB.1.raw
  modified_base (207)..(207): a, c, t, g, unknown or other
  misc_feature (207)..(207): n is a, c, g, or t
tcagacgcgatcgacacgaccggtgctcgatttagcacacgatagttgggtttgggggaggaactgctcagttaggacccagagggaaccagtggaagccccagctcagcttctcttcctcctgctactctggcctcccagagacctccggagaaacttggtcttgacacagtctccagccattctgtctctctctccgaggggtanacagccaccctctcatcgcagggccagtcagagtataggaactatactggcctggtatcaatacaagctggccacgggtcccgctcctgactctatgatcgtcttaccgagtcgacgggcctagtcggactacgtacccagtcccacggttcacggtcgggtacgggttgggtttcgactacgagtaccttcacgtcacaactacgtcacgtacctacggacctaccaacgtacgtaaagttactttacgactacgttacttaacgttactagtacctaaacgtacgtaccgtaactaaggtacttacgggaccttaccttaccgaccgtttaccgggacggtaacggaaccggtaagggtcggaacgtaacccgttagaaaaccggtaaccgttacggtacggaccgttcgaccgtaacctacgttcggtaccgttaacg

SEQ ID NO: 240519 - DNA, 630 bp, Homo sapiens
  misc_feature: GYAE6OF02H8R3C.45.35.D02.1.454.CMB.1.raw
  modified_base (183)..(183): a, c, t, g, unknown or other
  misc_feature (183)..(183): n is a, c, g, or t
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (292)..(292): a, c, t, g, unknown or other
  misc_feature (292)..(292): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaatttgtcttgacacagtctccagccattcngtctntctctcgagggganacagcctaccctntacagtgcagggccagtcaagagtattagaacatacttggccttggtatcaatacaagcctaggccagggtccccgntcctcatctatgatgcttcagcagggccagtggcactccagtccaagttcagtcggnggttggtcgctaacngacttcactcacaaccaatcagcacgacctaccaactagaacgtacttttaggactacggttactttaacttacgtacgttaacaaaccgtagtaccgttaacgtaaggtacttacgggtacccggtacttaccgttaaccgtttcggggaaccggggttaacgggaaccggtaaacgggtacgggtaacggaacgttaaccgaaaaggtaacccgttaggttacgggcttacggaccgtaaccgtaacgtttccttaggttaccc

SEQ ID NO: 240520 - DNA, 764 bp, Homo sapiens
  misc_feature: GYAE6OF02H87WL.45.35.D02.1.454.CMB.1.raw
  modified_base (215)..(215): a, c, t, g, unknown or other
  misc_feature (215)..(215): n is a, c, g, or t
tcagacgcgatcgacacgaccggtgctcgatttagcacacgatagttgggtttgggggaggaactgctcagttaggacccagagggtaacatggaagccccagctcagcttctcttcctcctgctactctggctccagagacctccggagtaaattgtcttgacacagtactccagccattctgtctctctctccaggggatacaggccaccctntcatgcagggcagtcagagtattagacatacttgccttggtatcaatacaagcctggcctagggtccccgctcctcatctagtgagtcgctttcgacgtcgaacgggtaccagtcggctaacgtcccgaaggtcctaaacgggttcccgtaaggttcgggcggggttttaggggtttacggaccgtaaacgtacggtaacctttaccgtacctccggtaactaaacgtaacttaccgaaacggtacccgaaacggtccccttaacccgtaaacccgttaggtaaaaccgtttattttacggacgtaaccggtttaactttaaactttaccgtagttaaccaaacgtaaccggttaccgttaaaccgtaaggttactttacccggggaccttaccgttaccgtttaaccggtttaccgggaaccggggtaacgggtaaccccggtaaggggttaaccgggtaacggtaacgttaaccggaaaacggttaccgtttaggtacgggtacgtacgtaacccggtaaccgtacgtttacccgttggtttaaccc

SEQ ID NO: 240521 - DNA, 577 bp, Homo sapiens
  misc_feature: GYAE6OF02H9Q4E.45.35.D02.1.454.CMB.1.raw
  modified_base (200)..(200): a, c, t, g, unknown or other
  misc_feature (200)..(200): n is a, c, g, or t
  modified_base (258)..(258): a, c, t, g, unknown or other
  misc_feature (258)..(258): n is a, c, g, or t
tcagacgcgatcgacacgaccggtgctcgatttagcacacgatagttgggtttgggggaggaactgctcagttaggacccagagggaacatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatnaatacaagcctggccagggtccccggctcctcatcctatgatgcttccagcagggccatggcactcccagccaggttcaggttcgggcggttggggtttcgcacgtagtacttcactctacaactaatcagcacgcctacccaactgaatatttgacagttcttaattactgtacaacagtacgtaacaagtacttaggccgtcttaccgtacgtttcggacgggtaacggtacgtaagggtacggaagaacgttaaccgaaaacggaaccgttggacggtcgtacggaccgtaaccctagttacccgttagtttaccc

SEQ ID NO: 240522 - DNA, 630 bp, Homo sapiens
  misc_feature: GYAE6OF02I3NU5.45.35.D02.1.454.CMB.1.raw
  modified_base (200)..(200): a, c, t, g, unknown or other
  misc_feature (200)..(200): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
  modified_base (471)..(471): a, c, t, g, unknown or other
  misc_feature (471)..(471): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctggtacaacagaaacctggccaggctccgaggctcctcatccatgatgcatccaacgtcgggtccctggccgtacccgagaccgtacgggttccgtggccgtaggtcgggtccgtgggacaggtacgttccacgtctaccgaccgtnacgcacggtccgtagggtacncccgttagtacgttaggttacttttgcgtttacggtttacttcgtcgttacncgtacacggttcccgttccgacaccggtccgacttcgttaccggttcggggaccggggactaggggtgaacgtagtacggacgtaccgtagtcgtgggtcctaggcccaaccgtacgtttcgcgtttccgttacacctttaccggttccccacgtacgg

SEQ ID NO: 240523 - DNA, 567 bp, Homo sapiens
  misc_feature: GYAE6OF02GU306.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggtgaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatgcagggccagtcagagtattagaacatacttggcctggtatcaatacaagcctggccacgggtccccgctcctcatctatgatgcttccagcgacgggccacgtggacactccagcctaggttcaggtggcggttgggttcgcacgagtcttcactctacacactacagcacgtccctacctaacctacgtaacgttactttacgcgtagtacttattactacgtactaacgacgtacgtaactagtacgtcggtcctcgtctacgtttcgggacgggtacgggaccgtaggtacggaacgtacgtaacgaacgtacgtaggtacggtacgtacgactaccgtactctcg

SEQ ID NO: 240524 - DNA, 598 bp, Homo sapiens
  misc_feature: GYAE6OF02HPL5O.45.35.D02.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
tcagacgcgatcgacacgaccggtgctcgatttagcacacgatagttgggtttgggggaggaacgtgctcagttaggacccagagggaaccatggaagccccagctcagcttctcttcctcctgctactctggctccagacgacctccggagaaattgtcttgacacagtctccagccattctgtctctctctccgagggganacagccacctcncatgcacgggccagtcaggtatatacgaacatacttggcctggtactcaaatacaagtcctggaccacgggtccccgctcctcactctatgatcgcttacagcgagggccacgtggactactcccagtcccaaggttcaggtcgggcggttgggttcgctacgtacgtcttcgactcacgaactatcgacgccacgtccctaccgaactgtaaacgttgtttacgactagttaccttagttacttacgtacaacgtacgtacgtaacgtacgtacgtcggaccttctacgttacggttcggaaccgggtaggaccggtaggtcggaagtacgtaacgaacgtacgtaggtcgtacgacgaccgtacgtactacgtgttaaccg

SEQ ID NO: 240525 - DNA, 575 bp, Homo sapiens
  misc_feature: GYAE6OF02HT1F1.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatactggcctggtatcaatacaagcctggccacgggtccccgctcctcatctatgatgcttccagcagggccacgtggccatcccagccaggttcaggtcgggcggttgggtttgcacgagtacttcactctacactaatcagcacgcctaccaactgaagtatttgctagttctattactcgtacaacagcgtaacagtacgttcggccgtcttacgtaccgtttcggacgggtacgggaaccgagggtacggaaggtaacgttaaccgaaacggtaacgttacgggtaggtacgttacggaccgtaccgtaacgttccgttacggttacccg

SEQ ID NO: 240526 - DNA, 257 bp, Homo sapiens
  misc_feature: GYAE6OF02HNYIH.45.35.D02.1.454.CMB.1.raw
  modified_base (252)..(257): a, c, t, g, unknown or other
  misc_feature (252)..(257): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgcatctgatcgatcgcgtctgagcgggctggcaaggcgcatagnnnnnn

SEQ ID NO: 240527 - DNA, 666 bp, Homo sapiens
  misc_feature: GYAE6OF02JZGE9.45.35.D02.1.454.CMB.1.raw
  modified_base (167)..(167): a, c, t, g, unknown or other
  misc_feature (167)..(167): n is a, c, g, or t
  modified_base (184)..(184): a, c, t, g, unknown or other
  misc_feature (184)..(184): n is a, c, g, or t
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
tcagacgcgatcgacacgaccggtgctcgatttagcacacgatagttgggtttggggaggaactgctcagttaggacccaggagggaaccatggaagccccagctcacgcttctcttcctcctgctactctggctcccagagacctccggagaaacttgtcttgacncagtctccagccattcngtctctctctcagggganacagccacctctcatgcagggccagtcagagtatagaacntactggcctggtactacagtacaagcctggaccgacgggtccccggctccgtactactcgtatgatcgtacttaccagtcgacgggtccacgtggactactacccaggccgtaaggttccgtaggttcgggtcgggttacgggtttcggacctacgtacggtaaccgtttccgaccgttacgtccaactaacgtccgaacgtccgtacggtaccctacccgaaaccgtttggaaacgttacgtttaccggacgttacgttaccgtttaacgtttaacgttccggaaactacgtaacggtaccgttaacgtacgtacgttcgacccgtaccttacgttaccgtttacgggacgggtacggaccgtacgggtcgaagtacgtagacggtaacgtacgtggtacgcgtacgacgtcgacttcgtacg

SEQ ID NO: 240528 - DNA, 792 bp, Homo sapiens
  misc_feature: GYAE6OF02H1Z9O.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctcagtcgcgacgggccagtcaaggagtaattaagaactaattacgttggaccttaggtatacaaataacgaagccgtcggacccgtacggggttcccccgcttccgtacgtactcctaagtgtatcgtcttccgagcgacgggtccacgcggacctacctcccgacgtaccggtacggttaccgaggggtcgggttcggggttcggggttttacggaccgtaacggtacgttaacccgtttaccgtaaaccgttcccgtaacgtaaacctaagtaccgtaaccggtaccctaacccggttaccccctaaacccgtaaaaccgttacggtaaaacgtttacgtttttacggaaccgtttaacgtttaaccttttaacgtttaacctttaccgtaaaccgtaaacgtaccggttaaccgttaacgaacgtttacggtccggtacccgtaccgttaccgttaacccgggtttacgggaccgggtaacgggtaacccggtaagggtcggtaacgtaacgtaacgaaaccggtacgttaggtaccggtctacggtaccctacgttacgtccgttacgttacc

SEQ ID NO: 240529 - DNA, 511 bp, Homo sapiens
  misc_feature: GYAE6OF02FRIJA.45.35.D02.1.454.CMB.1.raw
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttcagcagggccatggcatcccagccaggttcaggtggcggttgggtttggcacgagtacttcactctcaacatcagcacgcctaccaacctgaagtactttgctagttctacttactgtacaactagcgtacagtactcggcctctctacgttcggaggacggaccgaggtggacgatacgaaacgtactgtaggctcgacacatctgtc

SEQ ID NO: 240530 - DNA, 577 bp, Homo sapiens
  misc_feature: GYAE6OF02F24QY.45.35.D02.1.454.CMB.1.raw
  modified_base (181)..(181): a, c, t, g, unknown or other
  misc_feature (181)..(181): n is a, c, g, or t
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattcngtctctctctccagggganacagccaccctctcatgcagggccagtcagagtattagaacatacttggcctggtatcaatacaagcctggccaggggtcccccggctcctcatctatgatgcttccagcagggccacgtggcactcccagccaggttcagtgggcggtgggtttgcacgagacttcactctcaacatcagcacgccctaccaacctagaagtattttgactagtctattactgtacaacagacgtacgagtacgttcggccgtctctacgtttcggacgggtacgggaccgtaggggtacggaacgtaacgtaaccgtaaaaccggtaaccgttagggtacgggtacgttacggtacccgaaccctaagttccgtaggtttacccg

SEQ ID NO: 240531 - DNA, 566 bp, Homo sapiens
  misc_feature: GYAE6OF02FKB1E.45.35.D02.1.454.CMB.1.raw
  modified_base (201)..(201): a, c, t, g, unknown or other
  misc_feature (201)..(201): n is a, c, g, or t
  modified_base (427)..(427): a, c, t, g, unknown or other
  misc_feature (427)..(427): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccactggcatcccagccaggttcaggtcggcggttgggtttcgcacgagtactttcacttctacacaatcagcacgccctaccaacctagaagtatttgactagttctattactntacaacagacgtacagtacgtcggccgtcttaccgtacgtttcggaccgggtacgggaaccgtagggtcggaggtaactaaccgaaacggtacgtaggttacggacttacggacctaaccgtacgttccgtagttaccc

SEQ ID NO: 240532 - DNA, 733 bp, Homo sapiens
  misc_feature: GYAE6OF02JXKFR.45.35.D02.1.454.CMB.1.raw
  modified_base (199)..(199): a, c, t, g, unknown or other
  misc_feature (199)..(199): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctccggagaaattgtcttgacacagtctccagccattctgtctctctctccagggganacagccaccctctcatcgcagggccagtcagagtattagacatactggcctggtatcatacaagcctggcctaaggtccccggacttccgtactatccttacgtacggtatcgtctttccgagtccgaacggggttccaaccgtgggtaccaacgttccccgagtccccgtaggtttccgacggtttcggcggggttttgggtttcgggaccacgtacggttaccctactaccgtccgtaacgacctaacgtcgaacggcctaacgtcccctacgtaaaccccgttagaaacgttacttttacggaccgttagttaccgtaacgtttaccgttaggtaacctaacgtacgttacgtaaccgtaacgtaacgttccggttaacccgtccgtttcctaacggttttcccggggaaccggaacggggttacccgtacgggtaaggtaccgtaaactaccgtaaaaccggttaaccggtcgttaacgggttccctacgggtaccttaacccggtagtttccggttaccctttaccggg

SEQ ID NO: 240533 - DNA, 708 bp, Homo sapiens
  misc_feature: GYAE6OF02GG9ZQ.45.35.D02.1.454.CMB.1.raw
  modified_base (140)..(140): a, c, t, g, unknown or other
  misc_feature (140)..(140): n is a, c, g, or t
  modified_base (212)..(212): a, c, t, g, unknown or other
  misc_feature (212)..(212): n is a, c, g, or t
  modified_base (259)..(259): a, c, t, g, unknown or other
  misc_feature (259)..(259): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccaganacctccggagaaattgtcttgacacagtctccagccattctgtctctctctaccgagggcacagccaccctntcatcgcaggccagtcaggagtattagaactatacgttgcctggtanctaatacaacgctggaccgtacggggtcccccggtctccctacgactacgtacgtacgtaagttcgtaccttccgacgtacgacgggcctaacgttccggcgtaactcccgagcctacggttaccaggttccgggtacgggttcggggtttacggccgtaacgtaacggtactttaccgaaccgtttccttaccgaacgaacttccgaacgtccaaggtcccctaccctaacgtcgaaacttagtttcacgtacgtaactaacgttacgtactacgaaacctacgtaccgtaagacggttacgtacgacccggtacttaccggtaaccgtttcgggacgggtaacccgggaacgttacggggtacgtaacggtaacggtaacggtaaaccggtaaccttagggtaccggtacgttacccgacgttaaccggcttaccggtagttacccg

SEQ ID NO: 240534 - DNA, 596 bp, Homo sapiens
  misc_feature: GYAE6OF02GC00Q.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggnacagccaccctctcatgcagggccagtcagagtattagaacatacttggcctggtatcaatacaagcctggccagggtccccggctccctcatctatgatgcttccagcagggccactggcactccagcctagtcagtcggcggttgggtttgcacgagtactcactctacacactcagcacgcctaccaaccgtagaacgtacttttcgctacgttacttactttactgttacaacgtacgtacgtaacgacgtacgttcggaccgtcgtacctaccgtttacggacgggtacgggaaccggtaagggtacgggaacgtaacgtaaccgtaaaaccggtaacgttaggttacgggtacgttacggtaccgacctacgttccgttacggttacccg

SEQ ID NO: 240535 - DNA, 560 bp, Homo sapiens
  misc_feature: GYAE6OF02FHOW9.45.35.D02.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtattagaacatacttggcctggtatcaatacaagcctggccagggtcccccggctcctcatctatgatgcttccagcagggccacgtggcactcccagccaggttcagtggcggttgggtttgcacgagtacgttcactctcacaatcagcacgccctccaacctgaacgttactttgctagttctattactagtacaacgagtcgtaacagtacgttcggacctactccgtacgtttcgggacggtacgggacctaagggtggaacgtaactacgaaaaccgtacgttcggtacggtcttacggaccctaaccattacgtggttacc

SEQ ID NO: 240536 - DNA, 547 bp, Homo sapiens
  misc_feature: GYAE6OF02GOPPZ.45.35.D02.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtatagaacatactggcctggtatcaatacaagcctggccacgggtccccggctcctcatctatgatcgcttcagcacgggccacgtggccagtcccagccaggttcaggttcggcgggttggtttcggctacgagtaccttcactctacacaatcagcacgcctaccaaccgtgaagttactttcgacgttagttacttattactgtacaactgactacgagtagtcgccgtctcgtacgttcggaggacgggtacgaggtggagtactaacgaaacgtacgtggtacggacgtcgacgtacgtatcgtgtacc

SEQ ID NO: 240537 - DNA, 633 bp, Homo sapiens
  misc_feature: GYAE6OF02H5OVV.45.35.D02.1.454.CMB.1.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
  modified_base (465)..(465): a, c, t, g, unknown or other
  misc_feature (465)..(465): n is a, c, g, or t
tcagacgcgatcgacacgaccggtgctcgatttagcacacgatagttgggtttggggaggaactgctcagttaggacccagagggaacatggaagccccagctcagcttctcttcctcctgctactctggctccagagacctccggagaaattgtcttgacacagtctcagccattctgtctctctctccgagggganacagccaccctctcatgcagggccagtcagagtattagaactatacttggcctggtatcaatacaagcctggccacgggtcccccggntcctcatctatgacttctacgcgacgaggaccactggccactcccaggcctaggttcgtacggtcggggtcgggttacggggtttcggactacgaggttctaccgtactcgttacacaacgtcagcacgtcctaccaaccgtggtaacgttatttcgactacgttacttaacgtttacngttaaccaactacggtaccgtaagtacgaacgtttcggacccgttctacgttaaccggtttccgggaacgggtaacgggtaaccgaagggttcggaacggtaacaccggtaaaccgaacgttggtcggaccttacggactaaccgtacgttcgttccggtacttaccg

SEQ ID NO: 240538 - DNA, 258 bp, Homo sapiens
  misc_feature: GYAE6OF02G3E4Z.45.35.D02.1.454.CMB.1.raw
  modified_base (253)..(258): a, c, t, g, unknown or other
  misc_feature (253)..(258): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgcatctgatcgatcgcgtctgagcgggctggcaaggcgacatagnnnnnn

SEQ ID NO: 240539 - DNA, 791 bp, Homo sapiens
  misc_feature: GYAE6OF02IMMQO.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctcagccattctgtctctctctccagggganacagccaccctctcatgcgacgggccagtccaaggtacgtattaaggaactatacttggccttaggtactacaaatacaagtccgtaggcctacgggtcccccgtctaccgtccaacttctagtcgtatcgtacctttccacggtccgaacggggccctacgttcgggacctacgttccccacggtccctacgggtttaccaggggttcggggtccgggggttttcggggttttacggaccgttaaaccggtaacgggttaccccttttacgaacccgtttaccgtacccaaaccgttaaactccgtaacgtacccgtaaccgtacccctacccgtaaacgtacgtaacgttacgtttttacgacgttacgttacgttactttaccgttacgttaccaagtaaccgtccgttaacgtacgtacgttacggtaccgtcttacccgttacgtttaccgggacgggttaaccgggaaccggtacgggttacggtaacggtaacgttaaccgtaaaccgggttaaccgttacgggttacggtaaccgttacgggtaaaccctaccggttaacgtttaccgttacccggtttaccg

SEQ ID NO: 240540 - DNA, 576 bp, Homo sapiens
  misc_feature: GYAE6OF02I65C8.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatgcgagggccagtcagagtattagaacatacttggcctggtatcaatacagcctggccagggtccccgctccgtcatctatcgatcgcttccagccgagggccacgtgcacgtacccagccctaggtccacggttggccgggttgggtttacgcgtacgacgtacttcacctctacaactataccgacgcacgaccctaccaacctagtaactgttcgctagttcttattactcgtacaacacgtactaacgagtagtcgccgtctacgttaccggttcggaccgggacggacgaggtaggacgtacgtaaccgaaacggtacgtaggtcggactacggacacctagttccgtcttaccg

SEQ ID NO: 240541 - DNA, 718 bp, Homo sapiens
  misc_feature: GYAE6OF02JL3PT.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtattagaacatacttggcctggtatcaatacaagcctggccacgggtccccgctccgtctactcgtatgatcgcttaccagccgacgggccctaacgtcggacctaccgtcccgacgcccgtaacggttccgaacgggttcgggtccgggttcgggttttacggaccgtaacggtacgtacctttccgaaccgttccgtaccgtaacgtaaacgtacgaaccgtacaacggtcccctaacccgtaaccgttagtaacgttagttttacgaccgttaacgttacttaacttacgttacgtaactaacgtacggtaccgttaacgaacgttaccgttacggtacccgtacgttaccgttaccggtttacgggaccgggtaaccgggtaacccggtaggggtacggtacggtaaccggttaaccgtaaaccgggtacgtacggtacggtaccgtacgtacccgaaccgtacgttaccgtaccgttaccg

SEQ ID NO: 240542 - DNA, 665 bp, Homo sapiens
  misc_feature: GYAE6OF02ILKQ0.45.35.D02.1.454.CMB.1.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagacatacttggcctggtatcaatacaagcctggccagggtcccccgatccncatctatgatgcttccgagcgacgggcctagtcggcatcccgagccgtaggttccaaggtcgggtcgggttgggtttcggacctacgtacgtaccgtttcaaccttctacgtaacctaagtaccaacggtcctaaaccgtccccttaacccgtaaaccttaggtaaacggtttattttacggaccttaacggttaccttaacgtttaccttacggtaccaaactacggtacgtaacctaaggtacgttcggtacccgtccttaccgtacgttttacgggaccgggtaacgggaccgtaagggtacggacgtaacgtaaccgaaacgtaacgttcggacgtcgttacggaccttaccgaagttccgttagttacccg

SEQ ID NO: 240543 - DNA, 648 bp, Homo sapiens
  misc_feature: GYAE6OF02I1WOT.45.35.D02.1.454.CMB.1.raw
  modified_base (201)..(201): a, c, t, g, unknown or other
  misc_feature (201)..(201): n is a, c, g, or t
  modified_base (534)..(534): a, c, t, g, unknown or other
  misc_feature (534)..(534): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatcgcgagggccagtcaagagtattagaactatacttggcctggtatacaatacaagtcctggccgacgggtcccccggtctcctctatcctagtcgatcgtcttaccaggcgacgggccacgtcggcacgtcccgagccgtacggttcgaggttcgggtcggggttagggtttcggacgtacgtacgtaccgtttaccgaccgttctacgtaactataccgacgtacctacgtcccctaaccgaccgttagaacgttacgttttacgaccgttaagttaccttactttacgtcgtaacctaactacgtaccgttanaacggtcgttccggaccgtcttcgtacgttcggaggacggtacggaggtaggtacgtacgtaaccgtaacggtaaccgtggtcggtacgtcggaccaccgtactcgtcttaccg

SEQ ID NO: 240544 - DNA, 519 bp, Homo sapiens
  misc_feature: GYAE6OF02FJ5E9.45.35.D02.1.454.CMB.1.raw
  modified_base (201)..(201): a, c, t, g, unknown or other
  misc_feature (201)..(201): n is a, c, g, or t
  modified_base (447)..(447): a, c, t, g, unknown or other
  misc_feature (447)..(447): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccggctccctcatctatgatgcttccagcagggccactggcactcccagccaggttcaggtcggcggttgggtttggcacgagtacttcacctctacaccatcagcagccctcggaccctgaggtactttcgcctatttactacttgtcagcagcgtggcgacgngcgtctcgacgtttcggcggagggaccagggtggagatacgaaacgaactgaggctgacacgactctgttcc

SEQ ID NO: 240545 - DNA, 711 bp, Homo sapiens
  misc_feature: GYAE6OF02I0MPG.45.35.D02.1.454.CMB.1.raw
  modified_base (200)..(200): a, c, t, g, unknown or other
  misc_feature (200)..(200): n is a, c, g, or t
  modified_base (661)..(661): a, c, t, g, unknown or other
  misc_feature (661)..(661): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgaggganacagccacctctcctgcacgggccaggtacggagttgtacagtaaagtacgttaggccttacgggtaaccaaacaacgaaaaccgtcgggacccgaggcctaccccagggtcctcctacactcccaatcgaacgtcggacacttacccgaaacgtacggggttcccctggggcccgttccccgaagggtaccgtaacgggggtttccggtcgggaccgtacgggttcgggggttaccggttacgggggaactaggggtaacggtttccaaccgttcctaccgtaacccgttcgaacgcgtacggtacccgtcgggaaccgtcccgtaggatttggttacttttcgacgttaacgttttccttacgttcgttacacggtcgtacgtccgttcccgccgaccgtccgtctccgtacgttccggggacgggggtaccgaggggtcgagcgtagagacgtacggnggtcggactcgacctacgacgttcgttaccgtattccgtcttccgtaccg

SEQ ID NO: 240546 - DNA, 655 bp, Homo sapiens
  misc_feature: GYAE6OF02F4XH1.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatgcagggccagtcagagtattagaacatacttggcctggtatcaatacaagcctggccacgggtccccgctcctcatctatgatcgcttccagcgacgggccacgtggcctactcccagccctaggttccgaggtcgggtcgggttgggtttcggctacgtaacgtacttccgacttccgtacctaactactcgaacgtaccacgtcccctaccctaaccgtagtaaacgttacgttttacgacttaacgttacgttaactttaaccgttacgtacctaaaccgtacgtaccgtaactaaggtagttccggccgtaccttacgttaccgtttacgggaccggtacgggtaaccgtagggtacggtaacgtaacgtaaccgaaaacggtacgttacggtaggtactacggacctaccgtacgttacgtacgtttacccg

SEQ ID NO: 240547 - DNA, 744 bp, Homo sapiens
  misc_feature: GYAE6OF02F4919.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccgagggganacagccaccctctcatgcaggccagtcagagtatagaacatacttggcctgtatcaatacaagcctggccgacgggtcccccgcttccgtcatctatgatgtccttcgagcgacgggcctagtcggacctacgtcccaaggtcccgtaaggtttccgagggttcggggtccggggtttgggggtttacggaccgtaacggtacggttacctttccaaccctttcctacctaactaacgttccgaacggtccaccgtacccccttaccgaaacccgttaggtaaacgttacttttcggacttaacgtttacctttaacttttaaccgtcgtaacctaaacgtacggttaccgttaaacgtaggttaacgtttccgggacccgttaccgttacccgttaaccggttttaccggggaaccggggtaaccggggtaaccgtaacgggggttacggtaaacggtaaccggttaaacccggaaaaacggttacggttaacgggttcggtacgttcgaaccgtaaccgtacgtttaccgttcttaacccg

SEQ ID NO: 240548 - DNA, 684 bp, Homo sapiens
  misc_feature: GYAE6OF02G3EMC.45.35.D02.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctcggagaaattgtcttgacacagtctccagccattctgtctctctctccagggganacagccaccctctcatgcagggccagtcagagtatagacatacttggcctggtatcaatacaagctgccgagggtcccccgatcccgtnattcctattcgattcgccttccagcgacgggccacgtggacactcccgagccgtagttccaggtcggtccgggttagggtttcggactacgtaacggtacctttcaaccgtcgttaccaagtactactagccaacgccctaccctaacgtgtaagttcttttacggacttacgttacgttaattactaggttacaacgtacgtaccgtaagtaacggtacggtttccggtacccgtctttaaccgtaccggttttaccgggaccggggtaacgggtaaccgtaacggggttcggtaaacggtaagttaacccggtaaaaacggtaaccgtttcggtaaccgggtacgtttaccgggaaccgttaacccctaggttacccgtttaggtttaacccg

SEQ ID NO: 240549 - DNA, 579 bp, Homo sapiens
  misc_feature: GYAE6OF02GG2Q2.45.35.D02.1.454.CMB.1.raw
  modified_base (202)..(202): a, c, t, g, unknown or other
  misc_feature (202)..(202): n is a, c, g, or t
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggccagtcagagtatagaacatactggcctggtatcaatacaagcctggccgacgggtccccggctccgtcactctatgatcgccttccgagcgacgggccacgtcggcactcccgagtcctaggttcaggtgggcgggttgggtttgcacgagtacttcactctacacactcagcacgcctaccaactgtaatatttcgactagtcttattacgtntacaactagtacctaanagtagtccggccgtcttaccgtaccgttcgggacggtacgggaccgtagggtaggaacggtaacgtaaccgaaacggtacgtagggtacggtctcggacctaccgtacgttccgtagttacc

SEQ ID NO: 240550 - DNA, 790 bp, Homo sapiens
  misc_feature: GYAE6OF02JBJ5T.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctcctccgaggggacacacgcctaaccctctcatcgcacgggccagtcagagtatacgaacatacttggcctggtatacaatacaagtccgtaggaccacgggtccccgctacctcaattctaatgatcgtaccttccagccgagggccacgtggacctactcccgagcctacgggttccgaggcgtaggttcgggtacgtaggggactaggtacgttacacgttctccgtaccgtcgacgtacgaacggtccgtaccggtacctagggtaacgtacgtttcggaccttaacgtttacgtaacgttcgtaacgtacggtcgtaaggtccggtacgggtacccggaacccggtacgggtacccgttacccgttaccggttaaccgggtttacccgggggtaacccgggggtaaaccgggggtaaccccggttaaaggggggtaaccgggttaaaccgggaaaccgggtttaaccccgggtaaaaaaacggggttacccgggttaacgggttacccgggggttaaccggttaacccgggtaaccccgttaacccgggttaaccggtttaccgggtttacccggtttaacccggttttaaccccgg

SEQ ID NO: 240551 - DNA, 799 bp, Homo sapiens
  misc_feature: GYAE6OF02FQPJU.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccgctcctcatctatgatgcttccagcgacgggccacgtggccatcccagccctaggttccagggtcgggcgggttgggggtttcggccgtaacgtacggtaacctttccaaccgttcttaccgaacctaaagtccaacgccaacgcccctaccctaaacccgtagaaacgttacgtttttacggaccgttaacggttacctttaagttttaaccgttacggttaaccctaaaaccggtacggttaacccggttaaaccgtaaacggttaacggttttaccggggtcccgttacccgtttacccgttaacccggttttttacccgggggaccgggggtaaacccgggggtaaccccggtaaacgggggtacgggtaaaccgggttaaccggttaaacccgggtaaaaaaccgggtaacccggtttaacggggttaaccggggttacccggtttaaccgggtaaaccccggtaaccccggttaaccgttttaccccggttaccggtttttaaccccgg

SEQ ID NO: 240552 - DNA, 717 bp, Homo sapiens
  misc_feature: GYAE6OF02JYHYA.45.35.D02.1.454.CMB.1.raw
  modified_base (211)..(211): a, c, t, g, unknown or other
  misc_feature (211)..(211): n is a, c, g, or t
tcagacgcgatcgacacgaccggtgctcgatttagcacacgatagttgggtttgggtaggaacgtgctcagttaggaccagaggaaccatggaagcccagctcagcttctcttcctcctgctactctggcctcccagacgacctccggagaaattcgtcttgacacagtctcagccattctgtctctctctaccgaggggacacacgcccncccttctacattcgacaccgggacctagtcagtcgtaattaacgaacgataccttggccgtagtatactaatacgaagtccgtagaccgacgggtcccgtaccgtcctacgtacctacttagctagtcgcctttaccgacgccggtaaccgggcctaccgtagggaccttaccggaacccgtacgtacccgtacggtaccgttacgggtcgggttacggggttccggggttttaacgggctaacgtagtacttacccgtacgtctacgactaacgtactacgctacgtccctaccgtaaccgtaagtacgtagttacgacgtacgtaccttacgttaccaagttccgtaaactaccgttacgtaaccgttaagttaccgttacgggtacccgtacgttccgttaacgtcggtaccggtaagggaccgtagggtaccgtaggaacgtaacctaaacggacgttacggtagtacccgttaggacccgtagtacttaccgttagtaccg

SEQ ID NO: 240553 - DNA, 638 bp, Homo sapiens
  misc_feature: GYAE6OF02H9HQF.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatcgcttccagcagggccacgtgcatcccgagccaggttcaggtgggcggttgggtttgcaacgtagtctttacaccgttctacgtaactaataccagacctacgtccctacccgaaaccttacgaaacgttaacttttcggactacgttactttaacttaccgttacgtacgtaactacgtacgtaacgtaaggtacttacgggtcccgtaccttaccgttaccgtttcgggaccgggtaacggggtaaccgaacggggtagggacgtaacgtaccgtaaaacggtaaccgttacggtacggtaccgtacgtaccaacccgtattacccgttgttacccg

SEQ ID NO: 240554 - DNA, 873 bp, Homo sapiens
  misc_feature: GYAE6OF02I4P1T.45.35.D02.1.454.CMB.1.raw
  modified_base (199)..(199): a, c, t, g, unknown or other
  misc_feature (199)..(199): n is a, c, g, or t
tcagacgcgatcgacacgaccggtgctcgatttagcacacgatagttgggtttgggggaggaactgctcagttaggaccagagggaaccatggaagcccagctcagcttctcttcctcctgctactctgctcccagagacctccggagaattgtcttgacacagtctccaggcaccctgtctctcgtctccgagggganacacgccaccctcgtcctgccacgggccaggtacggagtcgtacgtaagtaacgtacgttagggctacgggtaaccaaacgaacgtaaaccgttcgggaccaacgggtccctacccgaacggtcctacccgttaccaacgttccccgaattcgaacgttcgaaccacttacccgtaaaacggtacggggttcccgtacggcccgttaccaacggtacgttacggttccggtcggacgtacggtacgggttcgtaacggggaactacggttacgtttccgacgttcgtaccgtaaccgttcacggaccgtacgggtccttaggggacctccgttaggtacgtttacggtacgtttttacggcctttaacggttttaccgtcgtttacggaccttaacggtccgttaacggtcccgtttacccggtaccgtaacccggttcccggtaccgtttaccggtacccggttttacccggggggaccggggggttaacccgtacgggggttaccgggtaaacggttaacgttaccggggttaaaccgggtacgggtttaacttccgggggttaccgggtacccgtttaccgggaaccgttaaccccgttaccggtttaccggtttaaccggtttcccgtttaacccggtttaacggtttcccccgttaccccgggttaccc

SEQ ID NO: 240555 - DNA, 813 bp, Homo sapiens
  misc_feature: GYAE6OF02IWDXK.45.35.D02.1.454.CMB.1.raw
  modified_base (181)..(181): a, c, t, g, unknown or other
  misc_feature (181)..(181): n is a, c, g, or t
  modified_base (203)..(203): a, c, t, g, unknown or other
  misc_feature (203)..(203): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgactacagtctcagccattcngtctctctactccgaggggtanaccacgccaaccctcgtcagtcgacacgggccagtcacgagtaacttagaacattacgtggacctaggtactacaagtacaagccgtaggcctaacggggtccccgctaccgtctactcgtatgactgccttccgagccgacgggcctaacgtcggacctacgtacccgacggtccgtaaccggttcgacgggtaccgggtcggggttaggggttttcggacctaacgtacggtactttccgaaccgttccgaccgtaacgtaactaccgaacgtaccgtaacgtacccttaccccgtaaacgttcggaaaacggttcgttttaacggaacgtaaccgtttaccttaacgtttaaccgttcggtaaaccctaaacggtacgtaccgggttaaaccgtaacggttacggtttaccggtacccgtaaccgttaccggtttaacccggtttacgggaaccgggggttaaaccgggtaacccgttaacgggggtacggtaaaccgtaacgttaacccggaaaacggttaaccggttaacgggtttaccggaacccggtttacgggaaacccccttaaccgggttacgtttacccgggttaccttttaaccccgg

SEQ ID NO: 240556 - DNA, 560 bp, Homo sapiens
  misc_feature: GYAE6OF02FQ9SB.45.35.D02.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (284)..(284): a, c, t, g, unknown or other
  misc_feature (284)..(284): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaacttgtcttgacacagtctccagccattctgtctctctctccaggggtanacagccacctntcatgcagggccagtcagagtatagaacatacttggcctggtatcaatacaagcctggccagggtccccgntcctcatcctatgatgcttccagcagggccactggcagtcccagccaggttcagtggcggtgggtttggctacgagtaccttcgactctacaactatcagcacgcctaccaactgaacgtatttcgctagttactattactgtacaactagcgttacagtacttcggcctcttacacgtttcggcggtaaccgggaccgtagggtcggagtaacgtaccgtaaaaccgtaacgttggtacggtactacggacctaccgacttccgtacgttacccg

SEQ ID NO: 240557 - DNA, 625 bp, Homo sapiens
  misc_feature: GYAE6OF02FP7S6.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagcccacctctcatgcagggccagtcagagtattagacatacttggcctggtatcaatacaagcctggccaggggtccccgctcctcatctatgatgcttcagcacgggccacgtggcatcccgagcctaggttcaggtggcggttgggttcgcacagtacttcactctacaactaactcacgcacgaccctaccgaaacctagaaacgttacgttttcgacgttagttaccttaatttactcgttaacaacgtacggtacgttaacgaaggtacgttacgggtcccgtacttaccgttaccgttttcgggacgggtacgggtaaccggtaaggggtacggtaacggtaagttaaccgaaaacggtaaccgttagggtacggtacgtacggtacccgaacgttacgttccgttagttacccg

SEQ ID NO: 240558 - DNA, 708 bp, Homo sapiens
  misc_feature: GYAE6OF02JJ16C.45.35.D02.1.454.CMB.1.raw
  modified_base (183)..(183): a, c, t, g, unknown or other
  misc_feature (183)..(183): n is a, c, g, or t
  modified_base (204)..(204): a, c, t, g, unknown or other
  misc_feature (204)..(204): n is a, c, g, or t
tcagacgcgatcgacacgaccggtgctcgatttagcacacgatagttgggtttgggggaggaactgctcagttaggacccagagggaaccatggaagccccagctcagcttctcttcctcctgcctactctggctcccagagacctccggagaaattgtcttgacacagtctccagccattcngtctctctcgtaccagggganacagcccaccctctcgatgcagggccaggtcagagtattagacatacttggcctggtatcaatacaagcctagccacggtcccggctcctcactagtactgatcgcttcacgtcgacgggtcacgtacgcactcccagccagtttccagtaggtcgggtacgggttttcggcgaaccgtacgaccgtttcctaacctcgtaccgaactaaacgtccacgcctacgcccgttacccaaaccgtcgtaacgtaacgtttttacgccgtacgtttacgttaactttaacgttaccgttacctaaaccgtaggtaaccgttaacgtacggttaaccgttacgggtacccgtccgttaacccttaaccggtttaccggtaccggggtaacgggtaacccggtaacgggttacgggaacggtaacgtttacccggaaaaccggtaaccgtttacgggtcggttaccggttaccggtcctaccccggtaatttcccggttcgtttaacccg

SEQ ID NO: 240559 - DNA, 698 bp, Homo sapiens
  misc_feature: GYAE6OF02GCRMZ.45.35.D02.1.454.CMB.1.raw
  modified_base (200)..(200): a, c, t, g, unknown or other
  misc_feature (200)..(200): n is a, c, g, or t
  modified_base (281)..(281): a, c, t, g, unknown or other
  misc_feature (281)..(281): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtattagacatactggcctggtatcaatacaagcctggccagggtccccgntcctcatctatgatgccttcagcacgggccacgtggcactcccagcctaggttcaggtggcggttgggtttcgctacgtagtaacctttcaacctttccgtaccaaccgtaacttaccgacggtaccgtaaccgtacccctacccgtaaacccgttacgggtaaacgttacgtttttacggacgttaaccggtttaccttaacgtttacgttacgtaacctaaccgtacggtaccgttaacgacgttacgttaccggaccgtaccttaccgttaccgttttaccgggacgggtaacgggtaaccgtaacggggttcggtaacggtaacggttaaccgtaaaaccggtaacggttacgggttacgggtaccgttacggtacccgtaacccggtacgtttaccgttacggtttaacccg

SEQ ID NO: 240560 - DNA, 911 bp, Homo sapiens
  misc_feature: GYAE6OF02JG285.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggacacagcccacctctcatgcaggcagtcagacgtattagaacatacttggacctgtactacaataacaacgccgttcggacccgtacggggttaccccccggcttacccttaccgaacttcccgtaagttacggaactttcggtaccttacccgaaggtaccgtaacggggccctaaccggtgggtaaccctaaccgttccccgaaacggtcccgtaacgggtttagaaccgggtttcggggtacccgggggtttagggggttttaccggaccgtaaaccggtaaacgtttaacccgtttacccggaaaccctttcccggtaaaccgtaaaccgtaaacgtttacccggaaacggttacccgtaaacccgggtaccccccgtttaaacccgttaaacccggttaacgggttaaaacggtttacgtttttaaccggacccgtttaaacgtttacccgttttaaacgttttaaccggttaacccgttaaccgtaaaacgttacccggtaaccggtttaaacgtaaacgttacccggttccgggggtaacccctttaccgttacggttttaacccgggtttaccggggaaccggggttaaccgggttaaaccggaacggggttcggaaacggttaaccttaaccggaaaacggttacggtaccggtaggtaccgttacggacccgttaaacgttacgtacccgttgtttaacccg

SEQ ID NO: 240561 - DNA, 634 bp, Homo sapiens
  misc_feature: GYAE6OF02JJEAJ.45.35.D02.1.454.CMB.1.raw
tcagacgcgatcgacacgaccggtgctcgatttagcacacgatagttgggtttgggggtagggaacgtgctcagttaggacccagagggaaccatggaagccccagctcagcttctcttcctcctgctactctggctcccagagacctccggagaaattgtcttgacacagtctccagccattctgtctctctctccaggggacacagccaccctctcatgcagggcccagtccaggagtattagaacatacttcggcctggtatactaatacaagcctggccgacggggtcccccggctccctacattcctagtcgattcgccttcccaggccaagggcccacgtcggctactcccagccctaggttccaggttgggcggttcggggtttcgacgaacgacgtaccttccgacctttccgaccaagtactcgagaccacgcccctaccaaccgtagtaacgtctttacgctacgttacttaacttacgttacgtactaacgacgtacgtaacacgtacgttcggcctacgttcgtaccgtttacggccgggaacgggtaccggtaggtcgggacgtaacgtaacgtaaacgtccgtacggtgtacgcggacctaccgtacgtccgtgttaccg

SEQ ID NO: 240562 - DNA, 681 bp, Homo sapiens
  misc_feature: GYAE6OF02H8V05.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctcatgcacgggccagtcagtagtattagaacattacgttggcctggtatacaataacaagcctggccgacgggtccccgctcctcatcctatgtactcgcttaccgagccgacggcctacgtggccacgtcccgacgccgtaggttccgaggttgggtcgggttgggtttgcgtagtacgtacttccacgtcctacaactaactcgacgtaccacgtacccctacccaaacgtacgtaaagttacttttacgaccttagttaccttatttaaccgtcgttaacgaacgtaaccggtacgttaacgtaaggtacgtttaccgggcccgtacgttacccgttacggttccggggaaccgggtacgggaacccgtaaggggtacggaacggtaacgttaaccgaaaacggtaacgttacggtccggtacgtaccggaccgtaaccccgtagtttacccgtcgttaacccg

SEQ ID NO: 240563 - DNA, 758 bp, Homo sapiens
  misc_feature: GYAE6OF02I167O.45.35.D02.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctcggagaaattgtcttgacacagtctccagccattctgtctctctctccgagggganacagcccaccctcncatcgcgagggccagtcagatatagacatactgcctgtatacaatacgacgcgtacggccgacgggtccccgcttcctctactctagtgtagtcgtcctaccgacggccgacgggtccacgtcggacctaccgtcccgacggtccgtacggttcgacggggttcggggtacggggtttggggtttacgaccgtaacgtaaccggttacctttaccctaaccttacctaacctaacgtaaacgtaccgtaacgacccgtaacccggttacccctaacccgtaaacccgttaagggttaaacggtttacgtttacggtaaccgtttaacgtttaacctttaacgtttaaccgttaccgtaaaccaaacggtaccggttaaccggtaaacgtacggttaaccgttccgggtacccttacgttacccgttaccgggtttaccgggacggggtaaaccgggtaacggtaaggggttacggtaacgtaacggtaaccgtaaacggtacgttgggacgtaccgacgtaccgtacgtacgttccttcggtacc

SEQ ID NO: 240564 - DNA, 692 bp, Homo sapiens
  misc_feature: GYAE6OF02HB3L7.45.35.D02.1.454.CMB.1.raw
  modified_base (408)..(408): a, c, t, g, unknown or other
  misc_feature (408)..(408): n is a, c, g, or t
  modified_base (628)..(628): a, c, t, g, unknown or other
  misc_feature (628)..(628): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcccccagataccaccggaaaattgtgttgacacagtctccaggcaccctgtctctgtctccaggggagacagccacccgtctcctgacgagggccagtaggacgtggtcagtaagtacttaggctggtaccaacgagaaacctggccaggctcccgaaggctcctcatccgatcgatgccattacccaaacgtacgggtccctggaccgttcccgaaggtaccgtaacgggtttccccggtaggacgtaagggttcggggtaccgtaggggtaacncggtaacgtttcaccgttcttaaccgacccggtcaacgaccgacggtacccgttagggacgtcctgaacgttcgtaacgtttttcgacgttaacgtttacttacgttcgtactaacgctacggtccgttcccgacctaccgtaccgcttcgttaccggttccggggaccgggggtaccaggggtacgtaggtaacgtggaaccggtagtaaccgttcggnggtccgttagcctaccgtacgttcgtgttccgttcgtaccgtcccggtaccctacgtacttcgg

SEQ ID NO: 240565 - DNA, 777 bp, Homo sapiens
  misc_feature: GYAE6OF02H4QBE.45.35.D02.1.454.CMB.1.raw
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
  modified_base (202)..(202): a, c, t, g, unknown or other
  misc_feature (202)..(202): n is a, c, g, or t
  modified_base (575)..(575): a, c, t, g, unknown or other
  misc_feature (575)..(575): n is a, c, g, or t
tcagacgcgatcgacacgaccggtgctcgatttagcacacgatagttgggtttggggggaggaactgctcagttaggacccagagggaaccatggaagccccagctcagcttctcttcctcctgctactctggcctccagagcctcggagtaaattgtcttgacanagtcnccagcctattctgtctctctctcgagggganacacgcctaccctctcatcgacgacgggccagtcaaggataattaagaactatacgttaggacctggtaactacaaataacgaagtccgtacggccgtaacggggtccccgtctaccgtacacttacccaaagttggactagacctaacgtaaccgtaacggaccgggttccctagggtacccgtacccaaggtaccgtaacgggtttcccggaggtaccgtagggtttcgggtacggtaacgggtaacgtaacggtcggtttaccaacttcgtacccgaacggtcaacggcaacggtccgttcgggacgtacgtacggtaagttcggttaactttacggtacttaacgtttttccgtagtttacgacgttanacgtaggtaacccttccgaacccggtacggtccgttaccgtaccggtttaaccggggttaccgggggtcccggggggtaaataaccgggggttggaaacggtacggttacgggtaacgggtaaccgttaaagggttacggaccgggttctaaccggacttaaccgtacggttacgtttaccggttacctttacgtaaccccg

SEQ ID NO: 240566 - DNA, 336 bp, Homo sapiens
  misc_feature: GYAE6OF02IUUQW.45.35.D02.1.454.CMB.1.raw
  modified_base (168)..(168): a, c, t, g, unknown or other
  misc_feature (168)..(168): n is a, c, g, or t
  modified_base (191)..(191): a, c, t, g, unknown or other
  misc_feature (191)..(191): n is a, c, g, or t
  modified_base (256)..(258): a, c, t, g, unknown or other
  misc_feature (256)..(258): n is a, c, g, or t
  modified_base (262)..(263): a, c, t, g, unknown or other
  misc_feature (262)..(263): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (277)..(278): a, c, t, g, unknown or other
  misc_feature (277)..(278): n is a, c, g, or t
  modified_base (280)..(282): a, c, t, g, unknown or other
  misc_feature (280)..(282): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (291)..(336): a, c, t, g, unknown or other
  misc_feature (291)..(336): n is a, c, g, or t
tcagacgcgatcgacacgaccggtgctcgatttagcacacgataggtgggtttggcacagacttcactctcacaatccagcagcctccaacctgaagattttgcagtctattactgtcaacagcgtacagattggccgctcactttcggcggagggaccaaggtgganatcaaacgactgtggctgcaccntctgtcttcatcttcccgcatctgatcgatcgctctgacgcggctggccaaggtcgccagtagcnnngacnntcngntncgacntnnannntngccngcnnnnnnnnnnnnnnnnnnnnnnnnnnnnnnnnnnnnnnnnnnnnnn

SEQ ID NO: 240567 - DNA, 554 bp, Homo sapiens
  misc_feature: GYAE6OF02FIMFA.45.35.D02.1.454.CMB.1.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccgntcctcatctatgatgcttccagcagggccacgtggcatcccagccaggttcaggtggcggtgggtttgcacagacttcactctacacaatcagcacgccctaccaacctgaagtattttgactagttctattactgtacaacagctacagtacttcggcctcttcgtacgtttccggacgggtacgggaccgtagggtcggtagaacgtaccgaaaacggtacgttaggtacggtcttacggacctaccgtacttaccgttgttaccg

SEQ ID NO: 240568 - DNA, 750 bp, Homo sapiens
  misc_feature: GYAE6OF02IGBJV.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggaagaaattgtcttgacacagtctccagccattctgtctctctctccgagggganacagccaccctctcatgcacgggccagtcaaggacgtaattaagaactatacgttcggccgttggtatacaatacagctcggccgacgggtccccgctcctcactctatgactgccttaccacgtcgacgggtccacgtcggacctactccgacgtaccgtaggttccgaggggtcggggtggggtttcggggtttcgacgtaacgacgttaaccgttacctaccgttcctaaccgaacctaacgtaccgacgtaccgtacccggtacccctaacccgtaaaccgttaggtaaacggtttattttacggaccttaacgtttaccgtttaaacgtttacgttacgttaaaccgaaacgtacggtaaccgttaacggaagttacgttaccgggtacccgttaccttaccgttaccgggttttacgggaaccgggttaacggggaaccgtaaggggttacgggaacgttaaacggtaaccgtaaacggtaaccggttcggttacgggtcctaccggtaccaaccggtttaacttccggttacgtttacccg

SEQ ID NO: 240569 - DNA, 554 bp, Homo sapiens
  misc_feature: GYAE6OF02H9EQZ.45.35.D02.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctnatctangtatgcttcagcacgggcacnggcatccagctaggttcagtggcggtggtttcggcacngtacttcgacttcncaacatcagcacgtcctaccaactgaagtatttgctagttctaacttactacgtacaacacgtacgtagagtattcggccgtctcgtacgttcggacggtacggacgaagggttcggaagtacgtaaccgaaacgtacgtaggttaggccgttacggacctaccgtacgttccgtagtttacccg

SEQ ID NO: 240570 - DNA, 580 bp, Homo sapiens
  misc_feature: GYAE6OF02F7TQ6.45.35.D02.1.454.CMB.1.raw
  modified_base (201)..(201): a, c, t, g, unknown or other
  misc_feature (201)..(201): n is a, c, g, or t
  modified_base (283)..(283): a, c, t, g, unknown or other
  misc_feature (283)..(283): n is a, c, g, or t
  modified_base (399)..(399): a, c, t, g, unknown or other
  misc_feature (399)..(399): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatactggcctggtatcaatacaagcctgccagggtccccgntcctcatctatgatcgcttccagtcagggccagtcggcatcccagccaggttcagtggcggtgggtttcgctacgagtacttcactctcacatcagcacgcctaccaactgaactntttagctagttctattactgtactaactacgtacgtaacagtacgttcgggtccgtacgttaccgtaccgtttcgggacgggtaacgggtaccgtaagggtacggaacggtaactaaccggaaaacggtacgttacggtacggtacctacggaccgtaacctacgttccgtcgtttacccg

SEQ ID NO: 240571 - DNA, 595 bp, Homo sapiens
  misc_feature: GYAE6OF02GZU4I.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggganacagccaccctctcatgcagggccagtcagagtattagaacatacttggcctggtatcaatacaagcctggccagggtccccgctcctcatctatgatcgtcttccagcacgggccacgtggccactcccagcctaggttcaggtcggcggttgggtttcggcagagtacttcactctcaacatcacgacacgccctaccaacctgtaagtacttttcgctagttacttactttactacgttacaactacgaccgtacgacgtacgtttcggcccgtcgtaccgtaccggtttcgggaccgggtacgggaaccgtagggtacggaacgtacgtaacgtaaacggaacgttacggtacggacgtacggaccgtaccgtacttccgtagttaccg

SEQ ID NO: 240572 - DNA, 695 bp, Homo sapiens
  misc_feature: GYAE6OF02F0WIV.45.35.D02.1.454.CMB.1.raw
  modified_base (689)..(689): a, c, t, g, unknown or other
  misc_feature (689)..(689): n is a, c, g, or t
tcagacgcgatcgacacgaccggtgctcgatttagcacacgataggttgggtttggggaggaactgctcagttaggacccagagggaaccatggaagccccagctcagcttctcttcctcctgctactctggctcccagagacctccggagaaacttgtcttgacacagtctccagccattctgtctctctctccaggggacacagcccaccctctcatcgcgagggcccagtcagagtattagaactatactggcctggtatacaatacaagcctcggccgacgggtccccgctccgtcatatatgatcgtccttcgagcgacgggccacgtgcctactcccagccgtaggttccagggttcgggacggggttggggtttacgacgtaacgacgtacctttaccaccttacccgtacctaacaaacttccgaaccgtaccgtaaccggaccccctttaaccccgaaacccgttacgggtaaacgtttacggttttaccgaccttaacggtttacttaacgtttacgttacgtaaccgtaaacgtacggttaccgttaactacggttaaccgttcggtacccgtacttaccgttaccgtttaccggggacggtaaccgggaccggtagggtacgacgtaacgtacgaaacggtacgtacggttagcgtcgaccgtaccgtcgtaccgtnttaccg

SEQ ID NO: 240573 - DNA, 663 bp, Homo sapiens
  misc_feature: GYAE6OF02IC55U.45.35.D02.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (362)..(362): a, c, t, g, unknown or other
  misc_feature (362)..(362): n is a, c, g, or t
  modified_base (410)..(410): a, c, t, g, unknown or other
  misc_feature (410)..(410): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctcagggganacagccaccctntcatgcacgggccagtcaagagtattagaacatacttggcctggtatcaatacaagctggaccacgggtccccgctcctcatctatgatgcttccagccgaggccagtggcactccagcacggttcaggtcgggcggttggttggcacgngtacttcactctacactaatcagcacgtcctaccaactagtaaacgtntttacgacttagttacttattacgtacgtaactaacgacgtaccgtaacgtaagtaactttccgggacccgttaccgttaccgttacggttttacccggggaaccgggtaacgggggtaaccgtaaacgggggttacgggtaaacggtaaacggttaaaccgtaaaaaccggggtaacgttacgggttaccggggtaaccggtttaccgaacccggtaacccgttaacgtttcccggtttacgttttaccccg

SEQ ID NO: 240574 - DNA, 774 bp, Homo sapiens
  misc_feature: GYAE6OF02F15CH.45.35.D02.1.454.CMB.1.raw
tcagacgcgatcgacacgaccggtgctcgatttagcacacgatagttggggtttaggggggaggaactggctcagttaggtacccagagggaaccatggaaggaccccggagtctcaggcttctcttccgtcctgctactctggctacccaagagacctccggagaaattgtcttcgaccacagtcgtccaggccacttctgtcgtcctctcctccgaggggagacagccacccgtctcgatcggccagggccaggtcagacgttatagaacctagtacctggccttggtactcaatacaagtccgtggccacgggtccccggctcctcatcatgtatcgcgttcagcgacgggtccacgtcggacgacgtcccgaggtccgtagggttaccaggggttacggggtaccggtttcggggtttacgggacgttaaccggaggtaaccctttaccgaaacccgtttccctacccgtaaccgaaacgtttaccggaacggtaccgaaaccgtacccccttaacccgtaaacccttacgggaaaacggtttaccgtttacgggaacctaacggttaacccttaacttttacccgtacgttaccgaaaacgtcggtaaccgttaacggacgttacgttacgggtcccggtacccttcgtaacccgtttcgggggaaccggtaggggaacccttaaggggccggtaaggaacgtaaccgaaaacgggtaacgttcggtaccggacgtaccggacctaacggacgtttccgtagttacccg

SEQ ID NO: 240575 - DNA, 644 bp, Homo sapiens
  misc_feature: GYAE6OF02H91SC.45.35.D02.1.454.CMB.1.raw
  modified_base (205)..(205): a, c, t, g, unknown or other
  misc_feature (205)..(205): n is a, c, g, or t
  modified_base (393)..(393): a, c, t, g, unknown or other
  misc_feature (393)..(393): n is a, c, g, or t
  modified_base (561)..(561): a, c, t, g, unknown or other
  misc_feature (561)..(561): n is a, c, g, or t
tcagacgcgatcgacacgaccggtgctcgatttagcacacgatagttgggtttggggaggaactgctcagttaggacccagagggaaccatggaagccccagctcagctttctcttcctcctgctactctggcctcccagataccactgggagaaatagtggtagacacagtctccaggcaccctgtctctgtctccgagggganacacgccaccctctcctgacagggccaggtaggacgttgtacaggttaatacttaggctcggtaccaacgagaaacctggaccaggcctacccgacggtctccgtcactcccaatgactcgctaacgtaccaacgacgggtcccctaggcccgtaccagtaccgaggtttccgaggcctaggtcggtntgggacaacgtgttacactcgtcgaccgtcaactcgccgtagacgcctaggactgtattttcgcttacgtttacgttctacgttcaacgtcgtacgtccggttcgacccgtcgacccgtctaccgtaccggttcgggaccgggggtacctcggggtacgagtaacggngaacgacggtaacgtggtacggtcgtacggtaccaacttacgtacgttcgtacccgttacctacgtttacccgtcccgtaccg

SEQ ID NO: 240576 - DNA, 266 bp, Homo sapiens
  misc_feature: GYAE6OF02HUR4S.45.35.D02.1.454.CMB.1.raw
  modified_base (261)..(266): a, c, t, g, unknown or other
  misc_feature (261)..(266): n is a, c, g, or t
tcagacgcgatcgacacgaccggtgctcgatttagcacacgatagttgggtttggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttccgccatctgatcgatcgcgtctgagcggctggcaaaggcgcatagnnnnnn

SEQ ID NO: 240577 - DNA, 770 bp, Homo sapiens
  misc_feature: GYAE6OF02JWXIO.45.35.D02.1.454.CMB.1.raw
  modified_base (530)..(530): a, c, t, g, unknown or other
  misc_feature (530)..(530): n is a, c, g, or t
  modified_base (595)..(595): a, c, t, g, unknown or other
  misc_feature (595)..(595): n is a, c, g, or t
  modified_base (625)..(625): a, c, t, g, unknown or other
  misc_feature (625)..(625): n is a, c, g, or t
tcagacgcgatcgacacgaccggtgctcgatttagcacacgatagttgggtttggggtaggaactgctcagttaggacccagagggaaccatggaagccccagctcagcttctcttcctcctgtctactctggcctcccagagaccctccggagaaattgtcttgacacacgtctccagcctattctcgtctctctccgtaccagggggacacacggaccctaccctcctcaacttcggaccgacgggaccctaggtccaaggtacgtaagttacggaactacgttacttacgggtcccttaggtacctacgaattaaccaagtcctagggccccgtaacgggtccccccggtattccccgtacattccgtactgtagtaccgcctttaccgacgccggtaacggccctaacgttggaccactccccgaggtaacccgtgggttaccgaacggttgggtcggggtttgggttttacggcctaacgtcggtaaccttccgacctcgtacaaccgtaatcgactccggtacncccgtacccaacccgtggaaactttgttcggacttacgttacctttataacgttcgtaacaacgngtacttaaccgagtaccgtagtccccggtntttacccgtagttaccgggaccggtaacggtaccgtaaggttcgggtaacgtaaacccggtacgttaaaacccggaaccgtttacgggtcggtaaacccgttcgggaaccccttaaaggttcccgttaccgttttaacggttccg

SEQ ID NO: 240578 - DNA, 730 bp, Homo sapiens
  misc_feature: GYAE6OF02GM6SS.45.35.D02.1.454.CMB.1.raw
  modified_base (199)..(199): a, c, t, g, unknown or other
  misc_feature (199)..(199): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctccggagaattgtcttgacacagtctccagccattctgtctctctctccgagggganacacgccaccctctcatcgcagggccagtcagtagtattagaacattacttggcctggtatcaaatacaagcctggccacgggtccccgctccctacagtctatgtatcgcttccgagccgagggccacgtcggcctactcccgacgcctaggttcagggttcgggcgggttaggggtttcggcgacgtacggtacctttccaccgtttctacctaactaactccgaacgccgtacgtaccccgtaacccgtaaacccgttaggtaaacgtttacgttttcgaccgttaacggtttactttaacgtttaccttagtaacctaacgtaacggtacgttaaccgtagtaacgttcggggtacccgttaccgttacgttaccggttttccgggaacgggtaaccggggtaccgtaaagggggttacggaaacggtaacgttaaccggaaaaccgggtaacgttacgggttacggggtaccgtttaacggaacccggtaacccgtttacggttacccgttacggttttaccccgg

SEQ ID NO: 240579 - DNA, 574 bp, Homo sapiens
  misc_feature: GYAE6OF02HLX4F.45.35.D02.1.454.CMB.1.raw
  modified_base (202)..(202): a, c, t, g, unknown or other
  misc_feature (202)..(202): n is a, c, g, or t
  modified_base (298)..(298): a, c, t, g, unknown or other
  misc_feature (298)..(298): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtacttgacacagtctccagccattctgtctctctctccagggganacagccaccctctcatgcagggccagtcagagtattagaacatacttggcctggtatcaatacaagcctggccagggtccccgctcctcatctatnatgcttccagcagggccagtggcactccgagccgaggttcaggtcgggtcggttggggtttcgactaacgtcgtactttcaacgttctacaactatcagccacgcctaccaacgtgtaacgtatttacgctattcttattactgtactacgacgtacgttacagtacgtggccgtacttacctcggttacggacggtacgggaaccgtagggtacggacgtaacaccgtaaacgtacgtaggtcgacgttcgacctaccgtagttacctgttaccc

SEQ ID NO: 240580 - DNA, 553 bp, Homo sapiens
  misc_feature: GYAE6OF02GIY45.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccactgcatcccagccaggttcagtggcggtgggttgcacagacttcactctcacatcagcagcctaccaacctgaactatttcgctagttctattactgtacaacacgacgtacagtactacgggcccgtcttaccgtaccgtttcgggaccgggtacgggaccgtaagggtggaacggaagttaccgaaacggtaacgtacggtaggtaccgtagaccaaccgtagttccgtgttacc

SEQ ID NO: 240581 - DNA, 583 bp, Homo sapiens
  misc_feature: GYAE6OF02HBNT3.45.35.D02.1.454.CMB.1.raw
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
  modified_base (322)..(322): a, c, t, g, unknown or other
  misc_feature (322)..(322): n is a, c, g, or t
  modified_base (452)..(452): a, c, t, g, unknown or other
  misc_feature (452)..(452): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctccggagaaattgtcttgacacagtctccagccattctgtctctctctccgagggganacagccacctctcatgcagggccagtcagacgtattagaacatacgtggcctggtatcaatacaagcctggccagggtccccgntccgtacatctatgatcgtctcagcgaggccagtgacnctaccagccagtcaggtgggtacggttgggttcgactagtacgtacttcgactactcaacaatcgacgcacgcctaccctaatggaaattctttcgactagttactattacacgttacaacaggtctaanacggttactcggacctattacgtaccgtttacgggaacgtacgggtaaccgtaagggttacgacggtaactaccgaaacggtaagttccgggagtccgtagacccgttaaccgagttaccgtagttacccg

SEQ ID NO: 240582 - DNA, 789 bp, Homo sapiens
  misc_feature: GYAE6OF02IIS7H.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcgacgggccagtcagagtattagaacattactggcctggtatacaatacaagcctggccgtacgggtccccgctcctctatctatgatcgccttcacgcgacgggcctacgtcggactactcccgagtccgtaggtttaccgagggttcgggtacggggttggggttttacggaccgtaacgtacggtaccttaccgtaccgttacctacctaaccgtaactaccgaaccgtacctaaccgtccccttaacccgtaacccgttaaggtaaaccggtttacttttacggaaccgttaacggtttaaccttaacgttttaaccgttacggttaacccgtaaaccggtaacggtaaccggttaacgtaacgggttacgtttaccgggacccggttaccgtttacccgttaaccgggtttcccgggggaaccgggtaaccgggggtaacccgttaagggggttaacggaaccggttaaacgggtaaacccgttaaaaccgggtaacccgttcgggtaacggtaccggttaccggtaacccgtaacccgttaacggttccgttaccggtttacccg

SEQ ID NO: 240583 - DNA, 713 bp, Homo sapiens
  misc_feature: GYAE6OF02ITJ8N.45.35.D02.1.454.CMB.1.raw
  modified_base (199)..(199): a, c, t, g, unknown or other
  misc_feature (199)..(199): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctcagggganacagcccaccctctcatgacgaggccagtcagagtacttagaacatacttggcctggtatcaatacaagcctggaccgtacggggtcccccggctccttacgacttctatcgattcgccttaccagacgacgggacctacgtcgggacaacgttcccacggaccctaaggtttccgagggttcgggtcggggttaggggttttcgacgtacgtacgtaccttctaaccgttcttacacgtaaactcgaacgctaaccgtacccgtacctaaccgttacgtaaaccgtttagtttacgaccgttaaggtttcgttaactttacgttacgtactaaacgtacggttacgaacgttacggttacgtttaccggggaccctaccgttccgttaacccgttttcggggaacccgggtaagggtaacccgtaaggggttcggtaacggacggttaaaccgaaacggttaacggttacggtcggggtactacggtaccgactacgtttaccgtactttccg

SEQ ID NO: 240584 - DNA, 540 bp, Homo sapiens
  misc_feature: GYAE6OF02GQD5P.45.35.D02.1.454.CMB.1.raw
  modified_base (201)..(201): a, c, t, g, unknown or other
  misc_feature (201)..(201): n is a, c, g, or t
  modified_base (375)..(375): a, c, t, g, unknown or other
  misc_feature (375)..(375): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
  modified_base (531)..(531): a, c, t, g, unknown or other
  misc_feature (531)..(531): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaatacaagcctggccagggtccccgctcctcactctatgatgccttccagcacgggccacgtggcactcccagcctaggtcaggtggcggtgggtttcgcacgagtacttcactcncacatcagcacgccctaccgaacctagaacgttatttcgctagttcttacttactgtacaancgacgtanacgtagttcggccgtcttacgtacgttcggcgggacggtacgtaaggtggagaactacgaacgtacgtgtacggctcggaccaccnttctgttcc

SEQ ID NO: 240585 - DNA, 576 bp, Homo sapiens
  misc_feature: GYAE6OF02JJEIV.45.35.D02.1.454.CMB.1.raw
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
  modified_base (382)..(382): a, c, t, g, unknown or other
  misc_feature (382)..(382): n is a, c, g, or t
  modified_base (426)..(426): a, c, t, g, unknown or other
  misc_feature (426)..(426): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatccatgatcgcatccaacgcgggtccctggcctccagacgacggttccgtaggcaggtggtctgggactagacgttcacttcacgaccgtnacgcagcctaggcgccgtgtatcgtatttcgctactttactctntcagctagccggttccaccgtacgtccgtctccgtacggtttccgggccgggggtaccgtagggtcgacgtagtcggacgtaacggttaaccgttacggtcggtacgtacgacgttaaccggtattaccggtttcgttccttactacccg

SEQ ID NO: 240586 - DNA, 735 bp, Homo sapiens
  misc_feature: GYAE6OF02JMRKM.45.35.D02.1.454.CMB.1.raw
  modified_base (138)..(138): a, c, t, g, unknown or other
  misc_feature (138)..(138): n is a, c, g, or t
  modified_base (319)..(319): a, c, t, g, unknown or other
  misc_feature (319)..(319): n is a, c, g, or t
tcagacgcgatcgacacgaccggtgctcgatttagcacacgatagttgggtttggggtaggaactgctcagttaggaccagagggaaccatggaagcccagctcagcttctcttcctcctgctactctggctcccagngacctccggagaaattgtcttgacacagtctccagccattctgtctctctctccgaggggtagacacgccaccctcgtcatgcctaggggcccaggttccaagtacgtattacgaactagtacttggacctcggtatctaataccaagacctggcctaggggtcccccggtctcccgtacncgtactactgacgtcgccgttccaggctacggggccctacggtcggcctaacgtcccgacgtccccgtaggttaccgtacggtttgggtaccggggtttcggggttttacggaccgttaccgaaacgggttcccgttttaccggaacgttcccgtaccgtacgtaaaccgtttaccgaacggttcccgtaacggaccccgtttaccccgtaaacccgttacgggtaaacgttaacggttttaccgtaccgttaacggttacctttacggttaccgtttacgtaccgtactaccggtactaacgtacgttcgttacggccgtacgtaccttacgttcggtacgacgggtaccagggtacgaacgtacgactaaacgacgttggtacggcgtcggtaccgacgtactaccgtgttacc

SEQ ID NO: 240587 - DNA, 631 bp, Homo sapiens
  misc_feature: GYAE6OF02JW3M0.45.35.D02.1.454.CMB.1.raw
  modified_base (150)..(150): a, c, t, g, unknown or other
  misc_feature (150)..(150): n is a, c, g, or t
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (317)..(317): a, c, t, g, unknown or other
  misc_feature (317)..(317): n is a, c, g, or t
  modified_base (592)..(592): a, c, t, g, unknown or other
  misc_feature (592)..(592): n is a, c, g, or t
  modified_base (617)..(617): a, c, t, g, unknown or other
  misc_feature (617)..(617): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccgganaaattgtcttgacacagtctccagccatttctgtctctctctccgagggganacacgcctaccctntcatgcacgggccagtccaggagtattaagaactatacgttggacctggtatcaatacagcctggccgacgggtcccggctcctcacgtcctagtcgagtntcccgttccgaagccgaacggggtcccacgttcggccaccgtacccgacgtccgtaacggttacgacgggttcgggtcggttggggttttacggacgtaaccgtacggtaccctttacgacccgttaccgtcgtaactaacgtacacggtacctacgtccccaactaaccgtgtaacgtatttcggactacggttacttacgttacgttacgtactaacgtacgttacgtacagtcgtacgccgtacttcgttcggtacgtggaccgttacaggngacgatacaagtacgtacgtgacgngcacacgtctagtc

SEQ ID NO: 240588 - DNA, 672 bp, Homo sapiens
  misc_feature: GYAE6OF02HGJLB.45.35.D02.1.454.CMB.1.raw
  modified_base (261)..(261): a, c, t, g, unknown or other
  misc_feature (261)..(261): n is a, c, g, or t
  modified_base (291)..(291): a, c, t, g, unknown or other
  misc_feature (291)..(291): n is a, c, g, or t
  modified_base (356)..(356): a, c, t, g, unknown or other
  misc_feature (356)..(356): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagataccaccggaaaaattgtgttgacacagtctccaggcaccctgtctctgtctcgaggggagacagccaccctctcctgcagggccagtaggagtgtcagtaagtacttaggctggtaccaanagaacctggaccaggctcccaggcctcctnactccagtcgatcgcactaccgaacgtacgggtccctggcctacccgaggaccgtagggttccgnggctacgggtggtccgtggggactaggtacgttctactcgtacgaccgttgacgcgacgtccggtggactccgtcgagttagttacgtttgactagtcttatttaccgtgtactaacgtagtccgtactaggtcttccgggcgtcctacgttaccggtttccgggaacggtaaccggggttacgtaaacggggttcggaaacgtacgttaaccgaaaccggtcggttacgggttcggaaccggttcgtaacccgtaccgttacgttcccgtttaacggttcctttaccgtttccgtttacccgtaccccgttaccg

SEQ ID NO: 240589 - DNA, 814 bp, Homo sapiens
  misc_feature: GYAE6OF02IO62Y.45.35.D02.1.454.CMB.1.raw
  modified_base (203)..(203): a, c, t, g, unknown or other
  misc_feature (203)..(203): n is a, c, g, or t
tcagacgcgatcgacacgaccggtgctcgatttagcacacgatagttgggtttgggggaggaactgctcagttaggacccagagggaaccatgggaagccccagctcagcttctcttcctcctgctactctggcctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccgaggcctcctcactccatagatgccactacccgaaacgtcgggttacccctgggtcccgttaccccaaggtaccgtacgggttttcccggagggtaccgtacgggttggggtccgttacgggggaacctagggtaacggtttccctaacgttccgttaccgaaccggttcgaacgtcccgtaccggtcccgtttcgggaacgtcccgttagggtaacgtttacggttaacgtttttacgggtaaccctttaaggttttttaacccgttccgtttacgggttacccgtaagggtacccgtaacgggttacccggttttccccggaacccgttacccgggtccccggtaccgtttacccggtaacccgggttttacccggggggaccgggggggtaacccgttaaggggggtaccgtaacgggtaacgttcgggaacggtaaccggtacgttcgggtacgggccttaccggccgtaaccgtagttaccgttcggttaccgttacgtacgttccccgttcccggacttaccg

SEQ ID NO: 240590 - DNA, 723 bp, Homo sapiens
  misc_feature: GYAE6OF02F5ZJZ.45.35.D02.1.454.CMB.1.raw
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (287)..(287): a, c, t, g, unknown or other
  misc_feature (287)..(287): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacngcccaccctctcatgcagggccagtcagagtattagaacatacttggcctggtatcaatacaagcctggccacgggtccccgntccctcatctatgatcgccttccgagcgacgggcctacgtgacctactcccagcctaggttcaggtcgggtacgggttggggtttcgactacgtacgtaccttcgtacctccgtacaactactacgacgtccgaacgtcccctaacccgtaaaccttaggtaaacgttacttttacgaccgttaaggttaccttaacgtttaccgttacgttacctaaaccgtaggtaccggtaacgtacggttacggttaccgggacccgtaccgtttaccgttaacccggttttaccgggaccggggtaaccgggtaacccgtaaggggttacggtaaacggtaacgttaaacccggtaaaaaccgggttaaccggttacgggttaaccggtaccggttacggtaaccctaacccggttacgtttcccgttaccggtttacccc

SEQ ID NO: 240591 - DNA, 662 bp, Homo sapiens
  misc_feature: GYAE6OF02G7H0G.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatgcacgggccagtcagagtattagaacatacgttggccttggtatcaatacaagtcctaggccacgggtcccccggctccctcacttctatgatcgccttccgagcgacgggcctacgtcggaccacgtaccccgagtcccgtacggtttccgagggttcggggttaccggggttggggtttcggactacgtacgtacctttaccaccttccgtacctaactaacgtcgaacgaccacgtacccctaaccctaacccgttagtaaacgttacttttcggaccttagttaccttattacgtgttacaacgtacgtaccgtaagtacgtacgttccggtacctcgttaccgttaccggttcgggacgggtacggaccggtagggtggaacgtacgtaacgaaacggtacgtaggtacgactacgaccgacctacgtctcgttacc

SEQ ID NO: 240592 - DNA, 674 bp, Homo sapiens
  misc_feature: GYAE6OF02FV05C.45.35.D02.1.454.CMB.1.raw
  modified_base (203)..(203): a, c, t, g, unknown or other
  misc_feature (203)..(203): n is a, c, g, or t
  modified_base (376)..(376): a, c, t, g, unknown or other
  misc_feature (376)..(376): n is a, c, g, or t
  modified_base (562)..(562): a, c, t, g, unknown or other
  misc_feature (562)..(562): n is a, c, g, or t
  modified_base (638)..(638): a, c, t, g, unknown or other
  misc_feature (638)..(638): n is a, c, g, or t
  modified_base (646)..(646): a, c, t, g, unknown or other
  misc_feature (646)..(646): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctccagagacctccggagaaattgtcttgacacagtctccagccattcctgtctctctctccgagggganacagccaaccctctcatgcagggtccagtcagtagtattacgaacagtacttgggccttggtataccaagttacaaagccgttggcccgtaaggggttccccccggcttcccggtacacgttctacgtagagttcgtcccttcgacgacggtaacggcccagttcggcctaancccaacggtcacgggtttacagggtcgggtcggtttcgggtttggacctacgaagttacgttcaaccgtcttacaaactacgttacgaacgacgacgtaccccttccgtaaaacctcgtaaacgttcttttacggctaacgttacctatttaactcgtaacaacgtacgcgtacatacggtttacnccgttactcctaccggtttcgggccgggttaaaccgtcggtaagggtcgaacggtagtaaccgtaaacgtaaccgngtaggtcnccgtaaccacgacgttacggttacttcc

SEQ ID NO: 240593 - DNA, 617 bp, Homo sapiens
  misc_feature: GYAE6OF02IGGGR.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccgacgggtccccgctcctcatctatgtatgcttccagcgacggccacgtggccactcccgagccgtaggttcaggttcggcggttgggtttcgacgactacgtaccttcactctacactatcagcacgacctacctaactagtaacgtatttacgctacgttcttattacgtacgtaccaacgtacgtacgtaacgtacgtacgttcggccgtcttaccgttaccgtttaccgggaccgggaacgggtaaccgtacgggttacggaacggtaacgtaaccgtaaacggtaacgttacggtacggtacgtacggacccgtaaccgtacgttccgttacgttacccg

SEQ ID NO: 240594 - DNA, 667 bp, Homo sapiens
  misc_feature: GYAE6OF02JERF1.45.35.D02.1.454.CMB.1.raw
  modified_base (198)..(198): a, c, t, g, unknown or other
  misc_feature (198)..(198): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctcagccattctgtctctctctcagggganacagcccacctctcatgcagggccagtcagagtatagaacatacttggcctggtatacaatacaagcctggccgacgggtccccgctcctcactctaatgatcgccttccagccgagggcccacgtcggactacgtcccgagccgtaggttcaggtggcggttgggtttggcacgtacgtacttacgaccttctaccgtaactaactcgtaacgccgtaaccgtaccctacccaaaccgtaggtaaacgttacttttcggacttaggttaccttaactttaaccgtagtacctaaacgtaacggtacgttaacgacgttacgttaccgggaccgtaccttaccgttacggtttaccgggacggggtaacgggtaaccggaagggttacggaacgtaacggttaaccgaaaacggtaaccgttaggtaccggtacgtacgacctaacccgtaacttccgttacgttaacc

SEQ ID NO: 240595 - DNA, 661 bp, Homo sapiens
  misc_feature: GYAE6OF02I6BSQ.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacacgccaccctctcctgcagggccagtaggagtgtcagtaagtacttaggctaggtaccaacagaaacctggccaggcctcccgaggcctcctcatccatgatcgacactacccgaacgtacgggtcccctagggcccgttccccgaagaccgtacgggtttcccgtggccgtaggttggggtacgtaggggacaggtacgttccgacttccgtccgtaccgtcgaacgtccacggtcccgtggacgtccctaggattcggttattttcggacttaggttttaccttcgtcgtacgagtctaggttcccgttcccggaccaccggtcccgtaccttccggtaccgggtttccgggggaccgggggttaccgacgggggttaggacgtagtacggacggtacgtacgttggtcggcgtaccgcgaacctagtctcgtcttaccgtatacccgtcacctcg

SEQ ID NO: 240596 - DNA, 688 bp, Homo sapiens
  misc_feature: GYAE6OF02J0DKV.45.35.D02.1.454.CMB.1.raw
  modified_base (202)..(202): a, c, t, g, unknown or other
  misc_feature (202)..(202): n is a, c, g, or t
  modified_base (248)..(248): a, c, t, g, unknown or other
  misc_feature (248)..(248): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagtccaccctctcatgcacgggccagtcagagtattagaacctntacgttggccttggtatacaatacaacgccttgggccgtacggggtcccccggacttcccgtactagtctagtacgattccgacctttccgacggaccgacggggtcccaacgttcgggcctacgtccccgagacccgtaggttccaagggttccgggtcgggtttggggtttcgactaacggacgtaaccgttccaacgttccgtacaactactccgagccacgtcctaacaaccgtgtaacgttgtttcgacgtattcgttaattacgtacgtaccagtacggtacgtaacgtagacgttcggccgtaccttgtaacccggtttcgggaaccggtacgggtaacgtagggtggaacgtaacgtaaccggaaaccggtaacgtttcggtaccgggtaccttacggaaccctaccggtaacttccggttactttacccgg

SEQ ID NO: 240597 - DNA, 735 bp, Homo sapiens
  misc_feature: GYAE6OF02H36GM.45.35.D02.1.454.CMB.1.raw
  modified_base (201)..(201): a, c, t, g, unknown or other
  misc_feature (201)..(201): n is a, c, g, or t
  modified_base (612)..(612): a, c, t, g, unknown or other
  misc_feature (612)..(612): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctcgagggganacagccacctctcatgcaggcaagtcaagagtaatagaactatacgttggaccttaggtataccaattaacgaaacgtccgtaggacccgtaacggggtccccgtcgttacctcgtactaccttagtcgtaacgtcgtaccgttacacggacgtacggggacctaacgtcggaccactccccgaagacccgtaggtttaccgaacggggtttcgggtaccgggggtttcgggtttacgggacctaaacgtacggttaaccgtttaaccctaaccggttactaacccgtaaccgtaaacttacggaacgtaccgaacgtaccccgttaacccaaaccgttaaagtaaaccgtttagttttaccgaacgttaacgttactttagttaacgtgtaaccaacgtagtaaccgtanaacgttcgtaccgggccttgtaacgtaccgttacgggcgtaacgggaccgtaggtcggtaagcttaacggaaaccgtagacgttggtactacgtacccgaatacgttacccgtagttaacccg

SEQ ID NO: 240598 - DNA, 742 bp, Homo sapiens
  misc_feature: GYAE6OF02I8F8K.45.35.D02.1.454.CMB.1.raw
  modified_base (185)..(185): a, c, t, g, unknown or other
  misc_feature (185)..(185): n is a, c, g, or t
  modified_base (200)..(200): a, c, t, g, unknown or other
  misc_feature (200)..(200): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagataccactggagaaatagtggtgacgcagtctccaggcaccctgtcngtgtctccgaggggnagagtccaccctctcctgcaccggccagtacaaagtcgttcgacgacccgatacttagcctggtaccagcagacgacctggccagccctccgaggccttcctcatctatggtcgcctactccccgtcgacggtcccttcgtcgggtccgtacccccgcgtaaggttcccgaggtcgggactagggttcggggttctacgggacctaggtacgtttccacttcctacaaccatcgacgacacggtcctaggctacgttacgaggttaaacgttagttttacgaacggtttaattttacgtttacgtttcgttcgttcgtaacttaacgttttaagtaaaccgttaggtaccgtttaccgggtcccgtttaaccggggttaacccgggtttcccgggaaccggtaacccgggggaaaccgggtttacggggttttaaacggaaaacgttaacccggtaaaaaccgggttaacggttacggttaacgggtactaccggtaccggttaaaccctaacggtttccggttaccgtttacgtttacccg

SEQ ID NO: 240599 - DNA, 768 bp, Homo sapiens
  misc_feature: GYAE6OF02GLN5X.45.35.D02.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (220)..(220): a, c, t, g, unknown or other
  misc_feature (220)..(220): n is a, c, g, or t
  modified_base (265)..(265): a, c, t, g, unknown or other
  misc_feature (265)..(265): n is a, c, g, or t
  modified_base (759)..(759): a, c, t, g, unknown or other
  misc_feature (759)..(759): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctccggagaaattgtcttgacacagtctccagccattctgtctctctctccgagggganacagcccaccctntcatgcnggccagtcagatatagaatatactggctggtatacaagtacaacnccgtggccgtaagggtcccccgacgtcctcacttctaatcgtaatcggtccttcccaggtccgaacgggtccctaacgtcggactaccgtacccgacgtcccgtaaggttccgaaggggtttcggggccggggttttcgggggtttacggccgtaacggtaaacggtacctttaccgtaacccgttccttacgaacccgttaaacttccgaacgcctaacggtaccccttacccgtaaaccgttaaggtaaacgtttaacgtttcggaaccgttagtttacccgttaatttacccgttacgtaacccgtaaagtaaccggtcgtttaaacgacgttaacgttccggtaaccgtccgtttacgttaccgttttaccggggcggttaacggggtaccgtaacggggttcgaaacggttaccggtaaaccgttaaaggtacccgtttaacgggtcggtaccggttaccggaccgttaacccgttacgtaccggtttnttaacccgg

SEQ ID NO: 240600 - DNA, 538 bp, Homo sapiens
  misc_feature: GYAE6OF02F4C21.45.35.D02.1.454.CMB.1.raw
  modified_base (201)..(201): a, c, t, g, unknown or other
  misc_feature (201)..(201): n is a, c, g, or t
  modified_base (434)..(434): a, c, t, g, unknown or other
  misc_feature (434)..(434): n is a, c, g, or t
  modified_base (485)..(485): a, c, t, g, unknown or other
  misc_feature (485)..(485): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagctggccagggtcccccgctcctcatctatgatgcttccagcagggccacgtggcactcccagccaggttcagtgggcggttgggtcgtggggacaggtacgttcactcctacaccgtcgagcagccgtggacgccgtgatgtatttgcttagtttcttctgtcagcngtccgttccgccgacgcccgcttccgtaccgtttcgggcgggggtacccgngggtcgaggtagtggagacggtaacgtgtcggctggacctacacttccgtgtc

SEQ ID NO: 240601 - DNA, 834 bp, Homo sapiens
  misc_feature: GYAE6OF02J17GV.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagataccaccggaaaattgtgttgacacagtctccaggcaccctgtctctgtcctccgagggganacacgccaccctctcctggcgacgggcctaggtacggagtgtctaagtaagttacttacgggctacggtaacaacgagaaaccgtggcaggcctccgaggtcctcctacgactccagtcgactcgacgtaactaccgaacgtaccggtcccgtcggaccgtcccgagtaccgtacggttccgtacggtacgacgggtttcgggacgtacggggtaacgtcggttaacgttccaccggttactaccgtaccggtaccacggtaccgtaccgtacccggtcggtaccgtaccgttaggtaacgttggtttaccggttttaacggtcgttttaaacgttttacccgttttccggttaacccggtcgtaacggtaccggtttaacggttcccgggtttccccgaaccggttacccccggttccggttaccgtttcccggttaaacccgggggtttcccgggggtaacccgggggggtaaaccggttagggggttacggtaacggtaccggtaacgggtaacgttacccgggttacgttaccggttacgggtacccgttcggaccttaccggttaaccgtcggtttacgttcccgtaagtttcccccggtttacccggttacccgtcgttaacccgg

SEQ ID NO: 240602 - DNA, 688 bp, Homo sapiens
  misc_feature: GYAE6OF02FW5PK.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggccagtcagagtattagaacatacttggcctggtatcaatacaagcctggccacgggtcccccggctccgtcattctatgatgcttccagcgacgggccacgtggcatcccagcctaggttcaggtcgggccgggttaggggtttcggactacgaacgtacttcgaccttcgtaccaacgtaaacttaccgagtaccgacggtcccctacccctaaacccgtagtaaacgttaacgtttttcgaccttaagttaccttacgtttaaccgttgttaacccaaaccgtagtaccgttaaacgtaagttagttaccggccggtaccgttacccgttaaccggttttccgggaccgggtaacgggaaccggtaaggggtcggtaacggtaacgtaaccgaaaaccggtaacgttacggtacgggtaccgttacggacccgtaaccgtacgttaccgttagtttaccccg

SEQ ID NO: 240603 - DNA, 612 bp, Homo sapiens
  misc_feature: GYAE6OF02F7T9O.45.35.D02.1.454.CMB.1.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (346)..(346): a, c, t, g, unknown or other
  misc_feature (346)..(346): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattcctgtctctctctccgagggganacagcccaccctctcatgcagggccagtcagtagtattagaacatacttggcctggtancaatacaagcctggccgacgggtcccccggctcctcatctagtgatcgctcagcagggccagtggcactcccagccgtaggttcnggttcgggcggttggggtttcgcacgtagtaccttcaccttctcaacatcacgtcacgccctaccaccgtagtaattacgtttcgcttagttactagtttacttcgtaactaacgtacgtacgtatagtacgtttcggaccgtaccgtaccgttaaccggtttcgggaccgggtaacgggtaaccgtagggttacggaacgaacgtaaccgaaaccggttacgtaggtacggtacgtcggtaaccacggtacttacgtgttacccg

SEQ ID NO: 240604 - DNA, 573 bp, Homo sapiens
  misc_feature: GYAE6OF02IRETH.45.35.D02.1.454.CMB.1.raw
  modified_base (202)..(202): a, c, t, g, unknown or other
  misc_feature (202)..(202): n is a, c, g, or t
  modified_base (322)..(322): a, c, t, g, unknown or other
  misc_feature (322)..(322): n is a, c, g, or t
  modified_base (357)..(357): a, c, t, g, unknown or other
  misc_feature (357)..(357): n is a, c, g, or t
  modified_base (424)..(424): a, c, t, g, unknown or other
  misc_feature (424)..(424): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccatttctgtctctctctccagggganacagccaccctctcatgcagggccagtcagagtattagaacatactggcctgtatcaatacaagctggccaggtcccgctctcatctatgatgctccagcgaggccactgacactcccanccgacgttcagttcgggcggttgggtttggactanacgtacttcactcgcacaatcagcacgcctccaacgtacgaagtagtttgcacgttcttattacgtntactaacacgtacgtaactagtaacttggccgtcctacgttaaccgtttcggacgggtacggggaaccgtaagggtacgtaacggtaacaaccggtaaaacgtaactcggttacggacgtacgtaccaccgtaactcgtactttacccg

SEQ ID NO: 240605 - DNA, 714 bp, Homo sapiens
  misc_feature: GYAE6OF02HN6RO.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctcatgcacgggccagtcagagtatagaactatactgcctggtatcaatacaagcctggccgagggtccccgctcctcatctatgatgcttccagccgagggccacgtggccactccccagcccgtaggttccagggttcggggtacgggttggggtttcggaccaggtacgtactttccgacttcctacaactaactcgagaccacgtaccctacctaaccgtagtaaacgttattttacggactacggtttacttaattaccgttacgtaaccgaacgtaccgtacgtaaccgtaggtaacgttccgggtacccgtaccgttaccgttaacccggttttaccggggaccggggttaaacgggggtacccggtaaacgggggttacgggtaacggttaaccgtaaacccggtaaaaaccggtaacggttacggggttaacgggtacccggtacggtacccgtaaacccgttaacgtttacccggttacggtttaacccg

SEQ ID NO: 240606 - DNA, 681 bp, Homo sapiens
  misc_feature: GYAE6OF02I9TUU.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggagacagcccaccctctcatgcgaggccagtcagatatagaacatacgtgcctggtatacaatacaagcctggccgtacgggtcccccggtctcccgtcaacttctagtgtagtcgtccttaccgaggcgtacgggccctaacgtggccaacctcccgacgcccgtaggttccgtaagggtcgggtacggggttggggtttcggaccgtacgtacgtacctttcgaactccgttaccaactaacgtaccgacgaccaaccgtcccctacccgaaccgttagtaaacgtttacgttttcgacgttaaccgttactttaacgttacgttacgttacaacgtacggtaccgttactaaggtacgttccggaccgtcttaccgttacggttccgggacgggtacgggaaccggtagggtacggaaggtaaccgtaacgaaacgtagtggtacggacgtcgacctccgtaagttccgtaggttaccc

SEQ ID NO: 240607 - DNA, 697 bp, Homo sapiens
  misc_feature: GYAE6OF02FIYGT.45.35.D02.1.454.CMB.1.raw
  modified_base (202)..(202): a, c, t, g, unknown or other
  misc_feature (202)..(202): n is a, c, g, or t
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatcgcagggccagtcagagtattagacatacttggctggancaatacaagctgccacgggtccccgctcctnatctatgatgcttcgagcacgggccagtggcctacgtcccgagtcctaggttccagggttgggtccgggtttgggggtttcgaccgtacgacgtacctttcgaacttcctacgaacctaataccgagccgtaccgaccctacccgaaaccgttagtaaacgttacgttttacgacgttaagttaccttaactttacgttacgtaactaaaccgttacggtaccgttaaccgaaggttaccgtttacgggtcccggttacctttaccgtaaccgtttttccggggaaccgggtaaccgggggttaacccgtaacggggttaggaaccggttaacgtaacccggtaaaaccggtaaccgttacggtacggtaccgttcgtaaccgaccctacgttccgttacgttacccg

SEQ ID NO: 240608 - DNA, 709 bp, Homo sapiens
  misc_feature: GYAE6OF02FWCFT.45.35.D02.1.454.CMB.1.raw
  modified_base (203)..(203): a, c, t, g, unknown or other
  misc_feature (203)..(203): n is a, c, g, or t
  modified_base (691)..(691): a, c, t, g, unknown or other
  misc_feature (691)..(691): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagaccctccggagaaattgtcttgacacagtcctccagccattctgtctctctctccgagggganacagcccaccctctcatcgcgagggccaggtcagagttaattagaactattacttcggacctggttataccaaattacaaacggtcctgggaccccgtacggggtccccccggcttacccctacgtacttacctatcggtagttccggcctttacccgaggccggaacgggtccctaacgtcggacctaccgtcccgacggtcccgtaggtttcgacggtgggtcggggttgggttcggctaacgacgtacgttctacctctaccgaactactcgacgacaccgtaccctaccgtaactacggaacgttactttacggcttaagttacttaactttacgtcgtaaaccgtacgtacgtaccgtacgtagttacgtccggaccgtaccttcggtactttaccggggaggtaccgggtaacgaacgggttgggacgtaaccgaacgttaaacggtacccgtggttaccggtacctcggtaacccgttacnccgttacgttgttacccg

SEQ ID NO: 240609 - DNA, 682 bp, Homo sapiens
  misc_feature: GYAE6OF02I4N76.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagcccccagctcagcttctcttcctcctgctactctggctcccagagacctccggagaaattgtcttgacacagtctccagccattctgtctctctctccagggganacagccaccctctcatgcagggccagtcagagtatagacatacgtgcctgtatcaatacaagcctggccctacgggtcccccggctcctctatctagtgactcgtccttaccgagccgagggcccacgtcgccactcccgagtcccgtaggttccgacgggttggggtccgggttggggtttggacctaacggtaacgtacttacctaaccgttcctaacaactaacgtcaacgcgtaaccgaccctacccgaaccgtagtaaacgtttacctttacggaccttaacgttaacgttactttaaccgtactaccgtaaactaccggtacgttaacaaggtaccgttcggacccgtcttacccggtaacggtttccggggacgggtaaaccgggtaccggtagggttaggaacggaacttaaaccggaaaccgtaaccgtcggtacggtcctacggacctaaccgacgttaccttcgttacc

SEQ ID NO: 240610 - DNA, 828 bp, Homo sapiens
  misc_feature: GYAE6OF02IT39T.45.35.D02.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagcctccggagaaattgtcttgacacagtctccagccattctgtctctctctccgagggganacacgcccaccctctacatcgcagggccagtcagagtattagaactatactcggcctagtactacaatacagcctggccgacgggtccccgctaccnctactctatcgtatcgtacttccgagacgacgggcccacgtacggacctaacgtcccgaacggtacccgtaacggtttaccggagggtttacggggtccggggttttagggggttttcggaccgttaacgacgttaacccttccgtaaccctttccgtaacccgtaaactaacgttaccgtaacgtacccgtaacccgtaccccgttaaccccgtaaaccttacgggtaaaaccgtttacgtttttaaccggactttaacggtttaccgtttaaacgttttacccgttaacgtttaacccgtaaacgtaaccgggttaaccgttaaaccggtaacgttacggtttaccggaccccgttaacgttacccgtttaccggggtttaccggggaccgggttaaccgggggtaaccggttaagggggtaccggtaacggtaaaccgtaaaccgggtaaaaccggtcggttacgggtacggttaccgtaccggtaacccgttaacccggtacgttttaccctacggttttaacccc

SEQ ID NO: 240611 - DNA, 701 bp, Homo sapiens
  misc_feature: GYAE6OF02I2O03.45.35.D02.1.454.CMB.1.raw
  modified_base (197)..(197): a, c, t, g, unknown or other
  misc_feature (197)..(197): n is a, c, g, or t
  modified_base (200)..(200): a, c, t, g, unknown or other
  misc_feature (200)..(200): n is a, c, g, or t
  modified_base (242)..(242): a, c, t, g, unknown or other
  misc_feature (242)..(242): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctcggagaattgtcttgacacagtctcagccattctgtctctctctccgaggganacncgccacctctcatcgcgaggccagtcagtacgtattagaacntacgttggccgttggtaatacaagtacaacgtccgtggaccgtacgggtccccgcttccgactacgttctaacgtcgtacgtcgtaccttaccgagccgacggtcctacgtcggacctacgtcccgagtccgtacggttccgaggttcgggtcggttgggtttacgactacggacgtacgttccacgtctacgaactactcgagcacgtcctaccgactagacgttacgttcgacgttacgttactttacgttacgtacgtaacctaacgtccgtaacgtaaccgtaacggtaccgttccggtaccgttaccttaccggttaaccgggtttccggaaccggggtaacgggtaacccgtaggggttaacggtaacgtaaccggttaaccgtaaacggtaaccggttacggtttacggaccgttcggaacccgacgttacttacccggttctttaacccgg

SEQ ID NO: 240612 - DNA, 279 bp, Homo sapiens
  misc_feature: GYAE6OF02GDYIW.45.35.D02.1.454.CMB.1.raw
  modified_base (266)..(279): a, c, t, g, unknown or other
  misc_feature (266)..(279): n is a, c, g, or t
tcagacgcgatcgacacgaccggtgctcgatttagcacacgatagttgggtttggcacagacttcactctcacaatcagcagcctccaacctgaagatttgcagtctattactgtcaacagcgtacagattggccgctcactttcggcggagggaccaaggtggagatcaaacgaactgtggctgcaccatctgtcttcagttccttcccgcctatctagatcgactcgcgtctgacgtcgggctggactaagggcgacaagtagnnnnnnnnnnnnnn

SEQ ID NO: 240613 - DNA, 664 bp, Homo sapiens
  misc_feature: GYAE6OF02F6V7M.45.35.D02.1.454.CMB.1.raw
  modified_base (200)..(200): a, c, t, g, unknown or other
  misc_feature (200)..(200): n is a, c, g, or t
  modified_base (342)..(342): a, c, t, g, unknown or other
  misc_feature (342)..(342): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaattgtcttgacacagtctccagccattctgtctctctctccgagggganacagcccaccctctcatcgcgacgggccagtcagagtatagaactatacttggcctggtatcaatacaagcctaggccgacgggtccccgctcctcatactatgactgtccttccgagcgacgggcctacgtcggacctacncccacgccgtaggttcgaggtcgggtcggttggggtttcggactacgacgtaccttaccgtacgtcctactaacacgtacgacgtccgacgtccccttacccgaaaccgtacgtaaacgttacttttacgacttacgttactttacgttacgttacgtaactaacgtacgtaccgtaacgtaggtacgttacggtacctcgttaccgttaccggttacgggacgggtaacgggtaccgtaagggtacggtaacggtaacgtaaaccgtaaacgtaacggttggtacggtacgttacggacctaccgtacgttcgtagttccg

SEQ ID NO: 240614 - DNA, 511 bp, Homo sapiens
  misc_feature: GYAE6OF02GXR2F.45.35.D02.1.454.CMB.1.raw
  modified_base (201)..(201): a, c, t, g, unknown or other
  misc_feature (201)..(201): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgccttccagcagggccacgtggcatcccagccaggttcagtggcggtggtttgcacagacttcactctacacatcagcacgcctaccaacctgaagtatttcgctagtctattactgtcaacngacgtanagtagtcggccnctcgtacgtttcggcggacgggtaccagggtcgagatacgaaacgacgtggagctgccaccntctntcc

SEQ ID NO: 240615 - DNA, 636 bp, Homo sapiens
  misc_feature: GYAE6OF02JKT2U.45.35.D02.1.454.CMB.1.raw
  modified_base (384)..(384): a, c, t, g, unknown or other
  misc_feature (384)..(384): n is a, c, g, or t
  modified_base (401)..(401): a, c, t, g, unknown or other
  misc_feature (401)..(401): n is a, c, g, or t
tcagacgcgatcgacacgaccggtgctcgatttagcacacgatagttgggtttgggggaggaactactcagttaggacccagagggaaccatggaagccccagctcagcttctcttcctcctgctactctggctcccagagacctccggaaaaattgtgttgacacagtctccaggcaccctgtctctgtctccgaggggagacacgcccaccctcctcctgcgagggccaggtaggagtcgtcagtaagttacttaggctggtaaccacaacgaaacctggaccaggcctcccgaggcctcctcatctatggtctcgttcctcgacgggtcctacgtggtactcccgagcccgtaaggttcaggtggactagggtcgggtacnggactacgtcgtttacnctacacgtactacaacgcgcctcgtacgtactagaagttattttcgacgttagttttactcgtacgtactaacctagtattaacgtaggtccgtccgtacggtggtacgtccggtaacgaaggtaccgtaagggtacgaaataccgtaaacgtacgtaggtagtcggcactacgtactcgttcttacgtacctaccgttccgtacccgaccgtacttacgcggtacttccgtacg

SEQ ID NO: 240616 - DNA, 678 bp, Homo sapiens
  misc_feature: GYAE6OF02JMKB5.45.35.D02.1.454.CMB.1.raw
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (451)..(451): a, c, t, g, unknown or other
  misc_feature (451)..(451): n is a, c, g, or t
  modified_base (489)..(489): a, c, t, g, unknown or other
  misc_feature (489)..(489): n is a, c, g, or t
  modified_base (675)..(675): a, c, t, g, unknown or other
  misc_feature (675)..(675): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagaccctccgagaaattgtcttgacacagtctccagccattctgtctctctctccgagggganacncgccaccctctcatgcagggccagtcagagtattagaactatacgttggccttaggtactacaaatacgaaacgtccgtacggccgtacggggtcccccgtcttaccctcacgttcctattacggattccggccttccgaagtccgaaccgggtccacgtaggacctactccccgagcccgtaggttcacgggtcggcgggttgggtttagacccagtacgtcttacgtacttctacacgtacacgngtaccacgtaccctacgaacgttgaacgttagtttccntaacgttctttactaccgttagccaaacgtggaacttaacgagttacggtccggcccttacttacgtacccggtttcggggaacgacggggtaacccgtaaggggtcgaacgtaacccgttaaaggaaaacccggttggtacgggtttcggacgttcggtaaccaccggtttacttacggttttcnccg

SEQ ID NO: 240617 - DNA, 817 bp, Homo sapiens
  misc_feature: GYAE6OF02IIRPK.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctcagccattctgtctctctctccgagggacgacagccaccctctcatgcgacgggcccagtaccgaggtacgtattaacggaactagttacttcggccgttagtatacaaattacgaacgccgtacggccgtaacgggtcccccggtacttcccgtactacgttcttaacgtacgtacgttcggtaccctttaccgacggaccgtaaccggggtaccctacggttcgggacctaacccttccccgaaacgggttacccgttacggtttaccgtaggggtttccggggttccgggtttacggggggttttaccgaaccgtacgtaaggttaccccttttacgaacccgtttccgtaacgactaaacgtcgtacgaccgtaccgtaccctacccggtaaccgtagtaaacgttagtttccgacgtcgtttaacctttaagtccgttacgtaacctacgtaaccggttaccttaacgaaacggttcgtaccgggtacccgtaccgtacgttttacccggttacgggaccggggttaacggtaccggttaacgggagggttaaccgaacggttaacccgaaaacgggttacccgtttcgggtagtacccggttaccggccgttaaaccgtgtttcccgttagtttaccccg

SEQ ID NO: 240618 - DNA, 606 bp, Homo sapiens
  misc_feature: GYAE6OF02FVJFE.45.35.D02.1.454.CMB.1.raw
  modified_base (200)..(200): a, c, t, g, unknown or other
  misc_feature (200)..(200): n is a, c, g, or t
  modified_base (257)..(257): a, c, t, g, unknown or other
  misc_feature (257)..(257): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatcgcagggccagtcagagtattagaacatactggcctggtancaatacaagcctggccacgggtccccggctcctcatctatgatcgtcttccgagtcacgggccacgtggccactcccagcctaggttcaggtggcggtgggtttcggcagagtactcgactctacacaatcagcacgccctaccaacgtacgaagtactttcgactagttacttatttacgtgtaactaacgacgtacgtaacacggtagttccgggccgtacttccgtaccgtttaccgggacggggtaacgggacccgtaagggtacgggaagtaacgtaaccgtaaaacggtaaccgtggtaccggacgttacggaacccgtaccgacgttaccttaggttaaccc

SEQ ID NO: 240619 - DNA, 643 bp, Homo sapiens
  misc_feature: GYAE6OF02IKFW3.45.35.D02.1.454.CMB.1.raw
  modified_base (201)..(201): a, c, t, g, unknown or other
  misc_feature (201)..(201): n is a, c, g, or t
  modified_base (283)..(283): a, c, t, g, unknown or other
  misc_feature (283)..(283): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctcagccattctgtctctctctccgagggganacagccaccctctcatgcagggccagtcaggagtattagaacatacgtgcctgtatacaatacagcctcggcaggtccccgntcctgatctaactgtatcgtccttacgagcaggccagtcggcacgtccagccagttcgacgtgggcggttgggttcggacagtactcgtacgactccgtacataacgtcagtcaccgccctaccaacgttagtaagtacttttcggacttacggtttcttaaacgtttccgacgttaaccgaaccgtacgtaaccggtttaaccgacgttacgtttccggacccgtaccgtttaccgttaaccgggtttacggacggggtaacggtaaccgtagggtacggtacgtagtaacccgaaacggttaacccgtggtttacggaccttacggaccgtaaccgtacgtttcccgtagtttacccg

SEQ ID NO: 240620 - DNA, 831 bp, Homo sapiens
  misc_feature: GYAE6OF02HH6H4.45.35.D02.1.454.CMB.1.raw
  modified_base (187)..(187): a, c, t, g, unknown or other
  misc_feature (187)..(187): n is a, c, g, or t
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (779)..(779): a, c, t, g, unknown or other
  misc_feature (779)..(779): n is a, c, g, or t
tcagacgcgatcgacacgaccggtgctcgatttagcacacgatagttggggtttgggggaggaactgctcagttaggacccagagggaaccatggaagccccagctcagcttctcttcctcctgctactctcggctcccagacgaccttccggaagaagttgtcttgacacagtctccagccattcngtctctctctcgagggnacgngcccacctctcatcgcgacgggccagtcaagtacgttaattagaaactgttaacgtggtaccgttggtaacttacaaacgttaacaacggtccgtaccggacccggtaccggggtcccccggtccttccctacctaagttccgtaagtcggtatcgtaccgttccaggtccggtacgggcccgtaagttcggacctaacgtacccgtacggtaccgtaggttacccaggggttcgggtcggggtttggggtttaccggacgtaaacggtacgttaccttacccgtacgttaccctaccgtaactaacgtccgaacgccgtaaccggttacccctaaacccgtaaccgttaacggtaacgtttaaacggttttccgaaacgttaccggtttaactttacggtttaacctacggtttaaccctaaactaaccggttacgtaacgtaacgttcggttaaccggcccgttaacctaccgtttaaccggttaggggccggggtaacggtaaccgggtaacggggtacgggtaacgtaaccgtaaaccgggtaaccggtaaacggtttacccggggngttaaccgtccgggtaaccgttaaccgtacgttcccgttacggtttaacccg

SEQ ID NO: 240621 - DNA, 682 bp, Homo sapiens
  misc_feature: GYAE6OF02I390Z.45.35.D02.1.454.CMB.1.raw
  modified_base (204)..(204): a, c, t, g, unknown or other
  misc_feature (204)..(204): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctccagagacctcggaagaaattgtcttgacacagtctccagccattctgtcctctctctcgagggacacncgccacctctcatcgcacgggccagtcagacgtatacgaactatacgttcggcctaggtatacaatacaacgcctggaccgacgggtccccgtctcctacacgtctacgtacgtactcgtccttacgcggaccgacggacctacgtacgcctagtaccccgagtaccgtacgtcgacggttcggtacgggtttacgggtcggactacgtacggtactttaccgtaccttctacctaacgtacgtccgtaacgaccgtacgtaccctaccgtaaaccgtacgttaagttactttacggaccttaacgttacttacgttaccgttagtaaccgaacgtacggtaacgttacgtacgttacgttacgtcccggtacttccgttccggttacggacgggtacgggtaacggtacggtaggaacctaaggaccgaaacggtaacgtcggttagacgttacgactacgtactacgtagttaccg

SEQ ID NO: 240622 - DNA, 291 bp, Homo sapiens
  misc_feature: GYAE6OF02JTPOE.45.35.D02.1.454.CMB.1.raw
  modified_base (213)..(213): a, c, t, g, unknown or other
  misc_feature (213)..(213): n is a, c, g, or t
  modified_base (220)..(220): a, c, t, g, unknown or other
  misc_feature (220)..(220): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (267)..(271): a, c, t, g, unknown or other
  misc_feature (267)..(271): n is a, c, g, or t
  modified_base (273)..(282): a, c, t, g, unknown or other
  misc_feature (273)..(282): n is a, c, g, or t
  modified_base (284)..(291): a, c, t, g, unknown or other
  misc_feature (284)..(291): n is a, c, g, or t
tcagacgcgatcgacacgaccggtgctcgatttagcacacgatagttgggtttggtcacagacttcactctcacaatcagcagcctccaacctgaacgatttgcagtctattactgtcaacagctacagattacggcgctcacctttcggcggagggacccaaggtggagatacgaaacgaactgtggctgcaccatctgtcttcgatctccnccatctnatcgtatcgcgtctgacgtcggacttggacaagggcncgatgnctannnnncnnnnnnnnnnannnnnnnn

SEQ ID NO: 240623 - DNA, 972 bp, Homo sapiens
  misc_feature: GYAE6OF02JDPJN.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttggggaggaactgctcagttaggacccagagggaaccatgggaagccccagctcagcttctcttcctcctgctactctggctcccagagacctccggagaaattgtcttgacacagtctccagccattctgtctctctctccgagggganacagcccaccctctacatcgcgacgggccagttcgaagtagttaattaacggaaacattaaccgttcggaccgttagggtataacgtaataacgtaaggcccgtacggaccgtaccggggtcccccggacttcccgtacacttcgtaatcgtacgtcgtacctttccgaaggtccgtaacggggtccctaacggtcgggtacctaacgtaccccgtaacggccggtaacggtttaccgaacggggtttcgggggtaccgggggtttaggggtttttaccgggaaccgtaaaccgggttaaacgttaacccgttttacccggaaacccgtttaccttaacccggaaactaaaccgttaacccggaacggtaacccgtaacccggttaacccccgttaaacccgttaaacccgggtttaaaggtaaaaccggtttaacgtttttaccgaacggtttaaaccggtttaacttttacgtttaaaacccgttacggttaaacccgtaaaaccggttaccggttaaacccgggttaaactaaccgggtttacggttaccccgggttacccggttaccgtttaacccgggtttaaaccgggttttacccggggaaaccgggggttaacccggggtaaaccggttaacgggggttaacgggttaaccggttaaaccggttaaacccgggtaaaaaccgggtttaaccggtaggggttaacccggttaccgtacggtaaccttaacccgggttactttacccggtttacgtttaacccg

SEQ ID NO: 240624 - DNA, 739 bp, Homo sapiens
  misc_feature: GYAE6OF02INVBR.45.35.D02.1.454.CMB.1.raw
  modified_base (206)..(206): a, c, t, g, unknown or other
  misc_feature (206)..(206): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccagagcctccggagaaattgtccttgacacagtcctccagccattctgtctctctctccgagggacacncgcccacccgtctcagtgccgacgggtccagtcaagagtacttagaactagttacgttggcctggtactcgaatacagccgtcggaccgacgggtccccgactcctcgactctactgacttcgaccttccgacgcgacggcctacgtcggacctactcccgacgtccgtacggttacgaggtcgggaccgggttcgggtttacggacgtaacgtacgtacctttacgaccgttaccgtacgaaccgtaacgtaccgaacgaccgtaaccggtccccttacccgtaaccgttacgtaaacggttacgttttaggaccgttaacggttacgtttaaccgtttaacgtacggttaaccaaacggtccggttaaccgaccgtaggtaccgtttacgggacccgttacgttacccgttacggtttccggaaccgggtacgggtaaccgtagggtccggaaggtaacgtaccggaaaccggtaacgttcggtacggtacgtacggtacccgtaacctacggttaccttacggttacccg

SEQ ID NO: 240625 - DNA, 777 bp, Homo sapiens
  misc_feature: GYAE6OF02FZL1O.45.35.D02.1.454.CMB.1.raw
  modified_base (176)..(176): a, c, t, g, unknown or other
  misc_feature (176)..(176): n is a, c, g, or t
  modified_base (194)..(194): a, c, t, g, unknown or other
  misc_feature (194)..(194): n is a, c, g, or t
tcagacgcgatcgacacgaccggtgctcgatttagcacacgatagttgggttggggaggaactgctcagttaggacccagagggaaccatggaagccccagctcagcttctctcctctgctactctggctcccagagacctcggagaattgtcttgacacagtctccagccattcngtctctctctcgaggganacgtagcctaccctgtctacgtggcagggccaggtccagtagtacttagacgtattacgtcggcctggtactacgaagtactaagccttggaccgtacgggtccccggtctacctctacgttctactacgtatcgtccttcgacgtcgacgggccagtcggctacgtcccagtaccgtacggttcgaaggtcgggtcggttggggtttacgccgtacgtacgtaccgttacgacgtccgtaacgaaccgttaacgtaccgtaacggtaccgtaccgaccctttacccggtaaacccgtacggttaaacggttaacgttttaccggaaccgttaacgttaccgttacgtttaacgtaccgttaaccgaacgtaacgtaccggtttaacctaagggttaccgttaacgggacccgttaccgttaaccgggttaacccgtttacgggaaccggggtaacggttaaccgtaacgggggttcggtaaccggtaacggtttaaacccgggaaacggttaaccgttacggggtacggtaccttcgggaacccttaaccggttaccgtttacggttaccggtttaacccgg

SEQ ID NO: 240626 - DNA, 781 bp, Homo sapiens
  misc_feature: GYAE6OF02H20N9.45.35.D02.1.454.CMB.1.raw
  modified_base (202)..(202): a, c, t, g, unknown or other
  misc_feature (202)..(202): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (698)..(698): a, c, t, g, unknown or other
  misc_feature (698)..(698): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccatttctgtctctctctccgagggganacagcccacctctcatgcaggccagtcagtagtatagaacattactggcctgtatcaatacagtctcgcgacgggtccccgntcctcatctatcgagtcncttccagtccgacgggaccacgtcggccacgttacccgagtccgtacgttcgaggttcggggcgggtttgggtttccggacgtaaccgtacgtaacccgtttcctaacccggttctaccctaactaacgttcaaacggtccgtaaccggtcccctaacccgtaaaccggttacgtaaaaccgtttagttttaccggaaccgtttaacggttacctttaaaccgttttttaaacccgggttagtttaaccccgaaaccggtaaccggtacccgggtttaaaacgtacggttaaacggttttccccggggaaccgttaccctttaacccgggttaacccgggttttccgggaaccgggttaacgggggaaccccgttttaaggggaacccggggtaanaacgtttaaacccgggaaactaaccgttacggggtttaccgacgttcgtaacccgtaaccgttacgtcgtttacccgtttacg

SEQ ID NO: 240627 - DNA, 800 bp, Homo sapiens
  misc_feature: GYAE6OF02FZ784.45.35.D02.1.454.CMB.1.raw
  modified_base (203)..(203): a, c, t, g, unknown or other
  misc_feature (203)..(203): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagacgacctccggagaaattgtcttgacacagtctccagccattctgtctctctctccgagggganacacgccaccctctccatcgcgacgggccagtcagtacgtattaacgacacttacgttggcttggtatacaactacaacgtcctcggcctacggggtcccccgctacccgtcatcctagtacgtatcggccttaccgacgaccgaccgggaccaccggtcggacctactccccgaacggtccctaacgggttcgaacgggtttcggggtccggggtttaggggttttcggaccgtaaccgtacgggttaaccctttaccctaccgtttaccgtacctaaaaccgtaacgtaccgaaccggtacccgtaccggtacccccctttaacccgtaaacccgttagggtaaaacgtttacggttttaccgaccgttaccgttacgtttaccgttaccgttacgtaaccgaaacgttacggtaacccgttaacggagttacgtttacccgggccgttacgtttacccggtacggtttacccggggacgggtaaaccgggtaccgtagggggttaacggaaccgtaaccgtaaacgtaaaacccgggtcgttacgggtacggtaccgtaccgtaaccgtacccgtacgttccgttacgttaccc

SEQ ID NO: 240628 - DNA, 711 bp, Homo sapiens
  misc_feature: GYAE6OF02I603X.45.35.D02.1.454.CMB.1.raw
tcagacgcgatcgacacgaccggtgctcgatttagcacacgatagttgggtttggggaggaactgctcagttaggacccagagggaaccatggaagccccagctcagcttctcttcctcctgctactctggctccagagacctccggagaaattgtcttgacacagtctccagccattctgtctctctctccgagggggacacgcccaccctctcatgcgaggccagtcagtagtaattagaacatacgttggaccgtgtatcgaaatacaagcctaggccgacgggtccccggctcctcagttctatcgtatcgccttaccgagcgacgggcctacgtcggacctacgccccaggacccgtagggttcaggtcgggtacgggttggtttcgggctaacgacgtaccgtttaccaccttccgtaacaaccgtaactaccgacgtaccgtaaccgtaccccgttaaccccgtaaaccgttacggtaaacgtttaacgttttaccggacgttacgttaccttaacgttttaccgtaccggttaccaaaccgtagtacccgttaacgtagttaccgttcggacccgttccttacgttccggtttacgggaccgggtacgggtaaccgtagggtacgaagtaccgtaaccgtaaaccgtacgtaggtcgtacgtacgtacgtaaccgttacgttcccgttagttacccgttaccg

SEQ ID NO: 240629 - DNA, 672 bp, Homo sapiens
  misc_feature: GYAE6OF02FX4SK.45.35.D02.1.454.CMB.1.raw
  modified_base (204)..(204): a, c, t, g, unknown or other
  misc_feature (204)..(204): n is a, c, g, or t
tcagacgcgatcgacacgaccggtgctcgatttagcacacgatagttggggtttgggggaggaactgctcagttaggacccagagggaaccatggaagccccagctcagcttctctttcctcctgctactctggctcccagagacctccggagaaattgtcttgacacagtctccagccattctgttctctctctccagggganacagccaccctctcatcgcagggcagtcagagtatagacatcttggctgtatcaatacaagcctggccgacgggtcccccggctcctcacttctatgagtcgcttccagcgacggcacgtgctactccacgccagttacgaggtgggtcgggttggggtttggcgacgagtaccttactactctacgaactatcagtacgacgtccctaaccctaacccgtagtaaacgttaacgttttcgaacgtacgttaactttacgtttaaccttagtaaccgtaaactaacggtactaacgaaggtaaccgtttcggacccgtacttaccgtaccggttttcggggaccgggtaacggggtaacccggtaaggggttaccggtaacgggtaacttaaccggaaaaccgttaagggttaccgtaggggtacctacggacccctaaccggtaccgttaccgtttacggttacccg

SEQ ID NO: 240630 - DNA, 652 bp, Homo sapiens
  misc_feature: GYAE6OF02GPBOO.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatgcagggccagtcagagtattagaacatacttggcctggtatcaatacaagcctggccacggggtccccggctcctcactctatgatcgcttccagcgacgggccacgtcggctactcccgagtccctaggttcaggtcgggtcgggttaggggtttggacacgtagtaccttcgacttcctaccaactaatcgacgccacgtccctacccaaccgtcgtaaagtacgttttcgacgtacgttactttaactttacgttacgtaaccaaacgtacggtaccgttaactagttaacgtttcggtaccgtccgttacgttaccggtttaccgggacgggtacggggaaccgtaggggtacgggaacgtaacgtaaccgaaacggtaacgttacggtacggtacgtcggacctaaccgtacgttccgttacgttaccg

SEQ ID NO: 240631 - DNA, 598 bp, Homo sapiens
  misc_feature: GYAE6OF02HPZJ3.45.35.D02.1.454.CMB.1.raw
  modified_base (113)..(113): a, c, t, g, unknown or other
  misc_feature (113)..(113): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
tcagacgcgatcgacacgaccggtgctcgatttagcacacgatagttgggtttgggggaggaactgctcagttaggacccagagggaaccatggaagccccagctcagcttcncttcctcctgctactctggctcccagagacctccggagaaattgtcttgacacagtctcagccaattctgtctctctctccaggggacacagccaccctctcatgcagggccagtcagatatagaacatacttggctggtatcaatacaagctggccagggtccccgctcctcatctatgtatgacttccagcaggcctactggcactccgagccgagttcagtcggcggtgggtttagcgtacagtacttcacgtctanactaancacgcacgacctaccaaactcgtaaagtactttcgacgtacgttacttaattacgtacgtactaaacgacgtacgtaacaaggttacgttacggtccgtaccttcgttaacgtttccgggacgtacgggaacctacgggtacggaacgcgttaacgaaacggtaaccgtacggttaggacgttaccggaaccaccctaagtttccggtagtttaacccg

SEQ ID NO: 240632 - DNA, 754 bp, Homo sapiens
  misc_feature: GYAE6OF02JPM3H.45.35.D02.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
tcagacgcgatcgacacgaccggtgctcgatttagcacacgatagttgggtttgggggagggaactgctcagttaggacccagagggaaccatggaagccccagctcagcttctcttcctcctgctactctggctccagagacctccggagaattgtcttgacacagtctccagccattctgtctctctctccagggganacacgccacctctcatgacaggccagtcagacgtattacgaactatacgtgacctggtactcaatacaagtcctaggccgtagggttcccccgnttacctcgtaacttacgtactgaacttcggtacctttccgaacggtccgacggggaccctacgttcgggaccttaaccgtcccgacgtacccgtaggtttccgagggttcgggcgggtttagggtttcgacgacgtagtaccctttcggacctaccgtacgtaactaacgtactaacggccgtacggtacccctaccgtaaaccgttcgtaaaacggttcttttacggcctaacggtttaccttaacgttttaccgtacgttacctaaaccggtcgtaacgttaaccaacgggttacggtttaccggcccgttaccgttacccgttaccggtttccggggaaccgggtaacgggtaaccgttaggggtacgtaccgggttaaactaaccgtaaaaccgggtacgttacgggtacggtaccggttccgaaccgttacccggtaagttccgttagttacccg

SEQ ID NO: 240633 - DNA, 604 bp, Homo sapiens
  misc_feature: GYAE6OF02GI0ZO.45.35.D02.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagcccattctgtctctctctccagggganacagccaccctntcatgcagggccagtcagatattagaaacntacttggcctggtatcaatcaaagcctggccaggggtccccgctcctcatctatgactgacttccagcaggggccagtggcactccagcctaggttcagtcggcggttgggtttgcacgagaccttcgactcgtcaactacgtcagcacgtccctaccaacctgaacgttattttcgactacgttacttacttacgttcgttacaaacgtagtacgttaaaccaggtacgtttcggacccggtcttccgtacgtttaccgggacggggtaccgggaaccgacgggttgggtagtaacgtaacgaaaccggtaacgtacgggtacgtcgttacgaccgaccttacgtacgttcggttaccc

SEQ ID NO: 240634 - DNA, 271 bp, Homo sapiens
  misc_feature: GYAE6OF02F5J26.45.35.D02.1.454.CMB.1.raw
  modified_base (261)..(271): a, c, t, g, unknown or other
  misc_feature (261)..(271): n is a, c, g, or t
tcagacgcgatcgacacgaccggtgctcgatttagcacacgatagttgggtttggtgggtttggcacagacttcactctcacaatcagcagcctccaacctgaagattttgcagtctattactgtcaacagcgtacagattggccgctcactttcggcggagggaccaaggtggagatcaaacgactgtggctgcaccatctgtcttcatccttcccgcatctgatcgatcgcgtctgagcggctggcaaggcgacatagnnnnnnnnnnn

SEQ ID NO: 240635 - DNA, 830 bp, Homo sapiens
  misc_feature: GYAE6OF02FOOCQ.45.35.D02.1.454.CMB.1.raw
  modified_base (203)..(203): a, c, t, g, unknown or other
  misc_feature (203)..(203): n is a, c, g, or t
  modified_base (810)..(810): a, c, t, g, unknown or other
  misc_feature (810)..(810): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggcctcccagagacctccggagaaattgtcttgacactagtctccagccattctgtctctctctccgagggganacacgcccaccctctcaagtcgacgacgggcctaacggtaccaaggtacgttaattaaagaaactagttaaccgttgggccttaggtaatacaaaagtaccgtaaagcccgttaggccccgtaacgggggtccccccggtcttccccgtactaacgttacgtaacgtacgtacgttcggtaccttcccgaaaggccgaccgggggacccctaattcggggtaacccaaccgttaccccgaaggtacccgttaacgggttaccgtaacggggttccgggggttaacgggggtttccgggggtttttaacggacccaaccgtaaaacggtttcccggttttaacacccgtccggtttaaaaccaacgtaaccttacgaacccgtacgtaaccgtacccctaaccgtaaaccgtacgtaaacgttacgtttacgacttacgttacttactttactacgtacaaacgtacgtacgttaacgtacgttacgttccggtaccgtacgttccgttaaccggttcgggaacgggacgggtaaccgtaggggtacggaacggttaacgaaaccggtaaacggtaacgtgggttaaccgccgttaggaacccgtaanacggtttaccgttgttaccg

SEQ ID NO: 240636 - DNA, 887 bp, Homo sapiens
  misc_feature: GYAE6OF02G42WM.45.35.D02.1.454.CMB.1.raw
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggcctcccagagacctccggagtaaattgtcttgacacagtcctccagcctattctgtctctctctcgaggganacncgcctaccgtctacatcgccgacgggacctagtacaaggtaacgttaattaacgaacgtattaccgttacgggcccttagggttactactaaacgttaacgaacgtccgtacggacccgtaaccggggtcccccgtcttccctacgtactaccgttaagtcgtacgttcgtccttaccgacggccggaccgggtacctaaccggtggaccctaccgtaccccgaggtacccgttaggttacgtaggggtccggggttaccggggtttggggtttaccgacgtaaaccgtacgttaccgtttaccaccttccgtaaccaaacgttacgtacccgaacgtaccctacccgtaccccttaacccgtaaaccgttagggttaaagtttaccgttttacgaacgtttaacggtttaaccttttaaacgtttaaccggttaccgtaaacgtaaaccggtaacggttaccgttaaaacggtacggttaccggtttcccgggacccgtttccttaaccgggtttcccgggttacgggggaacccgggtaaacggggttacccgtaaacggggttcgggtaaaaccgttaaccggttaaaaacccggtaaaacggttccggttcggtaaccgggttccgttaacccggaacccttaaccggtacggttttaccgtacccgttttacccgg

SEQ ID NO: 240637 - DNA, 561 bp, Homo sapiens
  misc_feature: GYAE6OF02IU7T0.45.35.D02.1.454.CMB.1.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (329)..(329): a, c, t, g, unknown or other
  misc_feature (329)..(329): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (429)..(429): a, c, t, g, unknown or other
  misc_feature (429)..(429): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagacttatacgaacatacttggcctggtatcaatacaagcctggccacgggtcccgctcctnatctatgatcgctcagccgaggccatggacacgtcccngcctaggtcaggtgcggttggtcgcanagtctcnctctcaanatcacncacgcctaccaacgtgaacgttatttcgactattactatttacgtctaccanacgtacgtacagtacgtcggcctactacgtacgtttcgggacgggtaacgggaaccctaggggtacgagtacgtaacggtaaaccgaacgtcggttcggtactacggaccaaccgtactaccggttgttacc

SEQ ID NO: 240638 - DNA, 771 bp, Homo sapiens
  misc_feature: GYAE6OF02GY35P.45.35.D02.1.454.CMB.1.raw
  modified_base (222)..(222): a, c, t, g, unknown or other
  misc_feature (222)..(222): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtcctccagccattctgtctctctctccgagggagacacgccaccctctcatgcncggccagtcgagtagtattagaactagtacgttcggcctaggtactacaaatacaacgtcctcggccgaccggggtcccccgtctccctactacttctacgtgtactcgtccgttacacggtaccgacgggacctaccgtgggacctactacccgacgcccgttaggttaccggagggtcggggttacggggttcgggtttcggacgtaaccgtacggttaacccttaccgaccttcgtaccgtaactaacgtacgtaccgtacgtaccgtaccccgttaactacccgttaaggtaaacgtttacgtttccgtaacgttaactttaccgttaattttacccgtaggtaaccttaacggaccggttactaaccggtacgttaccggttcgtcccggtacctttacccggttaacgggtcccgggaagggttacccgggaacggttacggggtaacgtaaggtaacccggtaaccggtaaaccggtacggttacggtacggtacccgttacggaccccgttacggttacccgtttcgtacccggtttaccg

SEQ ID NO: 240639 - DNA, 542 bp, Homo sapiens
  misc_feature: GYAE6OF02IUU4G.45.35.D02.1.454.CMB.1.raw
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (286)..(286): a, c, t, g, unknown or other
  misc_feature (286)..(286): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (371)..(371): a, c, t, g, unknown or other
  misc_feature (371)..(371): n is a, c, g, or t
tcagacgcgatcgacacgaccggtgctcgatttagcacacgatagttgggtttgggggaggaactgctcagttaggacccagagggaaccaaggaagccccagctcagcttctcttcctcctgcctactctggcctcccagacgacctccggagaaatttgcttgaccacagtctccagccattctgtctctctctccagggganaccagcccaccctntcatcgcaggccagtcagagtatgaacatacgtgcctggtatcaatacaagcctgcagggtccccgntcctcatctatgatgctcagcacggccatgcatccagcagtcagtgcggttggttnctanagtctcgactccnctacgatccncncgactccacctacctagtaagtcgtttacgctagttccttattaccgtgtacaacgtacgtacgtaacacgtatcggccgtctacgtaccgttcggacggacggacgtagggtacgaagacgtaacgaaaccgtacgtgtacgtcgtactcgtaccatccgttctcttacg

SEQ ID NO: 240640 - DNA, 580 bp, Homo sapiens
  misc_feature: GYAE6OF02F2NVE.45.35.D02.1.454.CMB.1.raw
  modified_base (201)..(201): a, c, t, g, unknown or other
  misc_feature (201)..(201): n is a, c, g, or t
  modified_base (283)..(283): a, c, t, g, unknown or other
  misc_feature (283)..(283): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatactggctggtatcaatacaagcctggccacgggtccccgntccctcatctatgatcgcttccgagcgacgggccacgtggcactccgagcctaggtcaggtggcgggttgggttgcacgtagtacttcactcgtcaactatcgacgcacgcctaccaactcgtaaagtatttacgctacgttacttatacttacgtactaacacggtacgttaacgacgtacgttggaccctcgttaccgtacggtttcggacgggtaaccgggtaacgagggtaggacgtacgtaacgaacggtaacgtagtacggactacggaccaccgtattccgtagttaccg

SEQ ID NO: 240641 - DNA, 775 bp, Homo sapiens
  misc_feature: GYAE6OF02FHB8O.45.35.D02.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccaggggganacagcccaccctntcatgcagggccagtcagngtattagaactatacgttggcctggtatcgaatacaagcctaggccacggggtcccccgctcctcagtcctatgatcgcttccgagtcacggggccaacgtcgggccacgttccccagtcccgtaggttccaaggttcggggtccggggtttggggtttcggacctaacgtaacggtacctttccgaaccttccgtaccaaccgtaaacttaccgaacgtcccgaacgtcccccgttaccctaaacccgttaggaaacgtttaactttttacggacccgttaaggtttacccttaaattttaccgtacgttaaccctaaaccggtacggtaccgtttaaaccgacggttaacgtttacccgggaccccgttaactttacccggtaaccgtttttaccgggggaccggggtaaccggggaccccgttaagggggtacggtaaacggtaacgttaacccggaaaaaccgggttaaccgttagggttaaccgggaccgtttacggacccgttaaccggacgtttacccggttcttttaaccccgg

SEQ ID NO: 240642 - DNA, 263 bp, Homo sapiens
  misc_feature: GYAE6OF02FV9D1.45.35.D02.1.454.CMB.1.raw
  modified_base (253)..(263): a, c, t, g, unknown or other
  misc_feature (253)..(263): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgccatctgatcgatcgcgtctgagcgggctggcaaggcgcatagnnnnnnnnnnn

SEQ ID NO: 240643 - DNA, 756 bp, Homo sapiens
  misc_feature: GYAE6OF02H2DR8.45.35.D02.1.454.CMB.1.raw
  modified_base (328)..(328): a, c, t, g, unknown or other
  misc_feature (328)..(328): n is a, c, g, or t
  modified_base (373)..(373): a, c, t, g, unknown or other
  misc_feature (373)..(373): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccaccctgtctttgtttccaggggaaagagccaccctctcctgcagggccagtcgagggtgttaacagctacttagccttaggtaaccaaacaaaaacctggaccaggcctcccagacctcctactatttatggttcttactaccgacgggccncttggtactcccagccgtaggttcagtacgcctaggtcgggtcgngggacaggtcgttcactctacaccactacacgtcgaacgtccgtacgaccttacgtcgtacgtaagttacgttttcgtacgttacgttttaatttcgttagttacgtacgtacgtaccggtaccggttccgtacccgtaccggtaccgtacccgttacccgttaccgggtttcccgggggtaccgggggggtacccggtacgggggtaccgggtaagggtaacggtacggtaacgggtaaccgggtaaacggttcggttacgggaccgttacggacccgtaccgtaccggtttaccgttacggttcccgtttaaccgttacccgtttacccgtttacccccgttacccgttaccgtttacccttcggttaaccgttaccccgg

SEQ ID NO: 240644 - DNA, 643 bp, Homo sapiens
  misc_feature: GYAE6OF02G9NW8.45.35.D02.1.454.CMB.1.raw
  modified_base (202)..(202): a, c, t, g, unknown or other
  misc_feature (202)..(202): n is a, c, g, or t
  modified_base (497)..(497): a, c, t, g, unknown or other
  misc_feature (497)..(497): n is a, c, g, or t
tcagacgcgatcgacacgaccggtgctcgatttagcacacgatagttgggtttggggggaggaactgctcagttaggacccagagggaaccatggaagccccagctcagcttctcttcctcctgctactctggctccagagacctccggagaaattgtcttgacacagtctccagccattctgtctctctctccgagggganacaggcccacctctcatgcagggccagtcagtagtattaagaacatacgtcggcctggtatacaaatacaagcctacggacccgtacggggtcccccgcttccactactctaacgtcgaacttcggacctttccgaggccgaacggggccctaacggtcgggacctacgtccccgaaggtacccgtacggttacgacgggtcggggtcggggtttgggggtttcgacgtacgtacggttacttccgacttccgtacaactaatccgagaccaccgtcctaccaacgtgtaacgtntttacgacgtagttacttagttactcgtaactacgactacgtacgagtacgttcgactctaccgtcgttacggacgggacgtacgtacggtggaacgtacgtaacgaacgtacgtgggtacgcgtcgaccacgtagtctcgttacc

SEQ ID NO: 240645 - DNA, 750 bp, Homo sapiens
  misc_feature: GYAE6OF02G7M96.45.35.D02.1.454.CMB.1.raw
  modified_base (192)..(192): a, c, t, g, unknown or other
  misc_feature (192)..(192): n is a, c, g, or t
  modified_base (397)..(397): a, c, t, g, unknown or other
  misc_feature (397)..(397): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctcncgagggacacacgcccaccctctacagtcgccgacgggcctagtcgagacgttataacgaactattacgttcggaccttacggtaattacaactaaccgaacgtaccgtacgggccggtaacccggggtccccccggtccgttaccccttaccgtaccttacttaacgtcgtacgtcgtccttaccggacggaccgacgggaccnccgtcgggactaccgtccacggtccgaggttaccgaggtcgggtcggggttacgggtttcggacgtacgacgtaccttacgtaccgttcctaacgaacgtacctacgccgtaccgtaccgtaccccctaaccgttaaacccgaggtttaaacgttacgttttacggccttacgttactttacttacgtaacgtaccgtaacgtacggtaccgtaacgtacggtttcgcggttaccgtaccgtttaccgtacgggtttcggggaacgtacgggtaacgtacgggtacggtacggacgttaaacgtaacgtacggtagtccggtacgcgtaccgacgtcctgttaccgttacccg

SEQ ID NO: 240646 - DNA, 862 bp, Homo sapiens
  misc_feature: GYAE6OF02H7FHU.45.35.D02.1.454.CMB.1.raw
  modified_base (114)..(114): a, c, t, g, unknown or other
  misc_feature (114)..(114): n is a, c, g, or t
tcagacgcgatcgacacgaccggtgctcgatttagcacacgatagttgggtttgggggaggaactgctcagttaggacccagagggaaccatggaagccccagctcagcttctnttcctcctgctactctggctcccagagaccctccggagaaattcggtacttcggaactactaggtctccctaaggcccatttcgtcggttcctctcttccttcccaggggggtacaccagacccgacccttcgttccaacttcggcgaacgggtcccagttccaggagttaacgtttaacgaacgaacttaccgttacgggcccttagggtaacgttacgaaacttaccgaaagtccccgttagggaccccgtaacgggggtccccccggtacttaccccgtacgtaacgtccgttaagtacggtaaccgttcggtacccttttcccgaacggccgtaccggggacccgtaaccgtcgggtaccttaacgccccgtaacgggccccgttaaggtttcccgaaaggttcggggttccgggtttacgggggttttacggaccctaaccggtaggtacctttaccggacgttaccttacgaacgtaacttaccgaacgtaccaacggtacccctaccgtaacctacgaacgttacgttttacgacgtacgttacgttaattacgtacgtacgaactaggtaccgttaaacgacgtacgttaccgacccgttacgttaccgttaaccggttcgggaccgggtaacggggtaaccgtacggggttacgaacggtacgtaaccggtaaaacgtaccgttacggttacggtaaccgttagacccgtaaaccgacgtttacccgtgttaaccccgg

SEQ ID NO: 240647 - DNA, 677 bp, Homo sapiens
  misc_feature: GYAE6OF02F3PFL.45.35.D02.1.454.CMB.1.raw
  modified_base (201)..(201): a, c, t, g, unknown or other
  misc_feature (201)..(201): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcgatgcagggaccagtcagagtatagaacatacgttgcctggtatacaatacaagcctggccgagggtcccggctcctcatctatgaatcgcttccgacgtcgacgggaccacgtggactactacccgagcccgtaggttacgaggtcgggcgggttcggggttttgggactaacggacgtaccgtttacgtcctacgttacgactaactacacggactacgcccttacccgaacccgttaagaagttactttacgcgttaacgttactaactttacgagttaaccctaacgaacggtactaaccgtaaggttaccgttacggggaccgtaccttaccgttaaccggtttccggggacgggtaaccggggtaccgaacggggtagggtaaccgtaacgtaaccgtaaaacggtaaccggtaggtacggtacctacggaccaacctggttaccttgtttaaccc

SEQ ID NO: 240648 - DNA, 765 bp, Homo sapiens
  misc_feature: GYAE6OF02FVZME.45.35.D02.1.454.CMB.1.raw
  modified_base (214)..(214): a, c, t, g, unknown or other
  misc_feature (214)..(214): n is a, c, g, or t
  modified_base (352)..(352): a, c, t, g, unknown or other
  misc_feature (352)..(352): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgaggggtacacagccaccctntcatgcagggcctagtcagagttattagaactagtacttggccttggtaatcaatacgaagccgtggcccgaacgggtcccccgcttcccgtctactcctatggactcgtccttccgagcgacgggccacggtgaccncgtcccagcctaggttcaggtcgtacgggttgggttcggctaacgacttaccgttcgaccttacctaccgaaactaatccgaacgggcctaacgtcccctaacccgtaaacccgttaggttaaacgtttcgttttaccggaccgttaagtttaccttaacgttttacgtaccggtttaacctaaaccggtaccgttaacgggttaaccgtaaggttacggtttacccggggaccctttaacggtccggtttaaaccccggttttcgggggaacccgggtaaccggggttaaccgtaacgggggttaccggggtaacgaacggtttaaaccccggaaacggttaaccgggtttcggtacccggtaccgtaacgggtacccaaccgttaccgtttaccgttaccggttttaaccc

SEQ ID NO: 240649 - DNA, 763 bp, Homo sapiens
  misc_feature: GYAE6OF02JB26F.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttgggggaggactgctcagttaggacccagagggaaccatggaagccccagctcagcttctcttcctcctgctactctggcctcccagagacctccggagaattgtcttgacacagtctccagccattctgtctctctctccgaggganacacgccacctctcatgacgaggccagtcagtagtataagaactagttacgttcggaccgtgttactacgtaactacgaagtccgtacggaccgaaccgggttcccccggactccgttctacttaccgtagtcgtacgtcgtccttaccgagtacgacggtaccaacggtcggtacctacgttaccccgacgtaccgtacggttaccgtaacgggtcggggttaccggggtttcgggtttacggaaccgtaacggtaacgtaacctttcgtaccgtccttaacgacgttaactacgaacgtaccgaaccgtccccttaaccgtaaaccttttaaggtaccgtttacgtaccgttaagtttaccttaacgtttaccttacgtaaccctaacgtacgtaaccgttaacgtacggttacttaccgggtaccctccgttaccgttaccggtttccggggaaacggtaaccggtacgtagggtaacggaaccgtacggtaaacccggtaacggtacgttacggtaccgtacgaaccgttaccaaccggttatccttcgttaccttacg

SEQ ID NO: 240650 - DNA, 613 bp, Homo sapiens
  misc_feature: GYAE6OF02FMLU9.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatcgcagggccagtcagagtattagaactatactggctggtatcaatacaagcctggccgacgggtccccgctcctcatctatgatcgtccttccgaggccgacgggccctacgtcgggcctacctccccgaggtcccgtaggttccgagggtcggggtcgggttggggtttcgctacgtagtacctttacgacttcaccactaatcgacgctacgtccctacctaacctagtaagttagtttcgctagttctattacttgaactaacgacgtacgtaacagttacgtcggcctactccgtacgttacgggcgggtacgggtacgtagggtggaacgtaactaaccggaaacggtacgtggtacggacgttcggacctacgcgttaccgtgttacc

SEQ ID NO: 240651 - DNA, 723 bp, Homo sapiens
  misc_feature: GYAE6OF02HU6WF.45.35.D02.1.454.CMB.1.raw
  modified_base (202)..(202): a, c, t, g, unknown or other
  misc_feature (202)..(202): n is a, c, g, or t
  modified_base (364)..(364): a, c, t, g, unknown or other
  misc_feature (364)..(364): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaacttgtcttggacacagtctccagccattctgtctctctctcgagggancacgccaccctctcatgcgacgggtccagtcgagagtaattagaactattactggcctggtatcaaatacagcctggaccgcgggtcccgtcctctcatctatgtatcgtcctcgacgccgacgggccacgcgacaccgtccgacgaccgtacggttacggnggtacgggtcgggtttgggtttacggccaagtcgtacctcgtacgttcctactaccgtatacgcgacctaccgaccttaacccgtaaccctagggttaaacgttacttttacggaacttacgtttaaccgtttaacttcgttaacgttaaccaacggttaccgtaccgttaacggtacgtaccggtttacggaccccgtttccgttaccgttttcccgggtttaaccggaccgggggtaacggtaaccggggtacggggttacggtaacgaacttaaacccgggtaaacggttaccggttagggttaccggtacctaaccggtcccgtaaaccgttacgtttccggttacggttacccc

SEQ ID NO: 240652 - DNA, 673 bp, Homo sapiens
  misc_feature: GYAE6OF02G2CO7.45.35.D02.1.454.CMB.1.raw
  modified_base (316)..(316): a, c, t, g, unknown or other
  misc_feature (316)..(316): n is a, c, g, or t
tcagacgcgatcgacacgaccggtgctcgatttagcacacgatagttggggtttgggggaggaactgctcagttaggacccagagggaaccatggaagccccagctcagcttctcttcctcctgctactctggcctcccagagacctccggaagtaaattgtcttgacacagtctccagccattctgtctctctccgtccgaggggacacagccctaccctctcatgcgagggccagtcagtagtattagaactagtacgttcggctaggtatactaatacgaacgtcgcggtaccgacgggtccccgacttcctntacgtactagtagatcggtacttaccgacgtacggacggttcccgaacgttcgggacctacctacccggaagcccgttaaggtcgaagggtcgggtcgggttagggttcgaacgtacgtagtaccttcgactcgaccgttacaacgtcaacgcgtacgtcctacctaaccgtgtaacgttacgtttacgacttacggtacttacttacgtacggttacaagttacgactacgtagtacgtacgcgtactccgtacgttacggaccggaggtaccgtagggacgtaagtaccgtaaacgaaccggtaagtacggtaccgtacgttacggacctaccggtacttacggttacgttaccg

SEQ ID NO: 240653 - DNA, 679 bp, Homo sapiens
  misc_feature: GYAE6OF02G2OS0.45.35.D02.1.454.CMB.1.raw
  modified_base (204)..(204): a, c, t, g, unknown or other
  misc_feature (204)..(204): n is a, c, g, or t
  modified_base (449)..(449): a, c, t, g, unknown or other
  misc_feature (449)..(449): n is a, c, g, or t
  modified_base (478)..(478): a, c, t, g, unknown or other
  misc_feature (478)..(478): n is a, c, g, or t
tcagacgcgatcgacacgaccggtgctcgatttagcacacgatagttgggtttggggaggaactgctcagttaggacccagagggaaccatggaagccccagcgcggcttctcttcctcctgctactgtggctcccagatacctctggagaaatagtgatgacgcagtctccagcccaccctgtctctgtctccgagggggaancgccaccttctccgtggtacggccagtcagactataccagcaacttagcctggtactcagacaaaacctggaccaggcctccccggctccctcactctcgtggtcgcacacaccgacgggcctacgtcggtactcccacgtccgacgggttcaggtcggcgtaggtgggtcgtcggggacgtacgggtttcccgtctaccgaccgtacgtcgggaccggggtctacgtacgtcgtaggaagtttnttttcggacgttaagttttacttacgttntacgtatctaagtactctagtcggacgggtactacgttagggtttccggaccggtaacggggacctaggtacgtagggtaacgtaacgtaaccgtaaaccggtagttcgggtacggtccgtacgtaacccgtaaccgtacgttaccgtttacgttcctttaccgtcctttaccccgtaccccggttacctacgttacccgg

SEQ ID NO: 240654 - DNA, 825 bp, Homo sapiens
  misc_feature: GYAE6OF02IAKXG.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagactaccaccggaaaaattgtcgttgacacagtctccaggcaccctgtctctgtcctccgaggggacacgacggcccacccttctccgttgccgtacggggcccaggtaggacggtcgtacaacggttaaacgttacgttagggccgttacggttaacccaaacgaagtaaaacccgttgggaccctagggtcctaccccgtaggtccttaccctacgtaaccgttaacctagttacgtaacgttaccgacctaacctacccggtaaaacgtccggggttaccccgttacgggtaccccggttacccgaacggtaacccgttacgggttttccccggtacgggtccgtaacgggttcggggttacttaggggacctaacgggtacggtttaccacgttaccgttaccaccgttcgaacggccgttaacgccgttgggaccgtacttggtaacgttgttaacgttttcggacctttaaggtttctccgtgtaccaggtccacgtccgtttacccgcgtaccgaccgtacgtccgtaccgggtttccggggaccggggtaactcggggttagaacgtcggttaggaacggtccgaacggttcgtggggacctttccggacgtaaccgttaccgttcggttacccgtttcgtttaacccgtactttcccgggttcccaggtttaaccccg

SEQ ID NO: 240655 - DNA, 694 bp, Homo sapiens
  misc_feature: GYAE6OF02F13SJ.45.35.D02.1.454.CMB.1.raw
  modified_base (205)..(205): a, c, t, g, unknown or other
  misc_feature (205)..(205): n is a, c, g, or t
  modified_base (583)..(583): a, c, t, g, unknown or other
  misc_feature (583)..(583): n is a, c, g, or t
  modified_base (689)..(689): a, c, t, g, unknown or other
  misc_feature (689)..(689): n is a, c, g, or t
tcagacgcgatcgacacgaccggtgctcgatttagcacacgatagttggggtttgggggaggaactgctcagttaggacccagagggaaccatggaagccccagctcagcttctcttcctcctgctactctggctcccagagacctcggagaaattgtcttgacacagtctccagcctattcctgtcttctctctccgagggganacacgcctaccctctacgatcgacgacggcctaagtcaagagttaattaagaactactaaccttgggaccttaggtaactaaccgtaaataccgaaacggtccttacgggacccgtacgggggtcccccctacttcctctaatacttaagtcgtagttacggtcccttcggaacgccggacgggtacccctaacggtggtaaccaccggtacccacgtccgtacgggttagcgggtttgggtacgggttggggtttcgcaagttacggaactttcccacgtttacaccaataacgtacaacgacgtacgaccctaaccctaacgtagtaacgtttaattgacgtattactaacgttactacgtacaacacgtacgtanagtacgtcgaaccgtctaccgttacggtacggacggtacggaacgaggttaggacgtaactaaccggaaatacggtggtacaggtccgtaccagtttcctacggtnttacg

SEQ ID NO: 240656 - DNA, 645 bp, Homo sapiens
  misc_feature: GYAE6OF02GL7TX.45.35.D02.1.454.CMB.1.raw
  modified_base (201)..(201): a, c, t, g, unknown or other
  misc_feature (201)..(201): n is a, c, g, or t
  modified_base (352)..(352): a, c, t, g, unknown or other
  misc_feature (352)..(352): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggcctccagagacctccggagaaattgtcttgacacagtctccagccattctgtctctctctccgagggganacacgcccaccctctcatcgcgaggccagtcagtagtatagaactatactggcctagtatacaatacacgcctggccgacgggtccccgctcctcatctatgatcgtcttcgagcgtacggccacgtggccacgtccgagtccgtaggtcngggtcgggtcgggttgggttcgactaacgtagtaccttcaccttcctacaacgtaactaccgacgcctaaccggtccccttaaccgtaaccgttaggtaaaagtttcgtttacggaccgttaaggtttaccttaacgttttcacgtacctaaacggtacgtaccgtaagtacgtagttccggcctacttaccggttacggttacggacgggtacggtaaccggtagggtaggaacgtaacgtaaccgaaacggttcgtacggtcggactacgaccgacttgtccgtacgttac

SEQ ID NO: 240657 - DNA, 699 bp, Homo sapiens
  misc_feature: GYAE6OF02I3IA9.45.35.D02.1.454.CMB.1.raw
  modified_base (206)..(206): a, c, t, g, unknown or other
  misc_feature (206)..(206): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccagagacctccggagaaattgtcttagacacagtctccagcctattctgtctctcctctccgagggganacagccaccctcgtcatcgcgaggccagtccagacgtataacgaactataacgtcggtcctgtatcgaatacgaagtcctacggccacgggtcccccggtctccctcgtaaccttctaacgtcggtacttccggtaccttccggagtcggacgggtcccacgttcggactaccgtccacgtcccgtaggttcgaggttcgggacggggtttcggttaggacctacgtaaacgtctttaccgtaaccttacgtaccgtactaactcccgaagcctaccgtaccctaccgtaacctaggtaacttacgttcacttacgttattaacgtttcgtacgtactaacgcgttaacgtaactaggtacgttccggaccttaccgtcgttaacggttccggacgggaacggtaccgtacgggacggtacgtaacgtaccggtaaataaccggtcggtaacgttccggaacggtccgtaacgtacttaccggttcgttaccc

SEQ ID NO: 240658 - DNA, 553 bp, Homo sapiens
  misc_feature: GYAE6OF02FWYG0.45.35.D02.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
  modified_base (391)..(391): a, c, t, g, unknown or other
  misc_feature (391)..(391): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgagggganacagcccacccgtctcatgcagggccagtcagngtatagacatacttgcctggtatcaatacagctggccaggtccccgntccncatctatcgatgctcagcagggccagtgcactcccngccaggtcagtggcggtggttgcanagtacttcactctcacgatcagtcacgtcctaccaactgaacgtntttcgacttagtcttaattactgtaccaaactcgactaacgagtacgtcgcctctacgtaccgtttcggcgggaaccggtaccgtagggaggaacgtacgtaaccgtaaaccgtaacgttcggtacggtactcggaccgtaaccgtacttcgttagttaccc

SEQ ID NO: 240659 - DNA, 834 bp, Homo sapiens
  misc_feature: GYAE6OF02JQRPC.45.35.D02.1.454.CMB.1.raw
  modified_base (214)..(214): a, c, t, g, unknown or other
  misc_feature (214)..(214): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagacgacctccggagaaattgtcttgacacagtctccagccattctgtctctctctcgaggggacacacgccaccctntccagtcgacgacgggccagtcagagtattacgaactattacgttggccttaggtactacgtaataccgaaacgtccgtacggtccgtaacggggtcccccggtacttacccgtacctaagtaccgtagttcggaacttcggtacccgtttccaaggtccgtaacgggggtcccctaaccggtggttaacccgtaactacccggactccccgggtaaggttttcggaaccggtttcggggtccggggtttcgggggtttaacggaccttaccggtaaaggtaaccccgttttcacccggttaacaccctaaagtaaccgtcgaaccgttaccgtaaccggtaccccttaacccgtaacgttacggttaaacgttacgttttccgaaccttaccggttaactttaacgtttccgtacgttacccgtaaacgtaccggtacttaaaccggttacggtaccggtttcgggaacccgttccgttacgttaaccgggtccgggtaccgggaacggggttaaccgtacggggttacggtacaaaggttaaccggtaaacggtaccggttaggtcccggaacttcgggaaacccctacggttacccgtacggttacccgttaaccgg

SEQ ID NO: 240660 - DNA, 678 bp, Homo sapiens
  misc_feature: GYAE6OF02I8R0W.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccgaggggagacagccacctctcatgcgaggccagtcagtagtattagaacatacgttcggcctggtatacaaatacgaaacgtccgtaggaccgtacggggtcccccggacgttccctacacttctaacgtcgtacttacgtaccgttccgagccgtaacgggccctaacgtcggacctacgtcccgaagcccgtaggtcctaggtcgggtcgggttagggtttcggactacgacgtcttaccgactcgtacacgtaatcacgaccacgtccctaccgaacgtacgtaagttacgtttacgactacgttacttaatttaccgtacgtaacgtaaccgtacgtacgtaacgtaacgtacgttacggtccgtaccgtcgttaacggttccggaacgggtaacggaccggtagggtacggaagtaacggtactaaaacggtacgtaggttacgacgttcgaaccgtacgtaacgttccgtagtttaccg

SEQ ID NO: 240661 - DNA, 779 bp, Homo sapiens
  misc_feature: GYAE6OF02F7B3X.45.35.D02.1.454.CMB.1.raw
  modified_base (203)..(203): a, c, t, g, unknown or other
  misc_feature (203)..(203): n is a, c, g, or t
  modified_base (257)..(257): a, c, t, g, unknown or other
  misc_feature (257)..(257): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtacttgacacagtctccagccattctgtctctctctccgagggganacagccaccctctcatcgcagggccagtcagagtatagacatactggctggtancaatacaagcctaggccacgggtcccccggctcccgtacagttctagtcgaatcgcctttaccgagtccgacgggccaacgtcggacctacctcccgacggtcccgtaggttaccgacgggttggggtccggggtttaggggttttaccggacgttaaccggaacggtttaccctttaccgaacccgtttaccgtaccgtaaacctaagttacccgaacgggtacctaacccggtaccccctttaaccccggtaaaaccgttaaggtaaaccggtttcgttttaaccggacccttaacggtttacctaacgtttttaacccgtacgggttaaaccaaaccggttaccggtaaccggttaactaacggttaacgtttacccgggaccgttaccttaccggttacccgggtttcgggaaccgggtaacgggaaccgtaggggcggtaaacgtaacgtaaccggaaaaccgttcgttaagggtccgttacgtccgaaccgtacccgatttcccgtagttaacccg

SEQ ID NO: 240662 - DNA, 872 bp, Homo sapiens
  misc_feature: GYAE6OF02FHGLR.45.35.D02.1.454.CMB.1.raw
tcagacgcgatcgacacgaccggtgctcgatttagcacacgatagttggggtttggggaggaactgctcagttaggacccagagggaaccatggaagccccagctcagcttctcttcctcctgctactctggctcccagataccaaccggaaaattgtgttgacacagtctccaggccaccctgtctctgtcctccgaggggagacacgcccaccctctcctgccgagggccctaggtacggagtcggtacgaagtaacggttacgttaggcctcgggtaaccaacgaagaaaacccgtcggacctacggtcctaccccgaacgggtcctttaccctctaactccctaagttcgacttcgacctaacgttaccccgaaaacggtaccggggttcccctcgggtaccccggtacccccaggtaacccggttacggggtttccccggtacggggacctaggggttcggggtaccgttggggacccgttaagttaccgtttttacccggaacctttcccggtaacccgaacccgttagttacccgacggtacccgtacggcccgtttacgaccggtaaggcccttaagggtaacggtaggttcggtcggtacgtttaagtttacttcggttacgttcgtaccgtacgtaaattaagttttacgtttaactttaacttaccgttaccccgttttacccgggttacccgttttttccgggaaccccgttaggggtaaaccccgttaaaggtttcggtaaaccgttaaccgttaacctaaaaccggtaccggtttaacgggtccgaacccggttaccgaccgttaacccgtatttccgttaccgttacccgtttacctaccggtttcccctaccccgg

SEQ ID NO: 240663 - DNA, 678 bp, Homo sapiens
  misc_feature: GYAE6OF02FTPBX.45.35.D02.1.454.CMB.1.raw
  modified_base (200)..(200): a, c, t, g, unknown or other
  misc_feature (200)..(200): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccagggganacagccaccctctcatgcagggccagtcaggagtattagaacatacttggcctggtatcaatacaagcctggccacgggtccccgctccccatctatgatgtctccagcgacgggccacgtggacactcccacgcctaggttcaggtcgggtcgggttggggtttcggctacgaggtactttcgacgttctctaaacgactcgacgtcaaccgccctacccgtaaccgttcgaaaacgtcttttcgacttacgttacctttaattaccttgtaaccgaactacggtacccgtaacgtacggtactttccggggtaccctccgttccgtacccgttttaccggggacgggtaacggggacccgtaaagggggtcggtaacggtaacgttaaccggaaaaaccgggttaccgttacgggtacggttaccgtacgtacccgaacccggttacggtttaccgtaggtttcccgtttaacccg

SEQ ID NO: 240664 - DNA, 766 bp, Homo sapiens
  misc_feature: GYAE6OF02GG5I4.45.35.D02.1.454.CMB.1.raw
  modified_base (113)..(113): a, c, t, g, unknown or other
  misc_feature (113)..(113): n is a, c, g, or t
  modified_base (118)..(118): a, c, t, g, unknown or other
  misc_feature (118)..(118): n is a, c, g, or t
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
tcagacgcgatcgacacgaccggtgctcgatttagcacacgatagttgggtttgggggaggaactgctcagttaggacccagagggaaccatggaagccccagctcagcttcnttccncctgctactctggctccagagacctccggagaaattggtcttgacacagtctccagccattctgtactctctctccgagggganacagcccaccgtctcgatgacacgggccaagtcagagtattaagaactatacgttcggccttaggtataccaataccgaaggcccgtaggcccgtaacggggtcccccggnttacccgtctaacgttacgtaatacggacttccgtaccttcccgaggtccgtacggggacctaacggtcggaccacgtcccgacgtccgtacggttcacggggttcgggtcgggtttagggtttagaccgtaacggaacgttacccttacgtaaccctcgtaccaacgtaacgttccgaacggtaccgtaccgtaccccgtaaccaaacgttacggtaacgttacgtttacgaccgttaagttaccttaacgtttacgtcgaacccgtaaacgtcggtaaccgttaacgtaggttacgtaccggtccgttaaccgttacgttacccggtttacgggaaccgggtacggaaccggtacggggtaggaaaccggttacgtaaccggtaaaccggttcgttaccggtacggtaccgtaccgaacccttaaccgtaggtttcccgtacggtttaccc

SEQ ID NO: 240665 - DNA, 804 bp, Homo sapiens
  misc_feature: GYAE6OF02FR9J2.45.35.D02.1.454.CMB.1.raw
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (269)..(269): a, c, t, g, unknown or other
  misc_feature (269)..(269): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctcgagggganacngccacctctcatgacagggccagtcagagtattaagaactatacttcggccttaggtatactaanacaaacgccgtggaccgtaccgggtccccgcttcctcgattctatgatctcgtccgaggcgacggcctacgtcgactacgtaccgagccgtacgttccgaggttcgggtacggttgggttacgccgtaactacggtccttacgaccttaccgtactaacgtacgtacgaacgtaccgaaccgttaccctaacccgttaaacgtacgtaaaaccgtttacgtttcggtaaaccgtacgttttaaaccgtaacgtttttaaccggtaccttaaacccgtaaacccggttaaggtaacccgtttaaacggaaacgtttacccggggttttccggaaccccgttacctttaacccggggttttaccgggttaaaccggggtaaccggggggtaaaccggttaaccgggtaacgggttaacgggtaaccggtaaccggtaaaaacccgttaaaaccgggtaaccggtttaagggttaccccgggtaacttaaccggtaaccccgttaaccggttaccgtttcgttaacccggtttaaccc

SEQ ID NO: 240666 - DNA, 716 bp, Homo sapiens
  misc_feature: GYAE6OF02GBGU9.45.35.D02.1.454.CMB.1.raw
  modified_base (199)..(199): a, c, t, g, unknown or other
  misc_feature (199)..(199): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctcggagaaattgtcttgacacagtctccagccattctgtctctctctccgaggganacagcccacctctacatcgcgacgggccagtccgaagtacgtaattaagaactattacgttcggacctaggttactacaaagttacgaagccctagggcccgtaacggggtcccccgtacttcccgtacacttacgtagtcgacttccggtcttaccgtaggccggtaacggcccgtaacgtcgggtaccaacgttaccccgacgtacccgttacggttaccgtagggtcgggttacgggttcgggtttacggacgtaaacgagttaacccttcggaccttacgtacctaacgaataccgataccgactacccgtacccaaaccgtcgtaaacttagtttacgactacgttacttaacttaccgtacgtacaacgtacgtacgtacgtaagtaccgtcggtcctacgttcctaacggttcggacgggtaaccggacgaagggtcgaacgtaacgtaacgtaaacgtacggtacgtacggtacgtcgaaccgtaaccgtacgtccgttacgttacccg

SEQ ID NO: 240667 - DNA, 670 bp, Homo sapiens
  misc_feature: GYAE6OF02FQOGM.45.35.D02.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (469)..(469): a, c, t, g, unknown or other
  misc_feature (469)..(469): n is a, c, g, or t
  modified_base (640)..(640): a, c, t, g, unknown or other
  misc_feature (640)..(640): n is a, c, g, or t
  modified_base (660)..(660): a, c, t, g, unknown or other
  misc_feature (660)..(660): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccatttctgtctctctctccgagggganacagcccaccctntcatcgacgagggccagtcagagttatagaacatacgttcgcctaggtatacgaatacaagtccgtacggccgtacggggttcccccgctcccgttacgacttacgtacgtcgtacttcgtaccttccgaggtccgaacgggccctacgtcggacaccttcccggagtcctaaggttcctaggtcggggtcggtttagggtttcgacgactaagttccgttacgctaccgtaccaagactacgacgtcgaacncccttaccaaccgtgaacgtttattcggactaggttactagttacgagtaacctacgacggtacgtaacgagttacttcgggaccgttactacgttacccgggttcgggaaccgtaggggaacctaagggtcggaacgtacaaccgggtaacgtagtcgggtataccggtnaaccgtttcacgttaccgtntttaacccgg

SEQ ID NO: 240668 - DNA, 1004 bp, Homo sapiens
  misc_feature: GYAE6OF02HERQ3.45.35.D02.1.454.CMB.1.raw
  modified_base (202)..(202): a, c, t, g, unknown or other
  misc_feature (202)..(202): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccacctctccatcgcgacgggccagtcagacgtataagaacattacttcggccgttaggtactacgaaattaccgaaacgtcccgtagggaccccgtaccgggggttccccccgtacgttcccccgttaccgtaacttaccgttaaacggttcgaacgtttccggcccttttacccgaacggtacccggaaccggggtacccttaacccggtcgggtacccaacccgtttaccccggaaccggttcccgtacgggtttaccaaccggggttcgggtaaccggtaggggtttcccgggtacggtaaccggggtaacctaccggttaacccgtttaccgtaacccgttttccgaccccgttaaccgtaaccgttacccgtaagggtaccccgtaacccggttacccggtacccgggttaaccccggttacggggttaaaccgggtttacgttttttacccgggaacccgttttaaaaccgtttttacccgggttaaccgtttaccggggttaccccgtaaaccggtaccgggttaaccgggttccccgggttaaccgggggttaccccggaaaccgggttccgggttccccgttaacggtttaccccggttttaaacccgggtttccgggggaaacccggggttaaccggggtaacccccggttaaaggggttacggggaaccccgggttaaaaccgtttaaacccgggtaaaaccggttaaccgggttacccgggttacgggttacccggttaccggtaaccccctacccggtttaccggttaccttttaacccccggg

SEQ ID NO: 240669 - DNA, 786 bp, Homo sapiens
  misc_feature: GYAE6OF02H3SCK.45.35.D02.1.454.CMB.1.raw
tcagacgcgatcgacacgaccggtgctcgatttagcacacgatagttgggtttggggaggaactgctcagttaggacccagagggaaccatggaagccccagctcagcttctcttcctcctgctactctggctcccagacgaccgtccggaagtaaattgttcttgacacacgtcctaccagtcctatttaccgtgttccttacctctccgtaccggaggggacgacaccgtcctacccctctacagtcgacgacggaccacgtcgagtattaacgtagaaccttacgtacgttggtaccgttggttaactactaacgaacaggtaccgtcggaccggtaccgggtccccgtctccctacgtctactcgttacggacgttactccgttccgacggtaccggacggtacccgtcggtacgacctccgtacccgagtacccggtacgttaccgtaggggtcgggttcggggttagggtttacgcgtaacgtacttcgtaccgtaccgttacgtaaccgtaacttacgaccgacgtaccgacccgtaaccgtacccgtaacgtaacgttaacgttacgtttccgtaacgttacgtttaccgtttaacttacgtaacgttacgtaaccgtacggtaaccgtaacgttacggtaccggttacgtccgttaacgttacccgccgggttaccgggtaacgggtacgggacgttaagggtacgtaacgtaacccggttaagacggttaaacgtcggaccgtacgaccgttaactccggtactcgtacgttaccg

SEQ ID NO: 240670 - DNA, 268 bp, Homo sapiens
  misc_feature: GYAE6OF02HJHCL.45.35.D02.1.454.CMB.1.raw
  modified_base (251)..(268): a, c, t, g, unknown or other
  misc_feature (251)..(268): n is a, c, g, or t
tcagacgcgatcgacacgaccggtgctcgatttagcacacgataggtgggtttggcacagacttcactctcacaatcagcagcctccaacctgaagattttgcagtctattactgtcaacagcgtacagattggccgctcactttcggcggagggaccaaggtggagatcaaacgactgtgctgcaccatctgtcttcatcttccgccatctgactcgatcgcgtctgagcggctggacaggcgcatacgnnnnnnnnnnnnnnnnnn

SEQ ID NO: 240671 - DNA, 1011 bp, Homo sapiens
  misc_feature: GYAE6OF02GFRNH.45.35.D02.1.454.CMB.1.raw
  modified_base (209)..(209): a, c, t, g, unknown or other
  misc_feature (209)..(209): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggcctcccagacgacctccggaagaaattgtcttgacacagtctccagcctattctcgtctctctctaccggagggganacacgcccaccctctacagtcgcgacgggcctagtcgaaggtagtacgttaagaaactacgttaccgttcgggtccgtaggttaactaacaaacgttaaccgaaggtacccgttacgggacccggacccggggttcccccgggacccttacccgtacgtaaccttaccgtaagttaccggttacgtaccggttacccgtttacccggaacgggttacccggaaccgggggaccctttaacgggtacccggggttaaccctaaccccggtttacccccgaaaccgggttaccccggggtttaacggtttaacccggggtacgggggtttccggggggttaacggggggtttttcgggggttaaacccgggtacccgttaaccggttaaccggtttaccccgtttaaccggttaaccccttaacccgttaaacccgtaaacccgttaacggttacccggaaacccgttaacccggtaccccgtttaaccccccgtaaacccgttaaaaccgggttaccgtttaaacggttttaacgtttaacccgtaccgtttaaaccggtttaaccttttaaccgttaacccggttaaccgttaaacccggtaacgtaaacgggtaccgtttaaagggaccgggttttaaccggtaccggttacccgttaccgtttaaccggtttacccgggttaacggggtaccgggtaaaccggggtaccgttaacggggtacgtaaccggaacgtttaaacgaccggtaagggttcggtaaccgtgacccgtacgttagaccgtttcggttacttaccgg

SEQ ID NO: 240672 - DNA, 922 bp, Homo sapiens
  misc_feature: GYAE6OF02JPV31.45.35.D02.1.454.CMB.1.raw
  modified_base (139)..(139): a, c, t, g, unknown or other
  misc_feature (139)..(139): n is a, c, g, or t
tcagacgcgatcgacacgaccggtgctcgatttagcacacgatagttgggtttgggggtagggtaacgtgctcagttaggacccagagggaccatggaagcccagctcagctctcttctcctgctactctggctccagngacctccgagaattgtcttgtacacagtctccagcctattctggtcctctcttactcccgaggggtacacgcgcccacccttcctcgactgccgacgggcctacgtaccgagtaacggttattaaagaactacggttaactggtccttaggtactaccgtaataacaacggtcctacggtaccgacggggtaccccccgtccgtccgtaccgtacttactaacgttcggtaacttccgcgttaccacggacgtaccggggttcccaacgggtccgtaaccgttaccgtaccccaccgggtaccgtacgggtttaccggaacggtttggggtaacccgggtttggggttttacccggacgttaaccgtacggttacccgttttaacgccgtaccttcccggaacgttactacccgtaaggtcccgtaaacgtaccccgttacccgtaaacccgtttacgggtaaacgttaccggttttttaccggaccggttaaccgtttttaccggtaaacctttttaacggtaccccggttaaagtttaaccctacgggttaacccgttacccggaaaacggttttccggttaaaccccgggtaccgtaacccgttaaccccgggtttacggtttaacccgggggacccgggttacggggtaaaacccggttagggggtacccgtacgggttaaacgtaaccggtaacgggtaaacccggttttccgggaacgggtttaccctacggggttaacccaacccgggtttacccttaggttacccggttttaccc

SEQ ID NO: 240673 - DNA, 640 bp, Homo sapiens
  misc_feature: GYAE6OF02GQ0M2.45.35.D02.1.454.CMB.1.raw
  modified_base (163)..(163): a, c, t, g, unknown or other
  misc_feature (163)..(163): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
  modified_base (417)..(417): a, c, t, g, unknown or other
  misc_feature (417)..(417): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctccagagacctccggagaaattgtcttgacncagtctccagccattctgtctctctctccagggganacngccacctntcgatgcgaggccagtcagtagtnttagaactgtactggccttgganacaatacagtccgtacgaccgacggtccccgntcctcgatccgtatacnttcgacttcgacgcgtaacggggcccaagttccggacaccgtcccaggtccctaggttacgagggttcgggcggtttgggtttcgactacgtacgctttacgacttcctanacatcagcacgcctacctacgtagtacgttagttcacgttacgttactacttacgtagttaccaaccgtagtaccgttaacgtacgtacgtttcggtaccgttcgtaccgttaccggtttacgggtaccggaacgggtaccgtagggttcgggaacgtaacggtaaccgaaaaccggtcgtacggtaggtcctaggtacccacgtacggttcctcgttacccg

SEQ ID NO: 240674 - DNA, 805 bp, Homo sapiens
  misc_feature: GYAE6OF02H7DUW.45.35.D02.1.454.CMB.1.raw
tcagacgcgatcgacacgaccggtgctcgatttagcacacgatagttgggtttgggggaggaactgctcagttaggaccagagggaacatggaagcccagctcagcttctcttcctcctgctactctggctccagacgacctccggagtaaattgtcttcgacacagtctcagctattctgtctctactctcgaggggacacgacgccacctctcactgacgacggccagtcagtagtaactaagaactataacgttcggtactggtactacaacgtacgacgtccgtcggaccggtaccggggtccccgtccttccgtactacttaccttacgtacgtacttcgtaccgttccgaacggcggtaccggtccgacggtacgaccgtaccaccgacggtccgtacggttacggacgggttcgggttacggggttacgggttacgacgtaaccgtacgttacttacgtaccgttccaactacctaacgtccgacgtaccgtacccgtaccctaaaccgaacgtttaggtaaccgtttcgttttacggacctttacggttaacttttaacgttacgtaactcgtaaaccggttcgtacggtaaaccgttaggttaccggtttcccggaccgtttccgttaaaccgggtttaccgggtacgggggaaacccggggtttaaaccggggacttaacgggggttaccggtaaccggtaaccggttaaaacccgttaaacggggtccgttttgggaccccgggtactaacccggttaccgtaacccgtttacggttttcccttaaggttcccc

SEQ ID NO: 240675 - DNA, 763 bp, Homo sapiens
  misc_feature: GYAE6OF02ILKVF.45.35.D02.1.454.CMB.1.raw
tcagacgcgatcgacacgaccggtgctcgatttagcacacgatagttggggtttggggaggaactgctcgagttaggacccagagggaaccatggaagccccagctcagcttctcttcctctgctactctggcctaccagacgacctccgggaagtaacttggtcttaggacaactggtcctaccgagtcctacttcgtcgtcctctcctacgtaccggaggggacaccgtacgccctaccctcgtacgacgtcggacggacgggtacctacgtaccggaagttaacggttaacgttaacgaaccttaacgttaccgttccgggtaccttagggttaacaacttaacgtaacggaaccgtccgtacgggaccccgtacggggtcccccgtactccgtacgtaactcgttagtccgtacgtcgtaccttccgaggtaccgtaaccggcctaacggtcgtaccgtacgttacccggacggtactaccggttcgaacgggttcgggtcgggttacgggtttacgacgtaacgcggttacctacgtactccggtacaaacgtactacgaccgtacgacctaccgtacctacggtacttaacgttcgtacgtacgtacgtacttaaggtacctaacggtcaacgcggttaacaacgtacggttcggtacgtccgtacgttcgtacgggtccggacgggttaacgacgtagggtacgacgcgtaacgacgtacgtacgcggtactacggctaggtctccggtataccgg

SEQ ID NO: 240676 - DNA, 720 bp, Homo sapiens
  misc_feature: GYAE6OF02GHS57.45.35.D02.1.454.CMB.1.raw
  modified_base (204)..(204): a, c, t, g, unknown or other
  misc_feature (204)..(204): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggcctcccagagacctccggagaaattgtcttgacacagtctccagccattctgtctctctctccgagggacacncgacccaccctctacatcgacgacgggccagtacagagtaattacgaactatacgttcggtcttaggtactacaatacaacgtctacggccgtaccgggtacccggctccgtacacgttactacgtcgtacttccgtacttaccgacgtcgaccgggtacctacgtaccgacctacgtacccgtacgtaccgtacgttacgtcgggtgggtacgggttcgggtttaacgcgtaaccgtacgtccgtttaccgtacgttacctacgtaaactaacgtccgtaacgtaccgaacgtaccccgtaccgtaaccgtacgtaaacgtttacgtttaacgacgtacgttaacttaacgttacttaccgactaaacggtcgtaacgtacgtaggttacgtaccgtaccgtactcccggttacgtacgggtaacgggtacggtaacccgtagggtacggtaacgacggttaacgaaaccggtgttacggacgacgttaccacgtactcgttacgttcgttaccg

SEQ ID NO: 240677 - DNA, 686 bp, Homo sapiens
  misc_feature: GYAE6OF02HYW2Y.45.35.D02.1.454.CMB.1.raw
  modified_base (421)..(421): a, c, t, g, unknown or other
  misc_feature (421)..(421): n is a, c, g, or t
  modified_base (605)..(605): a, c, t, g, unknown or other
  misc_feature (605)..(605): n is a, c, g, or t
  modified_base (639)..(639): a, c, t, g, unknown or other
  misc_feature (639)..(639): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
  modified_base (674)..(674): a, c, t, g, unknown or other
  misc_feature (674)..(674): n is a, c, g, or t
  modified_base (677)..(677): a, c, t, g, unknown or other
  misc_feature (677)..(677): n is a, c, g, or t
  modified_base (679)..(680): a, c, t, g, unknown or other
  misc_feature (679)..(680): n is a, c, g, or t
  modified_base (685)..(685): a, c, t, g, unknown or other
  misc_feature (685)..(685): n is a, c, g, or t
tcagacgcgatcgacacgaccggtgctcgatttagcacacgatagttgggtttggggaggaactgctcagttaggacccagagggaaccatggaagccccagctcagcttctcttcctcctggcactctggctcccagtcgagggtgttaacagtctacgttagcctggtaaccaaaccaaaaaccgtggcccagggtcctacccgaggcctacatctatctatagacgcagtaccggaacgacgggacctacgtgggcctactacccgacggaccgtaggttaccgaggtcggacgtagggtcgggtacgtacggggaacaaggtacgttacaccgttcgtacccgtaccgtacgagtaccgacgtcccgtagggactccgtaggtaattggttacttttgacgttaacgttttaccgtntacgtacacggtctacggtccttccgaccgaccgtcgacgttacgttacgggtaccggggcggggacgtagggtgaacgaggagtaacggaacgtggtcgggtacacgtccggtactaaccgcgttcgttcgtaattccgtaaccgtttcccgcccttacgtagtccgtagaaccgtggtaccnccgggttactcggtaacgggcggttacccggggnttaaacggacgcggtaccgatacgggngngagagncgngnngctgnc

SEQ ID NO: 240678 - DNA, 698 bp, Homo sapiens
  misc_feature: GYAE6OF02GEZJQ.45.35.D02.1.454.CMB.1.raw
  modified_base (112)..(112): a, c, t, g, unknown or other
  misc_feature (112)..(112): n is a, c, g, or t
  modified_base (181)..(181): a, c, t, g, unknown or other
  misc_feature (181)..(181): n is a, c, g, or t
tcagacgcgatcgacacgaccggtgctcgatttagcacacgatagttgggtttggggaggaactgctcagttaggacccagagggaaccatggaagccccagctcagcttcncttcctcctgctactctggctcccagagacctccggagaaattgtcttgacacagtctccagccattcngtctctctctcgaggggacacagcccaccctctcatgcagggccagtcagagtattagaactatacttcggcctggtatacaatacaaagcctggaccgacgggttccccggcgttccctacgactctatgatcgcttccgagccgacgggtccacgtcggtcctacgtacccacggaccgacggtttccgaggtcgggtcggggtcggggtttacggtcgtaaccggtaagttacttacctaccgttcctacctaacgtaactacgacgacgtacgtaccctacctaaccgtacgtaaacgtaatttttacggcgtaagttacttatttacgtagtttaccgtacgtaggaccgttaacgaagtacgttacggtcccggtacctttaccttaccggtttaccgggtcggggtaaccgggtaaccgggtaacgggacggtagggtaaacgttaaacgaaaccgttaagttaccgggttaggcgtacggaccaaccgtacgttcgttcgtttaacccg

SEQ ID NO: 240679 - DNA, 739 bp, Homo sapiens
  misc_feature: GYAE6OF02IWN7F.45.35.D02.1.454.CMB.1.raw
  modified_base (204)..(204): a, c, t, g, unknown or other
  misc_feature (204)..(204): n is a, c, g, or t
  modified_base (405)..(405): a, c, t, g, unknown or other
  misc_feature (405)..(405): n is a, c, g, or t
  modified_base (696)..(696): a, c, t, g, unknown or other
  misc_feature (696)..(696): n is a, c, g, or t
  modified_base (718)..(718): a, c, t, g, unknown or other
  misc_feature (718)..(718): n is a, c, g, or t
  modified_base (733)..(733): a, c, t, g, unknown or other
  misc_feature (733)..(733): n is a, c, g, or t
tcagacgcgatcgacacgaccggtgctcgatttagcacacgatagttgggtttggggaggaactgctcagttaggacccagagggaaccatggaagggccccagctcagcttctcttcctcctgctactctggcctccagagacctccggaagaattgtcttgacacagtctccagcctattctgtctctctctaccgaggganacagcccaccctctacatgacgacgggccagtactagtaacgttattaacgaactagttaaccgttggtccttaggtatacgaaacttaacgaacgtcccgtacggaccccgtaccggggttcccccggtaccttcccgtacctacttcgtaacgtcggtacttcgtccttaccgaggccgacgggtcccacggtcgaccnccgtacccgagtcccggtagtttcgacggttgggtacggggtttggtttacggcctaacgtacgtaacttccaaccttaccgactaaccgtactaccgaacgtaccaccgtacccctaaccgtaaccgtagttaaacggttcttttaacgaccttaacgttaccttaacgtttaccgtagttaccgaactacgtacgtaacgtagttacgtaccggtcctcgttaccgttacggtaccgggacggtacgggtaaccgtaggtacggtacgaacggtaaccgtaaaccggtntacggtcgtccgacggttaccnccggtacttacgttnttaccg

SEQ ID NO: 240680 - DNA, 627 bp, Homo sapiens
  misc_feature: GYAE6OF02FZ5GD.45.35.D02.1.454.CMB.1.raw
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
  modified_base (290)..(290): a, c, t, g, unknown or other
  misc_feature (290)..(290): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatncagggccagtcagagtattagaacatacttggcctggtatcaatacaagctggccagggtccccgctcctcntctactgatgcttccagcagggccacttggcactcccagccacggtttcaggtggcggtgggttttggcacgtaggtacctttacacttaccgttccaacgtaactacagacctagccccgtcctaaaccgtgtaacgtactttttcgctaacgttacttacttacttcgttacaactacgtacgtaacctagtaacgttcgggtcccgtacttacccgtacgttttaccgggtcgggtaacgggaacccgtaagggcggaacggaacttaaccggaaaaccgtaaccgtaggttcgggacgttacggtaccacccgagttaccgttgtttaacccg

SEQ ID NO: 240681 - DNA, 736 bp, Homo sapiens
  misc_feature: GYAE6OF02JL03W.45.35.D02.1.454.CMB.1.raw
  modified_base (168)..(168): a, c, t, g, unknown or other
  misc_feature (168)..(168): n is a, c, g, or t
  modified_base (230)..(230): a, c, t, g, unknown or other
  misc_feature (230)..(230): n is a, c, g, or t
  modified_base (710)..(710): a, c, t, g, unknown or other
  misc_feature (710)..(710): n is a, c, g, or t
tcagacgcgatcgacacgaccggtgctcgatttagcacacgatagttggggtttgggggaggaactgctcagttaggacccagagggaaccatggaagcccagctcagcttctcttcctcctgctactctggctcccgagagacctccggaataaattggtcttgacncagtctccagccagttctagtctactctctcgaggggacgacacgccacccgttctcagttnccaagggtccagttcaaggacttactagaacattacgttggtcccgtgtagacctaagtaccaagccgtcggtccgacggggttcccccgatccctcgtactactgtaggtacttcgccgttccgaagtccgaacgggtcctaacgtggacctacgtacccacggcctaggttacgtagtcggggtcggttacggggtttacgctaccggagttaccctttacgaccgttaccgttaccaacgtaaacgttgaaccggaacccgttaccgacccgttaaccccgaacgttaacggtaacgtttaaccggtttcgtaaaccgttaccgttaactttaccgttttaaccgtaacgttaccctaaacgaacggttaccgacggttactacgtttccggcccgttaaccgttcgttaaccgtttcgggaccgggtaacgtacgggttagtacgggaattcgttaacaacgttgtacggcgtacnccgtaacacgttactcgttcgtaccg

SEQ ID NO: 240682 - DNA, 832 bp, Homo sapiens
  misc_feature: GYAE6OF02IVW6P.45.35.D02.1.454.CMB.1.raw
  modified_base (121)..(121): a, c, t, g, unknown or other
  misc_feature (121)..(121): n is a, c, g, or t
  modified_base (231)..(231): a, c, t, g, unknown or other
  misc_feature (231)..(231): n is a, c, g, or t
tcagacgcgatcgacacgaccggtgctcgatttagcacacgatagttgggtttgggggaggaactgctcagttaggacccagagggaaccatggaagccccagctcagcttctctctcctnctactctggctaccagagaccgtccggaagtaacttcgtcttagacacagtcctcagcctattctgtctacgtctccgtcgagggactaccacgtccctaccgtactacngtcgcacgggcctacgtcaggtaacgtacgtacgtaaatacgtacgttacggtccgtagttaactacgtaaagtactaaacggaccgttacgggtaccgtaacccggggttcccccgtcgttaccccgttacgtaccgttattaccggtacggttactaccggttacctttaccgaaccggtcgtaaccccggggtaccctacggttcccggtaacctaacggttccccgtaaccgttcccgggtaaggttacccgtaaggggttccgggttaacccggggtttacggtttacggtacccggtaacgttaccggggttaacccttaccggttaacccgtaacccggtaccgttaaaccttaaccggtaaccctaccggtaaccgtaaaccgttcccgtaacccgtaaccgtacggtaacgttacgtaccgtactacgggttaactaccgttaccgtagtaaccggtacaccggttacgtaacgtaccgtcgtacggtccccgtagttacgttaaccggtcggtaaccggtacgtaggtacgtaacggtcgaacgtacgaacgtagtcggtacgtcgtagaccacgtctacgttacggtacg

SEQ ID NO: 240683 - DNA, 707 bp, Homo sapiens
  misc_feature: GYAE6OF02GNFF5.45.35.D02.1.454.CMB.1.raw
  modified_base (201)..(201): a, c, t, g, unknown or other
  misc_feature (201)..(201): n is a, c, g, or t
  modified_base (271)..(271): a, c, t, g, unknown or other
  misc_feature (271)..(271): n is a, c, g, or t
  modified_base (397)..(397): a, c, t, g, unknown or other
  misc_feature (397)..(397): n is a, c, g, or t
  modified_base (444)..(444): a, c, t, g, unknown or other
  misc_feature (444)..(444): n is a, c, g, or t
  modified_base (564)..(564): a, c, t, g, unknown or other
  misc_feature (564)..(564): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattcctgtctctctctccgagggnacacgccacccgtctaccagtcgacgcgggacctagtcagtacgtattagaactatacgttgcctaggtntacaaatcaagccgttacggacccgtacggggtcccccggcttccgctaccttcgtaacgtcgtatcgaccgttacacggtccgacgggacctacggtcgactactcccgtaagtcccgtaggtancggttgggtacccgggttggtttaggcctaaccggtactccgttacncccgtacttaccaagaacttcgacgtccacgttacccacggtaacctaggtaacgttactttcgggacctagtttaacccgtatttacgtacgttacccaaggtttcaccgggtttaaanacgggttaccgtccggtcctaccgttacggtaccggttacgggaaccggggtacgtaccgggagggtacggaacggtacgtaaccgtaaccggttcggacggttacggtcctaacgtccgaacccgtcgtttctaccggtacc

SEQ ID NO: 240684 - DNA, 685 bp, Homo sapiens
  misc_feature: GYAE6OF02IS5S9.45.35.D02.1.454.CMB.1.raw
  modified_base (187)..(187): a, c, t, g, unknown or other
  misc_feature (187)..(187): n is a, c, g, or t
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (530)..(530): a, c, t, g, unknown or other
  misc_feature (530)..(530): n is a, c, g, or t
  modified_base (565)..(565): a, c, t, g, unknown or other
  misc_feature (565)..(565): n is a, c, g, or t
tcagacgcgatcgacacgaccggtgctcgatttagcacacgatagttgggtttgggggaggaactgctcagttaggacccagagggaccatggaagccccagctcagcttctcttcctcctgctactctcggcctccagacgacctccggaagtaaattgtcttagacacagtctccgacgcattcngtctactctctccgagggacacacgcccacctnacatcgcgaggcacgtanacgtacgtaattaacggaactacgttacgtcggtcgtaggtaacttaccaagtacgtaaccggtccgcggtaccggaccgggtacccccgtctaccgtcctacgtacttacgtgtactcgtccttaccgagtccggaccggtaccaacggttcggacctaacgaccgtaacggccggttaacgtcgtacggggtcgttcggggttagggtccgactacggtacggtcttacgacgtacttaccgaagtactactcggacctacgtacctacccgaatgtaacgttcgttacncgtaagtacctagtcctagtaccgatacggtcganaacggttacgtccgagtacttaccggttcgtacggggaccgaagtaccggtaggggactacggaactaacgtaacggttacgtcggggttcacggtccgacgtccctatcgtccggttac

SEQ ID NO: 240685 - DNA, 924 bp, Homo sapiens
  misc_feature: GYAE6OF02JE52Q.45.35.D02.1.454.CMB.1.raw
  modified_base (532)..(532): a, c, t, g, unknown or other
  misc_feature (532)..(532): n is a, c, g, or t
  modified_base (804)..(804): a, c, t, g, unknown or other
  misc_feature (804)..(804): n is a, c, g, or t
tcagacgcgatcgacacgaccggtgctcgatttagcacacgatagttgggtttgggggaggaactgctcagttaggacccagagggaaccatggaagccccagctcagcttctcttcctctgctactctggcctccgagacgacccgtcggaagtaattgtagttgaacactagtcctaccacgaccctacccgttgtttaccgtttttacggtttacccggaaagggggaaaacgaccgtacccctacccccgtttccttccccggttgcccggtaacgggggtaccccaggtttaccgtaagggggtttacgttaaaaccgagtaaccttaaccgttacgtcccgttacgggtaaccacggtaccaaacggtaaaccgtcggaccggtaacggggtccccaggtcccctccgtacaagttccttaagttagcgtaccctaactacccgaaacggccgggacccctacggtacggacctacccgaaccccgtaaggacctttacgggtaccgtaacgggtcggtaaccggngggttaccggttccgggttaaccggggaactaaacggttacccctttacgaaaccccgtttaccgtaccgtaacccgtaaagtaccccggaacgtaccgaacgggttaccgtaaccggtcggtaaccgtaaaggttacgttacgtttacgacggtaggtttaccttaagttaccggtattaccgaaggttacgtaccgttaacggtaccctttccggttacctttcccggttacgttcccggtacccggtacgtaaaccggtaaccggttanaaccgtaaacgaaccggttaagtccgtacgtacggtacctcggtaaccctcgtaaacccgtttcgtttaaccaccgtttaacccgttaccctacccggttacccgtaccgtccttaacgg

SEQ ID NO: 240686 - DNA, 899 bp, Homo sapiens
  misc_feature: GYAE6OF02FGLQK.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctacccagagacctccggataaattgtcttgacacagtctccagccattctgtctctacgtcctaccgaggggacacgagccctacccgtctaccagtcggaccgacggggtaccctaacggttccgaaggtaacgttaacgtttaaacggaaacctaacgttaaccgtttcggacccgtttagggtaacttaccaaaacgttaccaaaacggtcccgttacggggaccccgtaaccgggggttccccccgtacttaccccgttacacggtttacctagtacgtacgttacgttcccttacccgaaggtccggaacggggtccccaacggtttcggaccgtaacccgtcccgtaacgggtaccctacgggtttacccgaggggtttccggggtaccgggggttttcgggggttttaccggaacccgttaaacgaccggtttaaccctttaccgaaccgttttacccgaaacaaacggttaaccgttcgaaccgaccgtaaccggtacccccttaacccgtaaaccgttacggtaaacggtttacttttacggacgttaacggttaccttagttacctagtaactaacgtacggtaccgtacgtaacggtcgttaccgggtaccgtacgtttaaccgtacggtttccgggaacgggtaccgggtaaccggtaaggggtacggaacggtaacgaaccggtaaaccgttacggttacggtaccgggtactaacggtacccctaacgtaccgtttaccgttcgttaacccg

SEQ ID NO: 240687 - DNA, 720 bp, Homo sapiens
  misc_feature: GYAE6OF02JCX5D.45.35.D02.1.454.CMB.1.raw
  modified_base (275)..(275): a, c, t, g, unknown or other
  misc_feature (275)..(275): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttggacacagtcctccagccattctgtcctctctactccgaggggactacagcccaccctctcactgccagggtccagtcaggtacgttatacggaactagtactggcctaggtanctaagtacaacgtcctggaccgacgggtaccccgcttcctagtactcgtatcgatcgtccttcagcgacggaccacgtgccaacgtccccgagtacccgtaggttcaccgggtaggtccggggttggtttggccaacgtacgtacccgtttaccgaaccttcgtaactacgtacgttccgagtccctaacggttcccctaaccgtaaccgtaggtaaaccgttacgttttaccgacgttaacgttctttaacgtttacgttaccgttactaaacgtaccggttacgttaaccgtacgtttaacgtccgttaaaccgccgtttaccgttaacgggtttcggaacgggacgttaaccggagggttacggaccgtaacggttaaccaacggttacggtacggtacggtaccgtacggccttaaacggtccgttaccgtttggtaaccg

SEQ ID NO: 240688 - DNA, 786 bp, Homo sapiens
  misc_feature: GYAE6OF02IBNUC.45.35.D02.1.454.CMB.1.raw
  modified_base (182)..(182): a, c, t, g, unknown or other
  misc_feature (182)..(182): n is a, c, g, or t
  modified_base (204)..(204): a, c, t, g, unknown or other
  misc_feature (204)..(204): n is a, c, g, or t
  modified_base (484)..(484): a, c, t, g, unknown or other
  misc_feature (484)..(484): n is a, c, g, or t
  modified_base (541)..(541): a, c, t, g, unknown or other
  misc_feature (541)..(541): n is a, c, g, or t
  modified_base (622)..(622): a, c, t, g, unknown or other
  misc_feature (622)..(622): n is a, c, g, or t
tcagacgcgatcgacacgaccggtgctcgatttagcacacgatagttgggtttgggggagaactgctcagttaggacccagagggaccatggaagccccagctcagcttctcttcctcctgctactctggcctccagagacctccggagtaaattgtcttgacacagttcctcagccattcngtctctctctccgagggtcacngccctacctcgtcagtcgcgacggcctagtcgaagtacgttagttaacgaccgtattaccggtggtaccgttaggttaactaccgtaaaagtaaccgaacgtcccgtacggggtacccgtaaccgggggtttccccccgtcgtacccgtcctaactttaccgtaacgttcggttaaacttcggaccttttcccacggacgtaaccggggtcctacggtcgaaccgtactcccggacgttcccgaaggtttacgcggggtagggtcgggtttccggggttnaaccggttactagtaacccgttacctaccgtcgtacgacttaacgtctagttacccncgtaacccctacgtaacgttacgtaaacgtttactttcgaaacgttcgttaaaccgttattacggtaactaacccggtaanaccggttaagtacggtacgtacggtttcccgaacggtccgttattaccggggtacggacggggtacgtaaaccgtggggaccggttaactaacggtaacggtaaccgttaggtccgttaccgagttacccggaccgttactacgttccggttacggtttaaccc

SEQ ID NO: 240689 - DNA, 815 bp, Homo sapiens
  misc_feature: GYAE6OF02HLVXI.45.35.D02.1.454.CMB.1.raw
tcagacgcgatcgacacgaccggtgctcgatttagcacacgatagttgggtttgggggaggaactgctcagttaggacccagagggaaccagtggaagccccagctcgagcttctcttcctcctgctactcgtggcctcccagacgacctccggaagtaaattgtcttgacacagtcctccagccagtttctgttcctccgttctccgtaccgaggggacacacggcccctaccctctacgtagtcgaccgacgggccaaggtacgaggttacgttaacttacggaactatacggttcggtccttaggtactagaaacttaacgaacgtccgtacggaccgaccgggtccccgtctccgtctacgttacttacgcgtacgtcgttaccttaccgacggccgtaaccgggacctacgtacggtaccgaccgtaccgaacgtaccgtaggttcccgtaggggttccgggttacggtttcgggtttcggacgtaccggtaacggtacctttacgaaccttaccgacgtaaaccgtaacgtaccaccggtaccgtaaccgtaccccgtttacccgtaaaacccgttaggtaaactttcgtttaacggaccttttaacgtacggtttacttacgttaccgtaaactaccggttaagaccgttacgtaaggttaccgacgttccgtacgttcctaaccgggttacggaccgggtaacgggaccgttagggacggtacggtaaacgtaaccggtaaactaccgggttaggtaccggtacgttaaccggaaccgttaccgtacgtttaccggttacctttacg

SEQ ID NO: 240690 - DNA, 627 bp, Homo sapiens
  misc_feature: GYAE6OF02GCNAV.45.35.D02.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagatatagaacatacttggcctggtatcaatacaagcctggccacgggtccccggctcctcatctatgatgccttccagacgagggccacgtggacacgtcccagccgaggttcaggtcgggtcgggttgggtttcggctacgtacgtacttcaccgttcaccagtaactcgagccacgtccctacccaaacgtcgaaagttactttacgcgtaacttacttactttactcgttacaacgtagtaccgttaacgtacgtacgttcgacccgtacttaccgttaccgtttacgggaccgggtaacgggtaccggtaagggtaggtaacggagttaacggaaggtaaccggaacgtggttacgggtaccttacggtacctaaccgttacgttacgttaccg

SEQ ID NO: 240691 - DNA, 687 bp, Homo sapiens
  misc_feature: GYAE6OF02G1W8S.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctttgtttccgaggggaaagcgccaccctctcctgcgacgggccagtcgtagggtcgttaaacaggtctaacttacgccgttacggtaacccaaacgtaaaaacccgtcggacccaacggcctacccgaggacctacgactcatctatgaccgactacgtacgaaacgtacgggacctacgtggacctactacccgagacccgtaggttcgagtcggcgtaggtcggtcgtagggacacgtaccgttactacgtcctacacctatacgacgtcacgtccgtacggacctacggtacggttacgtttacgtaccttacgtttacctacgttacgtactagtcgtaggccggtacggccgacgacggtcgtaccttaccgtacggtttaccgggcgggaaccgggacgtaacggggtacgaacgtacgaacgtaacgacgtacggtcggtactcggacctaccgtacgttacgtccggttacctaccgtcttcccgtaccctacg

SEQ ID NO: 240692 - DNA, 663 bp, Homo sapiens
  misc_feature: GYAE6OF02GN61P.45.35.D02.1.454.CMB.1.raw
  modified_base (379)..(379): a, c, t, g, unknown or other
  misc_feature (379)..(379): n is a, c, g, or t
tcagacgcgatcgacacgaccggtgctcgatttagcacacgatagttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagaggccacatcgaactgcaacgtccagccagagttgtttagacacgcctaccaacaagtaacgaacttacgttagtcttcggtaaccagacagaaaccgaggtacagcctacctagcctgcttacgtttcgacgggtcctacgacccgggtgtcccgggtcctagaccgtattcgaggtcgacngacggtcgtgggacagtactttcgacgtcctacaccgtatccgagtccgagtcccgtagacctagaccgttacgaaggtacgtcgtaccgtagtaaacgttttacgtactacgtacgtaacggtacttaaacgttcgttaagacgtaacggttaccttccgttaacctcgttacccggtttcggggaaccgggttaaccggtaacccggtaagggtttccgaacggtaacgttaaccgtaaacggtacggtttagggtacccggtataccggacccgttaaccg

SEQ ID NO: 240693 - DNA, 933 bp, Homo sapiens
  misc_feature: GYAE6OF02GGJME.45.35.D02.1.454.CMB.1.raw
tcagacgcgatcgacacgaccggtgctcgatttagcacacgatagttgggtttgggggaggaactgctcagttaggacccagagggaaccatggaagcccagctcagcttctcttcctctgctactctggctcccagacgacctccggagaaattgtcttgacacagtctccagcctattctgtctctctctccgagggacacagccctaccctctccgtatcggacgacgggtaccaggttaccaaggagtttaagttaacgaaacgtaacttaacgtttcgggaccttaggttaactaaccgtaaattaaccgaaagtccccgtagggtacccccggaacccgggggttccccccgtaccgttaccccgttacccgaagttaccttagttacgtaacttccggttacctttcccggaacggtccggaaaccgggggtcctaaccggtcgggtacccaaccgttaccccaacggtacccgtaggtttaccgacgggttcggggtcggggtttacggggtttacggtaaccgtacggtaaacttaccgttacccttaacgttcccgtaaacctaaccgtaaactttccgaagtaccgtaccccgtaaccgttacccgtaaacctaaggtttaaacgtttacgtttacgtaaccgttacggttaacctttaaagtttacccggttaaacgtttaaacccgaaacggttccggttaaaccttacggtaaacgttccggtttaaccggggttacccttccggtttaccccgggtttaaccggtttccggggtaaacggggtaacccgggtaaacgggttaacggggggttccgaaaacgggtttaaacccgtaaaccggaaaaccggttaaccgggttaccggtaacgggtacctacggtaaccctaacggtaccgttttacggtaccgttacccg

SEQ ID NO: 240694 - DNA, 585 bp, Homo sapiens
  misc_feature: GYAE6OF02F30FS.45.35.D02.1.454.CMB.1.raw
  modified_base (518)..(518): a, c, t, g, unknown or other
  misc_feature (518)..(518): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccgaggggagacagccaccctctcatgcaggggcccagtcagacgtattagaacatacttggcctggtatcaatacaagcctggccaggggtcccccgctcctcagtctactgatgccttccagcgaggccacgtggcacgtcccagcctaggtcagtcgggcggtttgggttgacgacacgtactctacttccacacaatcaacgccacgccctacaaccgtagagtaatttcgactagttcttattacgtgtaccaacagtcttacgaggttacttcgggcctacttcgttaccgttacgggacgggtaccggaacggtacgggnggtaacgtacggtaaccgaaaccggtacgtacggtggactcggaacctaccaagttcgttcgttacc

SEQ ID NO: 240695 - DNA, 784 bp, Homo sapiens
  misc_feature: GYAE6OF02G1H4J.45.35.D02.1.454.CMB.1.raw
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
  modified_base (319)..(319): a, c, t, g, unknown or other
  misc_feature (319)..(319): n is a, c, g, or t
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagtaaattgtcttgacacagtctccagcctattctgtctctctctcgaggggnacanccacctntcatgcncgggccagtcagtatattacgaacattacgtcggacctaggttactactaaactacgaacgccgtcggacccgtacggggtccccccggcttacccctanacttcgtaactaggacttcggtccttaccgacgccggacgggtccctacgtcgacctacctcccgaggcctaaggttccgagggttcgggtacgggttggggtttcgacgaaccggtataccgtttccaccttccggtaacctaataccgtacgtacgaccgtaccggtaccctacccgtaaccgtacggtaaaccgtttacgtttaccgtaacgttacgtttaactttaccgttttaacgttaccgttaacgtaaaccctacggttaaccgttaacggtaacgttaccggtttaaccgtcccgttaccctccggtttaccggtttacccgggaaccgggtacggggtaaccggtaacggggtacggtaacggtaaacggttaaccggttaaaaaccggtacggtttaaccggtaaggttaccgtacgggtaccctacgttaaccgtttcggttccgtttaaccg

SEQ ID NO: 240696 - DNA, 871 bp, Homo sapiens
  misc_feature: GYAE6OF02G8FVY.45.35.D02.1.454.CMB.1.raw
  modified_base (164)..(164): a, c, t, g, unknown or other
  misc_feature (164)..(164): n is a, c, g, or t
  modified_base (201)..(201): a, c, t, g, unknown or other
  misc_feature (201)..(201): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaattgtcttagacncagtctccagcctattcgtgtctctctctcgaggganacacgacccaccgtctcatgcgacggccagtcgaagtactatacaactatacgttcggcttaggtactactaagtaccgacgtcgtacggacccgtaacgggtcccccggacttaccgtacctacgtacgttactaggtacgttcgtaccctttaccggacggtaccggtacgggaccccgtacgtacggaccctaccgtacccgtacggacccgttaaggttaccgacggggttagggtcgggggtttacgttacgggctaacggtacggtaccttaccgtacggttactaccgtaacgtaacgtacctacggaaccgttacccgtaccccgtaaacccgtaacggttaagtaacggtttaaccgtttacggtaacccgttaaacgttttaccgttaaacgtttaacggtaccgttaaaacccgtaacgtaacccggttaacgggttaaccggttaacgttaccgggttaccgggttaccccgttacttacccgggttttaaccccgggtttacggggtaaaccgggttaacgggaaacccgggtttaaggggtccgttaaaaccgggttaacggttaaaacccggtaaacgggtaaccgttacgggtaccggttaaccccgttaagaccccggttaacctaaccgttttccgggtaacctttaacccg

SEQ ID NO: 240697 - DNA, 785 bp, Homo sapiens
  misc_feature: GYAE6OF02HHRN7.45.35.D02.1.454.CMB.1.raw
tcagacgcgatcgacacgaccggtgctcgatttagcacacgatagttgggtttgggggaggaactgctcagttaggacccagagggaaccatggaagccccagctcagcttctcttcctcctgctactctggctcccagacgacctccggagaaattgtcttgacacagtctccagccattctgtctctctctccgaggggacgacgtagccaccctctcatgcacgggccagtcaggtagtaattacgaacatactcggccttaggtactacaatacaacgtccgtaggccgaccgggtcccccggccttccctcgtactacgtagtacgtacgtcgtccttccgtacggccggtacgggaccccgtagtcggacctaccgcccgacgcccggtaggttcgtagggtcgggtcggggtttggggtttcggacgtacgtaacgtaccgttaccgtcctccgtaaccgtactaagtaccgaacgccgtaaccgtacccctaacccggtaacccgtaaggtaaacgtttacgttttacgaccgttaacgtttaccttaactttaccgttactaccgtaacggacgggttaaccgtacgtaacgggttaccgttaccgggacccgttccttacccgggttccgggtttacccggggacggggttaacccggggaaccgggttagggttacgggaaccggtaacggtaaaccgggaaaaccggttaacgtccggggttaacggtcccgttacggtaccccgaacgttaacgttccgtttacgttacccg

SEQ ID NO: 240698 - DNA, 742 bp, Homo sapiens
  misc_feature: GYAE6OF02HMC71.45.35.D02.1.454.CMB.1.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (259)..(259): a, c, t, g, unknown or other
  misc_feature (259)..(259): n is a, c, g, or t
tcagacgcgatcgacacgaccggtgctcgatttagcacacgatagttgggtttgggggaggaactgctcagttaggacccaggagggaaccagtggaagccccagctcagccttctcttcctcctgctactcctcggcccccagactaccaaccggaaaattgtgttgacacagtctccaggccaccctgtcctntgtcctccggagggatacacgcccacccctcttccgngccgacgggacctaagtaggagtcgtnaacggtaagtacgttaggacgttcgtaacgaactaaggaaaccgtcggacccgtaggccgtaccctagggtcctcccgtactaacgtcctagtcgtacttaccggacctacttaacccgaaccggccggttcccgtaccggtccgggacccccgtaaggaaccccgttagggttacccggtgggacgtaccgggggttcggttcgacgggaaccctaggtaacgttccacgtccgttccaacctaacgtccgaagcccgtaagtacccgtgagtcgtcggtagtacgtttagttcgtcgttagtttcttcgtcgtactagtgtactacgacgttaactagtcgtagttagttacgttacgtttcggaccggttacgggactaacgtacgtaaggaactaacggtaacgtacgttaggtaccggcgttacgacctaccgttgtaccgtcgttccgttacccgttaccttccggtacttacccgg

SEQ ID NO: 240699 - DNA, 811 bp, Homo sapiens
  misc_feature: GYAE6OF02JUNMZ.45.35.D02.1.454.CMB.1.raw
  modified_base (163)..(163): a, c, t, g, unknown or other
  misc_feature (163)..(163): n is a, c, g, or t
  modified_base (802)..(802): a, c, t, g, unknown or other
  misc_feature (802)..(802): n is a, c, g, or t
tcagacgcgatcgacacgaccggtgctcgatttagcacacgatagttgggtttgggggaggaactgctcagttaggacccagagggaaccatggaagccccagctcagcttctcttcctcctgctactctggctcccagagcctccggagaaattgtcttganacagtctccagacattctgtctctcgtctaccgaggggtacacacggtccacccttctacatcggacctacggggacctagtctaacggacgttattaacggaaactagtaccgtttaggaccttaggtaactacctaaattaacgaacgtaccggtacggaccccgtaacggggtacccccggtccgtaccgttacgtaaccttaccgtaagttccgtacggtacgttaccctaccggtaacgccggtaaccggggaccttaacggcgggaaccttaaccgtccccgtaaaccgggtccctaagggtttaccgaaacggggttcgggttaccggggtttacggggttttacggaacccgtaacgttacggtaacccgttttaccgaacccggttaccgtttaccgaaccgttaaagtccgtaacgtacctaccggtaccctacccgtaaccggtaacgtacgttaagtttccgaacttacggttattaaccttctaccgtaaacttagtaaccggcgttaacgtacgtaggttccgaccgtacttaccgtcccgggttaaacggcggtaaccggtcaggttacgtacgacgttaacggaaaccgtcgtacgtcggtacgtccgtaactcacggttacnggtttaacc

SEQ ID NO: 240700 - DNA, 234 bp, Homo sapiens
  misc_feature: GYAE6OF01BTWN0.40.28.C06.1.454.CMB.1.raw
  modified_base (225)..(234): a, c, t, g, unknown or other
  misc_feature (225)..(234): n is a, c, g, or t
tcagtctagcgactcacgaccggtgctcgatttagagctcacgtattgggtttgggtgccgaagttagctggaggtcaccgtctcctcagcctccaccaagggcccatcggtcttccccctggcgccctgctccaggagcacctccgagagcacagcggccctgggctgcctggtcaaggactacttccagtcgctagactgagcgggctggcaaggcgcatagnnnnnnnnnn

SEQ ID NO: 240701 - DNA, 228 bp, Homo sapiens
  misc_feature: GYAE6OF01A6MPZ.40.28.C06.1.454.CMB.1.raw
  modified_base (223)..(228): a, c, t, g, unknown or other
  misc_feature (223)..(228): n is a, c, g, or t
tcagtctagcgactcacgaccggtgctcgatttagagctcacgtattgggtttgggtgccgaagttgctggaggtcaccgtctcctcagcctccaccaagggcccatcggtcttcccctggcgccctgctccaggagcacctccgagagcacagcggccctgggctgcctggtcaaggactacttccagtcgctagactgagcgggctggcaaggcgcatagnnnnnn

SEQ ID NO: 240702 - DNA, 227 bp, Homo sapiens
  misc_feature: GYAE6OF01AL914.40.28.C06.1.454.CMB.1.raw
  modified_base (222)..(227): a, c, t, g, unknown or other
  misc_feature (222)..(227): n is a, c, g, or t
tcagtctagcgactcacgaccggtgctcgatttagagctcacgtattgggtttgggtgccgaagttgctggaggtcaccgtctcctcagcctccaccaagggcccatcggtcttcccctggcgccctgctccaggagcacctccgagagcacagcggccctgggctgcctggtcaaggactacttccagtcgctagactgagcggctggcaaggcgcatagnnnnnn

SEQ ID NO: 240703 - DNA, 231 bp, Homo sapiens
  misc_feature: GYAE6OF01B3A8H.40.28.C06.1.454.CMB.1.raw
  modified_base (219)..(219): a, c, t, g, unknown or other
  misc_feature (219)..(219): n is a, c, g, or t
  modified_base (224)..(231): a, c, t, g, unknown or other
  misc_feature (224)..(231): n is a, c, g, or t
tcagtctagcgactcacgaccggtgctcgatttagagctcacgtattgggtttgggtgccgaagttgctggaggtcaccgtctcctcagcctccaccaagggcccatcggtcttccccctggcgccctgctccaggagcacctccgagagcacagcggccctgggctgcctggtcaaggactacttccagtcgctagactgagcgggctggcaaggcgnatagnnnnnnnn

SEQ ID NO: 240704 - DNA, 574 bp, Homo sapiens
  misc_feature: GYAE6OF01D6MES.40.28.C06.1.454.CMB.1.raw
  modified_base (561)..(565): a, c, t, g, unknown or other
  misc_feature (561)..(565): n is a, c, g, or t
  modified_base (567)..(574): a, c, t, g, unknown or other
  misc_feature (567)..(574): n is a, c, g, or t
tcagtctagcgactcacgaccggtgctcgatttagagctcacgtattgggtttggggtattgggtttgggagtgccaccgacgatccatcccagccactcaggcccccggacaaaggcttgagtggctgggatggatcgtcgggtggcactcctaacataagatattcacagaagtttcagttcagagtcacctttagcagcgacacatccgcgacgacagtctacatggagttgagtggcctaagatcgtagaagacgacggctgtctatttactgtgcgagagatcgaccttacgacggacggacgggggccctagtttgattacgtgggccgacgggaccctggtcaccgtctcctcgacgcctaccgaaccgacgggccctagtccggttccctttcccccgtcggcccgcccgtcgccgtaccgacgggtacgccgacccgtaccgacgacgccgacgacggcccggtcccgtcgggcctcggtccgtacggtacgacggtacttacgtcacgtcgtactacgcgtgacggcgggtcgcggcgaggcgacagtagnnnnngnnnnnnnn

SEQ ID NO: 240705 - DNA, 233 bp, Homo sapiens
  misc_feature: GYAE6OF02HZG5Y.40.28.C06.1.454.CMB.1.raw
  modified_base (223)..(233): a, c, t, g, unknown or other
  misc_feature (223)..(233): n is a, c, g, or t
tcagtctagcgactcacgaccggtgctcgatttagagctcacgtattgggtttgggtgccgaagttgctggaggtcaccgtctcctcagcctccaccaagggcccatcggtcttcccctggcgccctgctccaggagcacctccgagagcacagcggccctgggctgcctggtcaaggactacttccagtcgctagactgagcgggctggcaaggcgcatagnnnnnnnnnnn

SEQ ID NO: 240706 - DNA, 493 bp, Homo sapiens
  misc_feature: GYAE6OF02F0R6C.40.28.C06.1.454.CMB.1.raw
  modified_base (483)..(493): a, c, t, g, unknown or other
  misc_feature (483)..(493): n is a, c, g, or t
tcagtctagcgactcacgaccggtgctcgatttagagctcacgtattgggtttggggtattgggtttgggagtgccaccgacgatccatcccagccactcaggcccccggacaaaggcttgagtggctgggatggatcgtcggtggcactcctaacataagatattcacagaagtttcagttcagagtcacctttagcagcgacacatccgcgacgacagtctacatggagttgagtggcctaagatctgaagacacggctgtctattactgtgcgagagatgccttacacgacgaggggggcccactttgattactggggccagggaaccctggtcaccgtctcctcagcctccaccaagggcccatcggtcttcccctggcgccctgctccaggagcacctccgagagcacagcggccctgggctgcctggtcaaggctacttccagtcgctagactgagcgggctggcaggcgcataggnnnnnnnnnnn

SEQ ID NO: 240707 - DNA, 234 bp, Homo sapiens
  misc_feature: GYAE6OF02FJP70.40.28.C06.1.454.CMB.1.raw
  modified_base (228)..(234): a, c, t, g, unknown or other
  misc_feature (228)..(234): n is a, c, g, or t
tcagtctagcgactcacgaccggtgctcgatttagagctcacgtattgggtttgggtgccgaagttgctggaggtcaccgtctcctcagttttcctccaccaagggcccatcggtcttccccctggcgccctgctccaggagcacctccgagagcacagcggccctgggctgcctggtcaaggactacttccagtcgctagactgagcgggctggcaaggcgcatagnnnnnnn

SEQ ID NO: 240708 - DNA, 174 bp, Homo sapiens
  misc_feature: GYAE6OF01AZP5T.18.39.D06.1.454.CMB.1.raw
  modified_base (173)..(174): a, c, t, g, unknown or other
  misc_feature (173)..(174): n is a, c, g, or t
tcagtacgagtatgcacgaccggtgctcgatttagtgacatctcgcagttcttggttgggaagagaagactgacggtcctccaggagttcaggtgctggcacagcggccctgggctgcctggtcaaggactacttcccatactcgtactgagcgggctggcaaggcgcatagnn

SEQ ID NO: 240709 - DNA, 357 bp, Homo sapiens
  misc_feature: GYAE6OF01BMXNN.18.39.D06.1.454.CMB.1.raw
  modified_base (251)..(251): a, c, t, g, unknown or other
  misc_feature (251)..(251): n is a, c, g, or t
  modified_base (280)..(280): a, c, t, g, unknown or other
  misc_feature (280)..(280): n is a, c, g, or t
  modified_base (349)..(357): a, c, t, g, unknown or other
  misc_feature (349)..(357): n is a, c, g, or t
tcagtacgagtatgcacgaccggtgctcgatttagtgacatctcgcagttctttgggtttggggaagaggaagactgacggtcctcccaggagttcaggtgctgggcaccgtgggcatggggaggtgtgtcacaagatttgggctctgggcaccgtgggcatgggggagtgtgtcacaagatttgggctctgggcaccctggtcaccgtctcctcagcttccaccaagggcccatcggtcttcccctggcnccctgctccaggagcacctctggggcacngcggccctggctgcctggtcaaggctacttcccatacctcgtactgagcgggctggcaaggcgcatagnnnnnnnnn

SEQ ID NO: 240710 - DNA, 181 bp, Homo sapiens
  misc_feature: GYAE6OF01BY0XA.18.39.D06.1.454.CMB.1.raw
  modified_base (178)..(181): a, c, t, g, unknown or other
  misc_feature (178)..(181): n is a, c, g, or t
tcagtacgagtatgcacgaccggtgctcgatttagtgacatctcgcagttcttggtttggggaagaggaagactgacggtcctcccaggagttcaggtgctgggcacagcggccctgggctgcctggtcaaggactacttcccatactcgtactgagcgggctggcaaggcgcatagnnnn

SEQ ID NO: 240711 - DNA, 226 bp, Homo sapiens
  misc_feature: GYAE6OF01B1HEI.18.39.D06.1.454.CMB.1.raw
  modified_base (222)..(226): a, c, t, g, unknown or other
  misc_feature (222)..(226): n is a, c, g, or t
tcagtacgagtatgcacgaccggtgctcgatttagtgacatctcgcagttctttgggtttggggaagaggaagactgacggtcctccaggagttcaggtgctggcaccgtgggcatggggaggtgtgtcacaagatttgggctctgggcacagcggccctgggctgcctggtcaaggactacttcccatactcgtactgagcgggctggcaaggcgcatagnnnnn

SEQ ID NO: 240712 - DNA, 187 bp, Homo sapiens
  misc_feature: GYAE6OF01B0E06.18.39.D06.1.454.CMB.1.raw
  modified_base (182)..(187): a, c, t, g, unknown or other
  misc_feature (182)..(187): n is a, c, g, or t
tcagtacgagtatgcacgaccggtgctcgatttagtgacatctcgcagttctttgggttttgggggaagaggaagactgacggtcctcccaggagttcaggtgctgggcacagcggccctgggctgcctggtcaaggactacttcccatgctcgtactgagcgggctggcaaggcgcatagnnnnnn

SEQ ID NO: 240713 - DNA, 190 bp, Homo sapiens
  misc_feature: GYAE6OF01BMQZJ.18.39.D06.1.454.CMB.1.raw
  modified_base (174)..(190): a, c, t, g, unknown or other
  misc_feature (174)..(190): n is a, c, g, or t
tcagtacgagtatgcacgaccggtgctcgatttagtgacatctcgcgagttcttgggggaagaggaagactgacggtcctcccaggagttcaggtgctgggcacagcggccctggctgcctggtcaaggactacttcccatactcgtactgagcgggctggcaaggcgcatagnnnnnnnnnnnnnnnnn

SEQ ID NO: 240714 - DNA, 175 bp, Homo sapiens
  misc_feature: GYAE6OF01D5B4L.18.39.D06.1.454.CMB.1.raw
  modified_base (175)..(175): a, c, t, g, unknown or other
  misc_feature (175)..(175): n is a, c, g, or t
tcagtacgagtatgcacgaccggtgctcgatttagtgacatctcgcagttctttgggggaagaggaagactgacggtcctcccaggagttcaggtgctgggcacagcggccctgggctgcctggtcaaggactacttcccatactcgtactgagcgggctggcaaggcgcatagn

SEQ ID NO: 240715 - DNA, 181 bp, Homo sapiens
  misc_feature: GYAE6OF01EEMSS.18.39.D06.1.454.CMB.1.raw
  modified_base (181)..(181): a, c, t, g, unknown or other
  misc_feature (181)..(181): n is a, c, g, or t
tcagtacgagtatgcacgaccggtgctcgatttagtgacatctcgcagttctttgggctctgggcaccgtgggcatggggaggtgtgtcacaagatttgggctctgggcacagcggccctggctgcctggtcaaggactacttcccatactcgtactgagcgggctggcaaggcgcatagn

SEQ ID NO: 240716 - DNA, 186 bp, Homo sapiens
  misc_feature: GYAE6OF01B0X8F.18.39.D06.1.454.CMB.1.raw
  modified_base (183)..(186): a, c, t, g, unknown or other
  misc_feature (183)..(186): n is a, c, g, or t
tcagtacgagtatgcacgaccggtgctcgatttagtgacatctcgcagttctttgggctctgggcaccgtgggcatgggggaggtgtgtcacaagatttgggctctgggcacagcggccctgggctgcctggtcaaggactacttcccatactcgtactgagcgggctggcaaggcgcatagnnnn

SEQ ID NO: 240717 - DNA, 222 bp, Homo sapiens
  misc_feature: GYAE6OF01CANTN.18.39.D06.1.454.CMB.1.raw
  modified_base (219)..(222): a, c, t, g, unknown or other
  misc_feature (219)..(222): n is a, c, g, or t
tcagtacgagtatgcacgaccggtgctcgatttagtgacatctcgcagttctttgggggaagaggaagactgacggtcctcccaggagttcaggtgctgggcaccgtgggcatgggggagtgtgtcacaagatttgggctctgggcacagcggccctgggctgcctggtcaaggactacttcccatactcgtactgagcgggctggcaaggcgcatagnnnn

SEQ ID NO: 240718 - DNA, 227 bp, Homo sapiens
  misc_feature: GYAE6OF01DDFAF.18.39.D06.1.454.CMB.1.raw
  modified_base (225)..(227): a, c, t, g, unknown or other
  misc_feature (225)..(227): n is a, c, g, or t
tcagtacgagtatgcacgaccggtgctcgatttagtgacatctcgcagttctttgggtttgggggaagaggaagactgacggtcctcccaggagttcaggtgctgggcaccgtgggcatggggaggtgtgtcacaagatttgggctctgggcacagcggccctgggctgcctggtcaaggactacttcccatactcgtactgagcgggctggcaaggcgcatagnnn

SEQ ID NO: 240719 - DNA, 227 bp, Homo sapiens
  misc_feature: GYAE6OF01CZ1ZL.18.39.D06.1.454.CMB.1.raw
  modified_base (226)..(227): a, c, t, g, unknown or other
  misc_feature (226)..(227): n is a, c, g, or t
tcagtacgagtatgcacgaccggtgctcgatttagtgacatctcgcagttctttgggttttgggggaagaggaagactgacggtcctcccaggagttcaggtgctgggcaccgtgggcatggggaggtgtgtcacaagatttgggctctgggcacagcggccctgggctgcctggtcaaggactacttcccatactcgtactgagcgggctggcaaggcgcatagnn

SEQ ID NO: 240720 - DNA, 182 bp, Homo sapiens
  misc_feature: GYAE6OF01CUZCS.18.39.D06.1.454.CMB.1.raw
  modified_base (182)..(182): a, c, t, g, unknown or other
  misc_feature (182)..(182): n is a, c, g, or t
tcagtacgagtatgcacgaccggtgctcgatttagtgacatctcgcagttctttgggttttgggggaagaggaagactgacggtcctcccaggagttcaggtgctgggcacagcggccctgggctgcctggtcaaggactacttcccatactcgtactgagcgggctggcaaggcgcatagn

SEQ ID NO: 240721 - DNA, 197 bp, Homo sapiens
  misc_feature: GYAE6OF01AEY8C.18.39.D06.1.454.CMB.1.raw
  modified_base (174)..(197): a, c, t, g, unknown or other
  misc_feature (174)..(197): n is a, c, g, or t
tcagtacgagtatgcacgaccggtgctcgatttagtgacatctcgcagttcttgggggaagaggaagactgacggtcctcccaggagttcaggtgctgggcacagcggccctgggctgcctggtcaaggactacttcccatactcgtactgagcgggctggcaaggcgcatagnnnnnnnnnnnnnnnnnnnnnnnn

SEQ ID NO: 240722 - DNA, 186 bp, Homo sapiens; identical to SEQ ID NO: 240716
  misc_feature: GYAE6OF01DW1I7.18.39.D06.1.454.CMB.1.raw
  modified_base (183)..(186): a, c, t, g, unknown or other
  misc_feature (183)..(186): n is a, c, g, or t

SEQ ID NO: 240723 - DNA, 221 bp, Homo sapiens
  misc_feature: GYAE6OF01EHMGS.18.39.D06.1.454.CMB.1.raw
  modified_base (219)..(221): a, c, t, g, unknown or other
  misc_feature (219)..(221): n is a, c, g, or t
tcagtacgagtatgcacgaccggtgctcgatttagtgacatctcgcagttctttgggggaagaggaagactgacggtcctcccaggagttcaggtgctgggcaccgtgggcatggggaggtgtgtcacaagatttgggctctgggcacagcggccctgggctgcctggtcaaggactacttcccatactcgtactgagcgggctggcaaggcgcatagnnn

SEQ ID NO: 240724 - DNA, 228 bp, Homo sapiens
  misc_feature: GYAE6OF01EQG8H.18.39.D06.1.454.CMB.1.raw
  modified_base (226)..(228): a, c, t, g, unknown or other
  misc_feature (226)..(228): n is a, c, g, or t
tcagtacgagtatgcacgaccggtgctcgatttagtgacatctcgcagttctttgggtttgggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnnn

SEQ ID NO: 240725 - DNA, 204 bp, Homo sapiens
  misc_feature: GYAE6OF01ETBWU.18.39.D06.1.454.CMB.1.raw
  modified_base (176)..(204): a, c, t, g, unknown or other
  misc_feature (176)..(204): n is a, c, g, or t
tcagtacgagtatgcacgaccggtgctcgatttagtgacatctcgcgagttctttgggggaagaggaagactgacggtcctcccaggagttcaggtgctcgggcacagcggccctgggctgcctggtcaaggactattccatactcgtactgagcgggctggcaaggcgcatacgnnnnnnnnnnnnnnnnnnnnnnnnnnnnn

SEQ ID NO: 240726 - DNA, 432 bp, Homo sapiens
  misc_feature: GYAE6OF01BM06J.18.39.D06.1.454.CMB.1.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (425)..(432): a, c, t, g, unknown or other
  misc_feature (425)..(432): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgngaatatgtggtgcaaagntggtcgttgtttgtttggccggtgaactactggggccagggcacctggtcaccgtctcctcagcttccaccaaggcccatcggtcttcccctggccgccctgctccaggacgcacctcgtgggggcacgacgcggccctgggctgcctggtcaaggactactcccatactcgtactgagcggctggcaaggcgcatagnnnnnnnn

SEQ ID NO: 240727 - DNA, 360 bp, Homo sapiens
  misc_feature: GYAE6OF01DE9JZ.18.39.D06.1.454.CMB.1.raw
  modified_base (355)..(360): a, c, t, g, unknown or other
  misc_feature (355)..(360): n is a, c, g, or t
tcagtacgagtatgcacgaccggtgctcgatttagtgacatctcgcagttctttgggttttgggggaagaggaagactgacggtcctcccaggagttcaggtgctgggcaccgtgggcatgggggaggtgtgtcacaagatttgggctctgggcaccgtgggcatgggggaggtgtgtcacaagatttgggctctgggcaccctggtcaccgtctcctcagcttccaccaagggcccatcggtcttccccctggccgccctgctccaggagcacctctggggcacagcggccctgggctgcctggtcaaggactacttcccatactcgtactgagcggctggcaaggcgcatagnnnnnn

SEQ ID NO: 240728 - DNA, 430 bp, Homo sapiens
  misc_feature: GYAE6OF01AEZWU.18.39.D06.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (425)..(430): a, c, t, g, unknown or other
  misc_feature (425)..(430): n is a, c, g, or t
tcagtacgagtatgcacgaccggtgctcgatttagtgacatctcgagtggatgggatggatgaacggtaaactgccaacacaggctatgcagaggcattccagggcagagtcaccatgaccgggaacccctccaccggcacagcctacatggagctgagcagtctgacacctgacgacacggccgtctattactgtgcgagagccgngaatatgtggtgcaaagntggtcgttgtttgttttggccggtgaactactggggccagggcaccctggtcaccgtctcctcagcttccaccaagggcccatcggtcttccccctggcgccctgctccaggagcacctctgggggcacagcggccctgggctgcctggtcaaggactacttcccatactcgtactgagcgggctggcaaggcgcatagnnnnnn

SEQ ID NO: 240729 - DNA, 183 bp, Homo sapiens
  misc_feature: GYAE6OF01A9D10.18.39.D06.1.454.CMB.1.raw
  modified_base (182)..(183): a, c, t, g, unknown or other
  misc_feature (182)..(183): n is a, c, g, or t
tcagtacgagtatgcacgaccggtgctcgatttagtgacatctcgcagttctttgggttttgggggaagaggaagactgacggtcctcccaggagttcaggtgctgggcacagcggccctgggctgcctggtcaaggactacttcccatactcgtactgagcgggctggcaaggcgcatagnn

SEQ ID NO: 240730 - DNA, 222 bp, Homo sapiens; identical to SEQ ID NO: 240717
  misc_feature: GYAE6OF01BK49Y.18.39.D06.1.454.CMB.1.raw
  modified_base (219)..(222): a, c, t, g, unknown or other
  misc_feature (219)..(222): n is a, c, g, or t

SEQ ID NO: 240731 - DNA, 179 bp, Homo sapiens
  misc_feature: GYAE6OF01CMCVQ.18.39.D06.1.454.CMB.1.raw
  modified_base (179)..(179): a, c, t, g, unknown or other
  misc_feature (179)..(179): n is a, c, g, or t
tcagtacgagtatgcacgaccggtgctcgatttagtgacatctcgcagttctttgggtttggggaagaggaagactgacggtcctcccaggagttcaggtgctgggcacagcggccctggctgcctggtcaaggactacttcccatactcgtactgagcgggctggcaaggcgcatagn

SEQ ID NO: 240732 - DNA, 433 bp, Homo sapiens
  misc_feature: GYAE6OF01DG1C3.18.39.D06.1.454.CMB.1.raw
  modified_base (227)..(227): a, c, t, g, unknown or other
  misc_feature (227)..(227): n is a, c, g, or t
  modified_base (327)..(327): a, c, t, g, unknown or other
  misc_feature (327)..(327): n is a, c, g, or t
  modified_base (356)..(356): a, c, t, g, unknown or other
  misc_feature (356)..(356): n is a, c, g, or t
  modified_base (425)..(433): a, c, t, g, unknown or other
  misc_feature (425)..(433): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaaagntggtcgttgtttgttttggccggtgaactactggggccaggggcaccctggtcaccgtctcctcagcttccaccaagggcccatcggtcctcccctggcnccctgctccaggagcacctctggggcacngcggcctgggctgcctggtcaaggctacttcccatacctcgtactgagcgggctggcaaggcgcatagnnnnnnnnn

SEQ ID NO: 240733 - DNA, 435 bp, Homo sapiens
  misc_feature: GYAE6OF01DD8C4.18.39.D06.1.454.CMB.1.raw
  modified_base (227)..(227): a, c, t, g, unknown or other
  misc_feature (227)..(227): n is a, c, g, or t
  modified_base (327)..(327): a, c, t, g, unknown or other
  misc_feature (327)..(327): n is a, c, g, or t
  modified_base (430)..(435): a, c, t, g, unknown or other
  misc_feature (430)..(435): n is a, c, g, or t
tcagtacgagtatgcacgaccggtgctcgatttagtgacatctcgagtggatgggatggatgaacggtaaactgccaacacaggctatgcagaggcattccagggcagagtcaccatgaccgggaacccctccaccggcacagcctacatggagctgagcagtctgacacctgacgacacggccgtctattactgtgcgagagccgcgaaatatgtggtgcaaaagntggtcgtttgtttgttttggccggtgaactacgtggggccagggcaccctggtcaccgtctcctcagcttccaccaaggcccatcggtcttcccctggcnccctgctccaggacgcaccgtcgtgggggcacgagcggccctgggctgcctggtcaaggctacttcccatactcgtactgagcgggctggcaaggcgcatagnnnnnn

SEQ ID NO: 240734 - DNA, 184 bp, Homo sapiens
  misc_feature: GYAE6OF01CMMM1.18.39.D06.1.454.CMB.1.raw
  modified_base (182)..(184): a, c, t, g, unknown or other
  misc_feature (182)..(184): n is a, c, g, or t
tcagtacgagtatgcacgaccggtgctcgatttagtgacatctcgcagttctttgggctctgggcaccgtgggcatggggaggtgtgtcacaagatttgggctctgggcacagcggccctgggctgcctggtcaaggactacttcccatactcgtactgagcgggctggcaaggcgcatagnnn

SEQ ID NO: 240735 - DNA, 186 bp, Homo sapiens
  misc_feature: GYAE6OF01E49O0.18.39.D06.1.454.CMB.1.raw
  modified_base (182)..(186): a, c, t, g, unknown or other
  misc_feature (182)..(186): n is a, c, g, or t
tcagtacgagtatgcacgaccggtgctcgatttagtgacatctcgcagttctttgggctctgggcaccgtgggcatggggaggtgtgtcacaagatttgggctctgggcacagcggccctgggctgcctggtcaaggactacttcccatactcgtactgagcgggctggcaaggcgcatagnnnnn

SEQ ID NO: 240736 - DNA, 182 bp, Homo sapiens; identical to SEQ ID NO: 240720
  misc_feature: GYAE6OF01AZZ2X.18.39.D06.1.454.CMB.1.raw
  modified_base (182)..(182): a, c, t, g, unknown or other
  misc_feature (182)..(182): n is a, c, g, or t

SEQ ID NO: 240737 - DNA, 188 bp, Homo sapiens
  misc_feature: GYAE6OF01DDEZ1.18.39.D06.1.454.CMB.1.raw
  modified_base (183)..(188): a, c, t, g, unknown or other
  misc_feature (183)..(188): n is a, c, g, or t
tcagtacgagtatgcacgaccggtgctcgatttagtgacatctcgcagttctttgggctctgggcaccgtgggcatgggggaggtgtgtcacaagatttgggctctgggcacagcggccctgggatgcctggtcaaggactacttcccatactcgtactgagcgggctggcaaggcgcatagnnnnnn

SEQ ID NO: 240738 - DNA, 186 bp, Homo sapiens; identical to SEQ ID NO: 240716
  misc_feature: GYAE6OF01CLTO7.18.39.D06.1.454.CMB.1.raw
  modified_base (183)..(186): a, c, t, g, unknown or other
  misc_feature (183)..(186): n is a, c, g, or t

SEQ ID NO: 240739 - DNA, 183 bp, Homo sapiens; identical to SEQ ID NO: 240729
  misc_feature: GYAE6OF01AVLI8.18.39.D06.1.454.CMB.1.raw
  modified_base (182)..(183): a, c, t, g, unknown or other
  misc_feature (182)..(183): n is a, c, g, or t

SEQ ID NO: 240740 - DNA, 183 bp, Homo sapiens
  misc_feature: GYAE6OF01CYZZU.18.39.D06.1.454.CMB.1.raw
  modified_base (180)..(183): a, c, t, g, unknown or other
  misc_feature (180)..(183): n is a, c, g, or t
tcagtacgagtatgcacgaccggtgctcgatttagtgacatctcgcagttctttgggtttgggggaagaggaagactgacggtcctcccaggagttcaggtgctgggcacagcggccctggctgcctggtcaaggactacttcccatactcgtactgagcgggctggcaaggcgcatagnnnn

SEQ ID NO: 240741 - DNA, 185 bp, Homo sapiens
  misc_feature: GYAE6OF01C6Y0Q.18.39.D06.1.454.CMB.1.raw
  modified_base (175)..(185): a, c, t, g, unknown or other
  misc_feature (175)..(185): n is a, c, g, or t
tcagtacgagtatgcacgaccggtgctcgatttagtgacatctcgcagttctttgggggaagaggaagactgacggtcctcccaggagttcaggtgctgggcacagcggccctgggctgcctggtcaaggactacttcccatactcgtactgagcgggctggcaaggcgcatagnnnnnnnnnnn

SEQ ID NO: 240742 - DNA, 184 bp, Homo sapiens
  misc_feature: GYAE6OF01C4RX5.18.39.D06.1.454.CMB.1.raw
  modified_base (182)..(184): a, c, t, g, unknown or other
  misc_feature (182)..(184): n is a, c, g, or t
tcagtacgagtatgcacgaccggtgctcgatttagtgacatctcgcagttctttgggttttgggggaagaggaagactgacggtcctcccaggagttcaggtgctgggcacagcggccctgggctgcctggtcaaggactacttcccatactcgtactgagcgggctggcaaggcgcatagnnn

SEQ ID NO: 240743 - DNA, 181 bp, Homo sapiens
  misc_feature: GYAE6OF01EGNAY.18.39.D06.1.454.CMB.1.raw
  modified_base (181)..(181): a, c, t, g, unknown or other
  misc_feature (181)..(181): n is a, c, g, or t
tcagtacgagtatgcacgaccggtgctcgatttagtgacatctcgcagttctttgggtttgggggaagaggaagactgacggtcctcccaggagttcaggtgctgggcacagcggccctgggctgcctggtcaaggactacttcccatactcgtactgagcgggctggcaaggcgcatagn

SEQ ID NO: 240744 - DNA, 433 bp, Homo sapiens
  misc_feature: GYAE6OF01D0UE1.18.39.D06.1.454.CMB.1.raw
  modified_base (226)..(226): a, c, t, g, unknown or other
  misc_feature (226)..(226): n is a, c, g, or t
  modified_base (427)..(433): a, c, t, g, unknown or other
  misc_feature (427)..(433): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagntggtcgttgtttgtttggccggtgaactactggggccagggcaccctggtcaccgtctcctcagcttccaccaagggcccatcggtcttccccctggcgccctgctccaggagcacctctgggggcacagcggccctgggctgcctggtcaagggactacgttcccatactcgtactgagcgggctggcaaggcgcatagnnnnnnn

SEQ ID NO: 240745 - DNA, 428 bp, Homo sapiens
  misc_feature: GYAE6OF01ASO7L.18.39.D06.1.454.CMB.1.raw
  modified_base (226)..(226): a, c, t, g, unknown or other
  misc_feature (226)..(226): n is a, c, g, or t
  modified_base (419)..(428): a, c, t, g, unknown or other
  misc_feature (419)..(428): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccgacacagcctacatggagctgagcagtctgacacctgacgacacggccgtctattactgtgcgagagccgcgaatatgtggtgcaaagntggtcgttgtttgtttggccggtgaactactggggccagggcaccctggtcaccgtctcctcagcttccaccaagggcccatcggtcttccccctggcgccctgctccaggagcacctctgggggcacagcggcctgggctgcctggcaggctactcccatctcgtactgagcgggctggcaaggcgcatagnnnnnnnnnn

SEQ ID NO: 240746 - DNA, 353 bp, Homo sapiens
  misc_feature: GYAE6OF01BZNPQ.18.39.D06.1.454.CMB.1.raw
  modified_base (344)..(353): a, c, t, g, unknown or other
  misc_feature (344)..(353): n is a, c, g, or t
tcagtacgagtatgcacgaccggtgctcgatttagtgacatctcgcagttctttgggggaagaggaagactgacggtcctcccaggagttcaggtgctgggcaccgtgggcatgggggaggtgtgtcacaagatttgggctctgggcaccgtgggcagtgggggaggtgtgtcacaagatttgggccagggcaccctggtcaccgtctcctcagcttccaccaagggcccatcggtctcccctggcgccctgctccaggagcacctctggggcacagcggcctgggctgcctggtcaaggctacttcccatactcgtactgagcgggctggcaaggcgcatagnnnnnnnnnn

SEQ ID NO: 240747 - DNA, 552 bp, Homo sapiens
  misc_feature: GYAE6OF01DLW1Z.18.39.D06.1.454.CMB.1.raw
  modified_base (346)..(346): a, c, t, g, unknown or other
  misc_feature (346)..(346): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggacccctcaccggcacagcctacatggagctgagcagtctgacacctgacgacacggccgtctattactgtgcgagagccgcgaatatgtggtgcaaagntggtcgttgtttgttttggccggttgaactacgtggggccagggcaccctggtcaccgtctcctcagcttccaccaaggcccatccggtcttcccctggccgcccctgctccaggacgcacctccgtggggccacgacggccggcccgtggggccctcggtcccgttgggtccaaacgggacccttaccttcccccgagttacccg

SEQ ID NO: 240748 - DNA, 536 bp, Homo sapiens
  misc_feature: GYAE6OF01CULGP.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgatcgggaaccctccaccggcacagcctacatggagctgagcagtctgacacctgacgacacggccgtctattactgtgcgagagccgcgaatatgtggtgcaaagatggtcgttgtttgttttggccggtgactacgtggggcagggcaccctggtcaccgtctcctcagcttccaccaggcccatccggtcttccccctcggccgccctgcctcccacggacgcaccctcgtcgggggccacgacgccggcccgtcgggcctggcccgtggtcaaggacctacgttcccgtaac

SEQ ID NO: 240749 - DNA, 555 bp, Homo sapiens
  misc_feature: GYAE6OF01BDFMN.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccgtgactctgggccagggcaccctggtcaccgtctcctcacgcttccaccaagggcccagtccggtccttccccctggccgcccctcgcctccacggacgccacccgtcgtcgggggccaccgacggccggccccgtggggcctggcccgtcgggtccaagggaccttaccttccccgagttacccg

SEQ ID NO: 240750 - DNA, 266 bp, Homo sapiens
  misc_feature: GYAE6OF01BY982.18.39.D06.1.454.CMB.1.raw
  modified_base (189)..(190): a, c, t, g, unknown or other
  misc_feature (189)..(190): n is a, c, g, or t
  modified_base (192)..(194): a, c, t, g, unknown or other
  misc_feature (192)..(194): n is a, c, g, or t
  modified_base (197)..(198): a, c, t, g, unknown or other
  misc_feature (197)..(198): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (205)..(266): a, c, t, g, unknown or other
  misc_feature (205)..(266): n is a, c, g, or t
tcagtacgagtatgcacgaccggtgctcgatttagtgacatctcgcgagttctttgggttttggggggaagaggaagactcgacggtccgtcccaggagttccaggtgctgggcacagcggccctgggctgcctggtcaaggactacttcccatacctcgtactgagcgggctggcaaggcgcatagcnntnnnganncnctncnnnnnnnnnnnnnnnnnnnnnnnnnnnnnnnnnnnnnnnnnnnnnnnnnnnnnnnnnnnnnn

SEQ ID NO: 240751 - DNA, 182 bp, Homo sapiens
  misc_feature: GYAE6OF01AO9BA.18.39.D06.1.454.CMB.1.raw
  modified_base (181)..(182): a, c, t, g, unknown or other
  misc_feature (181)..(182): n is a, c, g, or t
tcagtacgagtatgcacgaccggtgctcgatttagtgacatctcgcagttctttgggtttgggggaagaggaagactgacggtcctcccaggagttcaggtgctgggcacagcggccctgggctgcctggtcaaggactacttcccatactcgtactgagcgggctggcaaggcgcatagnn

SEQ ID NO: 240752 - DNA, 356 bp, Homo sapiens
  misc_feature: GYAE6OF01C0LJF.18.39.D06.1.454.CMB.1.raw
  modified_base (349)..(356): a, c, t, g, unknown or other
  misc_feature (349)..(356): n is a, c, g, or t
tcagtacgagtatgcacgaccggtgctcgatttagtgacatctcgcagttctttgggggaagaggaagactgacggtcctcccaggagttcaggtgctgggcaccgtgggcatgggggaggtgtgtcacaagatttcggctctgggcaccgtgggcatgggggaggtgtgtcacaagatttgggccagggcaccctggtcaccgtctcctcagcttccaccaagggcccatcggtcttccccctggcgccctgctcccaggacgcacctctgggggcacagcggccctgggctgcctggtcaaggctacttcccatactcgtactgagcgggctggcaaggcgcatagnnnnnnnn

SEQ ID NO: 240753 - DNA, 435 bp, Homo sapiens
  misc_feature: GYAE6OF01D5NEQ.18.39.D06.1.454.CMB.1.raw
  modified_base (226)..(226): a, c, t, g, unknown or other
  misc_feature (226)..(226): n is a, c, g, or t
  modified_base (422)..(422): a, c, t, g, unknown or other
  misc_feature (422)..(422): n is a, c, g, or t
  modified_base (428)..(435): a, c, t, g, unknown or other
  misc_feature (428)..(435): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagntggtcgttgtttgtttggccggtgaactactggggccagggcaccctggtcaccgtctcctcagcttccaccaagggcccatcggtccttcccctggccgccctgctccaggagcacctcgtgggggcacgagcggccctgggctgcctggtcaaggactacttcccatactcgtactgagcgggctggcaaggcncatagnnnnnnnn

SEQ ID NO: 240754 - DNA, 410 bp, Homo sapiens
  misc_feature: GYAE6OF01ENS9O.18.39.D06.1.454.CMB.1.raw
  modified_base (399)..(410): a, c, t, g, unknown or other
  misc_feature (399)..(410): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcatgggggagtgtgtcacaagatttgggatctgggcaccgtgggcatgggggagtgtgtacaagattggtcgtctggcgaccctcggtgaccgtctcctcagctcctaccaaggaccgactcggtccgttccccctccggcgcccctcgcgtccaggacgcacctatgggggccgacagcggcccgtcgggcgtcgccgtcggtccgaaaggaaccgttacctttccccgtaactaacgttccgtactcggaggcggggcctggcaaaggcggccagtagnnnnnnnnnnnn

SEQ ID NO: 240755 - DNA, 488 bp, Homo sapiens
  misc_feature: GYAE6OF01ENVLA.18.39.D06.1.454.CMB.1.raw
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
  modified_base (476)..(488): a, c, t, g, unknown or other
  misc_feature (476)..(488): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgngaaatatgtggtgcaaaagntgggtcgtttgttttgttttggcggtgaactacgtgggccagggcaccgtggtcaccgtctcctcagcttccaccaacggcccatccggtccttccccctggccgccctcgcctccaggacgccaccgtcgtgggggccacgacggccggcccgtggggcctcggccgttgggtaccaaacgggtaccttaccttcccaacttaccgtcgtacgttgaggccgggtctgggccgaaggcgcagtacgnnnnnnnnnnnnn

SEQ ID NO: 240756 - DNA, 198 bp, Homo sapiens
  misc_feature: GYAE6OF01DYZ3Z.18.39.D06.1.454.CMB.1.raw
  modified_base (182)..(198): a, c, t, g, unknown or other
  misc_feature (182)..(198): n is a, c, g, or t
tcagtacgagtatgcacgaccggtgctcgatttagtgacatctcgcgagttctttgggctctgggcaccgtgggcatgggggaggtgtgtcacaagatttgggctctgggcacagcggcctgggctgcctggtcaaggctacttcccatactcgtactgagcgggctggcaaggcgcatagnnnnnnnnnnnnnnnnn

SEQ ID NO: 240757 - DNA, 431 bp, Homo sapiens
  misc_feature: GYAE6OF01B25BQ.18.39.D06.1.454.CMB.1.raw
  modified_base (225)..(225): a, c, t, g, unknown or other
  misc_feature (225)..(225): n is a, c, g, or t
  modified_base (424)..(431): a, c, t, g, unknown or other
  misc_feature (424)..(431): n is a, c, g, or t
tcagtacgagtatgcacgaccggtgctcgatttagtgacatctcgagtggatgggatggatgaacggtaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagntgggtcgttgtttgttttggccggtgaactactggggccaggggcaccctggtcaccgtctcctcagcttccaccaagggcccatcggtcttcccctgcgccctgctccaggagcacctctgggggcacagcggccctgggctgcctggtcaaggctacttcccatactcgtactgagcgggctggcaaggcgcatagnnnnnnnn

SEQ ID NO: 240758 - DNA, 182 bp, Homo sapiens; identical to SEQ ID NO: 240720
  misc_feature: GYAE6OF01CBT6R.18.39.D06.1.454.CMB.1.raw
  modified_base (182)..(182): a, c, t, g, unknown or other
  misc_feature (182)..(182): n is a, c, g, or t

SEQ ID NO: 240759 - DNA, 542 bp, Homo sapiens
  misc_feature: GYAE6OF01EF7GL.18.39.D06.1.454.CMB.1.raw
  modified_base (446)..(446): a, c, t, g, unknown or other
  misc_feature (446)..(446): n is a, c, g, or t
tcagtacgagtatgcacgaccggtgctcgatttagtgacatctcgcagttctttgggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgacaaagatggtcgttgtttgttttggccggtgaactacgtgggccaggacaccctggtcaccgtctcctcagcttccaccaagggcccatcggtccttccccnggccgccctgctccaggacgccacctctcggggccacgacggccggccctggggcctcggccctgggtccaacggtacctaccttcccattacccg

SEQ ID NO: 240760 - DNA, 430 bp, Homo sapiens
  misc_feature: GYAE6OF01BM210.18.39.D06.1.454.CMB.1.raw
  modified_base (422)..(430): a, c, t, g, unknown or other
  misc_feature (422)..(430): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaaagtggtcgttgtttgtttggccggtgaactactggggccagggcaccctggtcaccgtctcctcagcttccaccaagggcccatcggtcttcccctggcgccctgctccaggagcacctctgggggcacagcggcctgggctgcctggtcaaggactacttcccatactcgtactgagcggctggcaaggcgcatagnnnnnnnnn

SEQ ID NO: 240761 - DNA, 427 bp, Homo sapiens
  misc_feature: GYAE6OF01DR8SX.18.39.D06.1.454.CMB.1.raw
  modified_base (421)..(427): a, c, t, g, unknown or other
  misc_feature (421)..(427): n is a, c, g, or t
tcagtacgagtatgcacgaccggtgctcgatttagtgacatctcgagtggatgggatggatgaacggtaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcacgtctcctcagcttcaccaagggcccatcggtcttccccctggcgccctgctccaggagcacctctgggggcacagcggccctgggctgcctggtcaaggctacttcccatactcgtactgagcgggctggcaaggcgcatagnnnnnnn

SEQ ID NO: 240762 - DNA, 428 bp, Homo sapiens
  misc_feature: GYAE6OF01DRCSG.18.39.D06.1.454.CMB.1.raw
  modified_base (225)..(225): a, c, t, g, unknown or other
  misc_feature (225)..(225): n is a, c, g, or t
  modified_base (426)..(428): a, c, t, g, unknown or other
  misc_feature (426)..(428): n is a, c, g, or t
tcagtacgagtatgcacgaccggtgctcgatttagtgacatctcgagtggatgggatggatgaacggtaaactgccaacacaggctatgcagaggcattccagggcagagtcaccatgaccgggaacccctccaccggcacagcctacatggagctgagcagtctgacacctgacgacacggcctctattactgtgcgagagccgcgaatatgtggtgcaaaagntggtcgtttgtttgtttggccggtgaactactggggccagggcaccctggtcaccgtctcctcagcttccaccaagggcccatcggtcttccccctggcgccctgctccaggagcacctctgggggcacgagcggccctgggctgcctggtcaaggactacttcccatactcgtactgagcgggctggcaaggcgcatagnnn

SEQ ID NO: 240763 - DNA, 187 bp, Homo sapiens
  misc_feature: GYAE6OF01CBNE3.18.39.D06.1.454.CMB.1.raw
  modified_base (183)..(187): a, c, t, g, unknown or other
  misc_feature (183)..(187): n is a, c, g, or t
tcagtacgagtatgcacgaccggtgctcgatttagtgacatctcgcagttctttgggctctgggcaccgtgggcatgggggaggtgtgtcacaagatttgggctctgggcacagcggccctgggctgcctggtcaaggactacttcccatactcgtactgagcgggctggcaaggcgcatagnnnnn

SEQ ID NO: 240764 - DNA, 474 bp, Homo sapiens
  misc_feature: GYAE6OF01DHHSG.18.39.D06.1.454.CMB.1.raw
  modified_base (228)..(228): a, c, t, g, unknown or other
  misc_feature (228)..(228): n is a, c, g, or t
  modified_base (461)..(474): a, c, t, g, unknown or other
  misc_feature (461)..(474): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatggtggtgcaaaagntggtcgttgttttgtttggccggtgaactacgtggggccagggcacctggtcaccgtctcctcacgccttccaccaacgggcccatccggtccttcccccgtggccgcccctgcctcccgaggacgccaccgtcgtcgggggcacgacgccggcccgtgggctcgccgtggtcaacggtacctaccttcccaattacctcgtactggacgcgggctggcgaaggcgcagtagnnnnnnnnnnnnnn

SEQ ID NO: 240765 - DNA, 350 bp, Homo sapiens
  misc_feature: GYAE6OF01ALH1W.18.39.D06.1.454.CMB.1.raw
  modified_base (346)..(350): a, c, t, g, unknown or other
  misc_feature (346)..(350): n is a, c, g, or t
tcagtacgagtatgcacgaccggtgctcgatttagtgacatctcgcagttctttgggggaagaggaagactgacggtcctcccaggagttcaggtgctgggcaccgtgggcatgggggaggtgtgtcacaagatttgggctctgggcaccgtgggcatgggggaggtgtgtcacaagatttgggccagggcaccctggtcaccgtctcctcagcttccaccaagggcccatcggtcttcccctggcgccctgctccaggagcacctctgggggcacagcggccctgggctgcctggtcaaggctacttcccatactcgtactgagcgggctggcaaggcgcatagnnnnn

SEQ ID NO: 240766 - DNA, 362 bp, Homo sapiens
  misc_feature: GYAE6OF01BJYRP.18.39.D06.1.454.CMB.1.raw
  modified_base (356)..(362): a, c, t, g, unknown or other
  misc_feature (356)..(362): n is a, c, g, or t
tcagtacgagtatgcacgaccggtgctcgatttagtgacatctcgcagttctttgggttttgggggaagaggaagactgacggtcctcccaggagttcaggtgctgggcaccgtgggcatgggggaggtgtgtcacaagatttgggctctgggcaccgtgggcatgggggaggtgtgtcacaagatttgggctctgggcaccctggtcaccgtctcctcagcttccaccaagggcccatcggtcttcccctggccgccctgctccaggagcacctctgggggcacagcggccctgggctgcctggtcaaggactacttcccatactcgtactgagcgggctggcaaggcgcatagnnnnnnn

SEQ ID NO: 240767 - DNA, 430 bp, Homo sapiens
  misc_feature: GYAE6OF01C9WVU.18.39.D06.1.454.CMB.1.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (423)..(430): a, c, t, g, unknown or other
  misc_feature (423)..(430): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtncaaagntggtcgttgtttgtttggccggtgaactactggggccagggcacctggtcacgtctcctcagcttccaccaagggcccatcggtcttccccctggccgccctgctccaggagcacctctgggggcacagcggcctgggctgcctggtcaaggctacttcccatactcgtactgagcgggctgggcaaggcgcatagnnnnnnnn

SEQ ID NO: 240768 - DNA, 349 bp, Homo sapiens
  misc_feature: GYAE6OF01EN652.18.39.D06.1.454.CMB.1.raw
  modified_base (344)..(349): a, c, t, g, unknown or other
  misc_feature (344)..(349): n is a, c, g, or t
tcagtacgagtatgcacgaccggtgctcgatttagtgacatctcgcagttctttgggggaagaggaagactgacggtcctcccaggagttcaggtgctgggcaccgtgggcatgggggaggtgtgtcacaagatttgggctctgggcaccgtgggcatgggggaggtgtgtcacaagatttgggccagggcaccctggtcaccgtctcctcagcttccaccaagggcccatcggtcttcccctggcgccctgctccaggagcacctctggggcacagcggccctgggctgcctggtcaaggactactcccatactcgtactgagcggctggcaaggcgcatagnnnnnn

SEQ ID NO: 240769 - DNA, 431 bp, Homo sapiens
  misc_feature: GYAE6OF01EF1FL.18.39.D06.1.454.CMB.1.raw
  modified_base (226)..(226): a, c, t, g, unknown or other
  misc_feature (226)..(226): n is a, c, g, or t
  modified_base (423)..(431): a, c, t, g, unknown or other
  misc_feature (423)..(431): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagntggtcgttgtttgtttggcggtgaactactggggccagggcaccctggtcaccgtctcctcagcttccaccaagggcccatcggtcttcccctggcgccctgctccaggagcacctcgtgggggcacgagcggccctgggctgcctggtcaaggctactcccatactcgtactgagcgggctggcaaggcgcatagnnnnnnnnn

SEQ ID NO: 240770 - DNA, 353 bp, Homo sapiens
  misc_feature: GYAE6OF01D5AUW.18.39.D06.1.454.CMB.1.raw
  modified_base (347)..(353): a, c, t, g, unknown or other
  misc_feature (347)..(353): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggaggtgtgtcacaagatttgggctctgggcaccgtgggcatgggggaggtgtgtcacaagatttgggccagggcaccctggtcaccgtctcctcagcttccaccaagggcccatcggtcttcccctggcgccctgctccaggagcacctctggggcacagcggccctgggctgcctggtcaaggactacttcccatactcgtactgagcgggctggcaaggcgcatagnnnnnnn

SEQ ID NO: 240771 - DNA, 432 bp, Homo sapiens
  misc_feature: GYAE6OF01CJCVR.18.39.D06.1.454.CMB.1.raw
  modified_base (227)..(227): a, c, t, g, unknown or other
  misc_feature (227)..(227): n is a, c, g, or t
  modified_base (424)..(432): a, c, t, g, unknown or other
  misc_feature (424)..(432): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaaagntggtcgttgtttgtttggccggtgaactactggggccagggcacctggtcaccgtctcctcagcttccaccaagggcccatcggtcttcccctggcgccctgctccaggacgcacctctgggggcacagcggccctgggctgcctggtcaaggctacttcccatactcgtactgagcgggctggcaaggcgcatagnnnnnnnnn

SEQ ID NO: 240772 - DNA, 178 bp, Homo sapiens
  misc_feature: GYAE6OF01A1O3T.18.39.D06.1.454.CMB.1.raw
  modified_base (175)..(178): a, c, t, g, unknown or other
  misc_feature (175)..(178): n is a, c, g, or t
tcagtacgagtatgcacgaccggtgctcgatttagtgacatctcgcagttctttgggggaagaggaagactgacggtcctcccaggagttcaggtgctgggcacagcggccctgggctgcctggtcaaggactacttcccatactcgtactgagcgggctggcaaggcgcatagnnnn

SEQ ID NO: 240773 - DNA, 384 bp, Homo sapiens
  misc_feature: GYAE6OF01D6PC9.18.39.D06.1.454.CMB.1.raw
  modified_base (350)..(350): a, c, t, g, unknown or other
  misc_feature (350)..(350): n is a, c, g, or t
  modified_base (357)..(360): a, c, t, g, unknown or other
  misc_feature (357)..(360): n is a, c, g, or t
  modified_base (362)..(384): a, c, t, g, unknown or other
  misc_feature (362)..(384): n is a, c, g, or t
tcagtacgagtatgcacgaccggtgctcgatttagtgacatctcgcgaggttctttgggggaagaggaagactgacggtcctcccaggagttcgaggtgctgggcaccgtgggcatgggggaggtgtgtcacaagatttgggctctgggcaccgtgggcagtgggggaggtgtgtcacaagatttgggccagggcaccctggtcaccgtctcctcagcttccaccaagggcccatcggtcttccccctggcgccctgctccaggagcacctctgggggcaccagcggccctgggctgcctggtcaaggctacttcccagtacctcggtacctgacgcggctggcaaggcncatagcnnnncnnnnnnnnnnnnnnnnnnnnnnn

SEQ ID NO: 240774 - DNA, 550 bp, Homo sapiens
  misc_feature: GYAE6OF01BV1E3.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaaatatgtggtgcaaaagatggtcgtttgtttgttttggccggtgaactacgtgggccagggcacccgtggtcaccgtctcctcagcttccaccaaggccccatccggtccttcccctcggccgcccctgccttccaggcgccaccgtccgtgggggccacgacgccgggccctcggggctcgcccgtggtccaagggacctaccttccccagtacccg

SEQ ID NO: 240775 - DNA, 448 bp, Homo sapiens
  misc_feature: GYAE6OF01EG20T.18.39.D06.1.454.CMB.1.raw
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (324)..(324): a, c, t, g, unknown or other
  misc_feature (324)..(324): n is a, c, g, or t
  modified_base (439)..(448): a, c, t, g, unknown or other
  misc_feature (439)..(448): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtnacaaagntggtcgtttgtttgttttggccggtgaactactggggccagggcacctggtcaccgtctcctcagcttccaccgagggccatcgtcttcccctggcnccctgctccaggagcacctcgtgggggcacgaggccggcccgtggggcctcggccgtggtccaaggacctacttcccatactcgtactggacgcgggctggcgaaggcgcatagnnnnnnnnnn

SEQ ID NO: 240776 - DNA, 351 bp, Homo sapiens
  misc_feature: GYAE6OF01CDLGB.18.39.D06.1.454.CMB.1.raw
  modified_base (347)..(351): a, c, t, g, unknown or other
  misc_feature (347)..(351): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggagtgtgtcacaagatttgggctctgggcaccgtgggcatgggggaggtgtgtcacaagatttgggccagggcaccctggtcaccgtctcctcagcttccaccaagggcccatcggtcttccccctggcgccctgctccaggagcacctctgggggcacagcggccctgggctgcctggtcaaggactacttcccatactcgtactgagcggctggcaaggcgcatagnnnnn

SEQ ID NO: 240777 - DNA, 252 bp, Homo sapiens
  misc_feature: GYAE6OF01C23OF.18.39.D06.1.454.CMB.1.raw
  modified_base (158)..(158): a, c, t, g, unknown or other
  misc_feature (158)..(158): n is a, c, g, or t
  modified_base (177)..(177): a, c, t, g, unknown or other
  misc_feature (177)..(177): n is a, c, g, or t
  modified_base (185)..(186): a, c, t, g, unknown or other
  misc_feature (185)..(186): n is a, c, g, or t
  modified_base (188)..(188): a, c, t, g, unknown or other
  misc_feature (188)..(188): n is a, c, g, or t
  modified_base (192)..(252): a, c, t, g, unknown or other
  misc_feature (192)..(252): n is a, c, g, or t
tcagtacgagtatgcacgaccggtgctcgatttagtgacatctcgcaggttctttgggctctgggtcaccgtgggcatgggggagtgtgtcacaagatttgggctctgggcacagcggccctgggctgcctggtcaaggctacttcccatactgtacngagcgggctggcaaggcgnagtagcgnngngcgnnnnnnnnnnnnnnnnnnnnnnnnnnnnnnnnnnnnnnnnnnnnnnnnnnnnnnnnnnnnn

SEQ ID NO: 240778 - DNA, 429 bp, Homo sapiens
  misc_feature: GYAE6OF01BPB78.18.39.D06.1.454.CMB.1.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (338)..(338): a, c, t, g, unknown or other
  misc_feature (338)..(338): n is a, c, g, or t
  modified_base (417)..(417): a, c, t, g, unknown or other
  misc_feature (417)..(417): n is a, c, g, or t
  modified_base (423)..(429): a, c, t, g, unknown or other
  misc_feature (423)..(429): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtncaaagntggtcgttgtttgtttggccggtgaactactggggccagggcacctggtcaccgtctcctcagcttccaccaagggcccatccggtcttccccctggcgccctgctccaggngcacctcgtgggggcacgagcggccctgggctgcctggtcaaggactactccatactcgtactgagcggctggcaggcncatagnnnnnnn

SEQ ID NO: 240779 - DNA, 500 bp, Homo sapiens
  misc_feature: GYAE6OF01BZABA.18.39.D06.1.454.CMB.1.raw
  modified_base (232)..(232): a, c, t, g, unknown or other
  misc_feature (232)..(232): n is a, c, g, or t
  modified_base (480)..(500): a, c, t, g, unknown or other
  misc_feature (480)..(500): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctggagcagtctgacacctgacgacacggccgtctattactgtgcgagacgccgacgaatatggtggtgacaaaagntggttcgtttgttttgtttggccggtgaactacgtgggccgagggccaccgtggtcaccgtctcctcagtccttccaccgaacgggcccagtcggtccttcccccgtggccgccctgcctccgaggacgccacctcggtgggggccacgacggccggcccgtggggcctcgccgtggtacaagggtaccttaccttcccatacctccgtactggacggccgggtctggacgaacgggccgacagtagnnnnnnnnnnnnnnnnnnnnn

SEQ ID NO: 240780 - DNA, 427 bp, Homo sapiens
  misc_feature: GYAE6OF01CGCR9.18.39.D06.1.454.CMB.1.raw
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (317)..(317): a, c, t, g, unknown or other
  misc_feature (317)..(317): n is a, c, g, or t
  modified_base (417)..(427): a, c, t, g, unknown or other
  misc_feature (417)..(427): n is a, c, g, or t
tcagtacgagtatgcacgaccggtgctcgatttagtgacatctcgagtggatgggatggatgaacggtaaactgccaacacaggctatgcagaggcattccagggcagagtcaccatgaccgggaacccctcaccggcacagcctacatggagctgagcagtctgacacctgacgacacggccgtctattactgtgcgagagccgngaatatgtggtgcaaaagntggtcgttgtttgtttgccggtgactactgggcagggcacctggtcaccgtctcctcagcttccaccaagggcccatcggtctcccctggcncctgctccaggagcactctgggggcacacgcggccctgggctgcctggtcaaggactacttcccatacctcgtactgagcgggctggcaaggcgcatagnnnnnnnnnnn

SEQ ID NO: 240781 - DNA, 204 bp, Homo sapiens
  misc_feature: GYAE6OF01A79UW.18.39.D06.1.454.CMB.1.raw
  modified_base (184)..(204): a, c, t, g, unknown or other
  misc_feature (184)..(204): n is a, c, g, or t
tcagtacgagtatgcacgaccggtgctcgatttagtgacatctcgcaggttctttgggctctgggcaccgtgggcatgggggaggtgtgtcacaagatttgggctctgggcacagcggccctgggctgcctggtcaaggactacttcccatactcgtactgagcgggctggcaaggcgcatagnnnnnnnnnnnnnnnnnnnnn

SEQ ID NO: 240782 - DNA, 376 bp, Homo sapiens
  misc_feature: GYAE6OF01BU9Q2.18.39.D06.1.454.CMB.1.raw
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (352)..(352): a, c, t, g, unknown or other
  misc_feature (352)..(352): n is a, c, g, or t
  modified_base (357)..(376): a, c, t, g, unknown or other
  misc_feature (357)..(376): n is a, c, g, or t
tcagtacgagtatgcacgaccggtgctcgatttagtgacatctcgcaggttctttgggggaagaggaagactgacggtcctcccaggagttcaggtgctgggcaccgtgggcatgggggaggtgtgtcacaagatttgggctctgggcaccgtgggcatgggggagtgtgtcacaagatttgggccagggcaccctggtccaccgtctcctcagcttccaccaagggcccatcggtcttcccctggcnccctgctccaggacncacctcgtgggggaccacgagcggccctgggctgcctggtcaaggctacttccccgatacctcgtactgacgcgggctggcaaggccgnatagnnnnnnnnnnnnnnnnnnnn

SEQ ID NO: 240783 - DNA, 221 bp, Homo sapiens
  misc_feature: GYAE6OF01CWE0N.18.39.D06.1.454.CMB.1.raw
  modified_base (189)..(221): a, c, t, g, unknown or other
  misc_feature (189)..(221): n is a, c, g, or t
tcagtacgagtatgcacgaccggtgctcgatttagtgacatctcggacgacgttctttagggttttggggggaagacggaagactgaacggtccctcccaggagttcaggtgctggcacagcggcctgggctgccttggtcaaggctacttcccatactcgtactgagcgggctggcaaggcgcatagnnnnnnnnnnnnnnnnnnnnnnnnnnnnnnnnn

SEQ ID NO: 240784 - DNA, 177 bp, Homo sapiens
  misc_feature: GYAE6OF01D6GEL.18.39.D06.1.454.CMB.1.raw
  modified_base (176)..(177): a, c, t, g, unknown or other
  misc_feature (176)..(177): n is a, c, g, or t
tcagtacgagtatgcacgaccggtgctcgatttagtgacatctcgcagttctttggggggaagaggaagactgacggtcctcccaggagttcaggtgctgggcacagcggccctgggctgcctggtcaaggactacttcccatactcgtactgagcgggctggcaaggcgcatagnn

SEQ ID NO: 240785 - DNA, 362 bp, Homo sapiens
  misc_feature: GYAE6OF01DT9R6.18.39.D06.1.454.CMB.1.raw
  modified_base (355)..(362): a, c, t, g, unknown or other
  misc_feature (355)..(362): n is a, c, g, or t
tcagtacgagtatgcacgaccggtgctcgatttagtgacatctcgcagttctttgggttttgggggaagaggaagactgacggtcctcccaggagttcaggtgctgggcaccgtgggcatggggaggtgtgtcacaagatttgggctctgggcaccgtgggcatgggggaggtgtgtcacaagatttgggctctgggcaccctggtcaccgtctcctcagcttccaccaagggcccatcggtcttcccctggcgcccctgctccaggagcacctctgggggcacagcggccctgggctgcctggtcaaggactacttcccatactcgtactgagcgggctggcaaggcgcatagnnnnnnnn

SEQ ID NO: 240786 - DNA, 483 bp, Homo sapiens
  misc_feature: GYAE6OF01CYH86.18.39.D06.1.454.CMB.1.raw
  modified_base (197)..(197): a, c, t, g, unknown or other
  misc_feature (197)..(197): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
  modified_base (403)..(403): a, c, t, g, unknown or other
  misc_feature (403)..(403): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (469)..(483): a, c, t, g, unknown or other
  misc_feature (469)..(483): n is a, c, g, or t
tcagtacgagtatgcacgaccggtgctcgatttagtgacatctcgagtggatggggatggatgaacggtaaaactgccaacacagggctatgcagaggcattccagggcagagtcaccatgaccgggaacccctcaccggcacagcctacatggagctgagcagtctgacacctgacgacacggcctctatactggngcgaagcgccggataaatgtggtggcgacaaaaaggtgttggggttcgttttggttttggttttcggggacccggttagaaaccgtcgggtcggggccgaagggccacccgtggtccaccgtctccttcgacgcctccaacgaacggcccatcggtccttcccngccgcctgcncgaggacgccactcggnggggcagcgtcgcgnggctcgctggacaggtactactaccatccgtcgtacnggagcggngnggacgaaggcgactagagnnnnnnnnnnnnnnn

SEQ ID NO: 240787 - DNA, 384 bp, Homo sapiens
  misc_feature: GYAE6OF01BB1EZ.18.39.D06.1.454.CMB.1.raw
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
  modified_base (372)..(384): a, c, t, g, unknown or other
  misc_feature (372)..(384): n is a, c, g, or t
tcagtacgagtatgcacgaccggtgctcgatttagtgacatctcgcagttctttgggggaaggaggaagactgacggtcctcccaggagttcaggtgctgggcaccgtgggcagtggggaggtgtgtcacaagatttgggctcgtgggcaccgtgggcagtgggggaggtgtgtcacaagatttgggccagggccaccctggtcaccgtctcctcagccttccaccgaagggccccagtccggtccttccccctggccgcccctgcctaccaggacgcaccctcgtgggggccacaggtccggccctgggctgcctaggtccaaggctaccttccatctcgtacngagcggtctggccaaggccncatagcnnnnnnnnnnnnn

SEQ ID NO: 240788 - DNA, 363 bp, Homo sapiens
  misc_feature: GYAE6OF01CPFF2.18.39.D06.1.454.CMB.1.raw
  modified_base (255)..(255): a, c, t, g, unknown or other
  misc_feature (255)..(255): n is a, c, g, or t
  modified_base (356)..(363): a, c, t, g, unknown or other
  misc_feature (356)..(363): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcatgggggaggtgtgtcacaagatttgggctctgggcaccgtgggcatgggggagtgtgtcacaagatttgggctctgggcaccctggtcaccgtctcctcagcttccaccaagggcccatcggtcttcccctggcnccctgctccaggagcacctctgggggcacagcggccctgggctgcctggtcaaggactacttcccataatcgtactgagcgggctggcaaggcgcatacgnnnnnnnn

SEQ ID NO: 240789 - DNA, 357 bp, Homo sapiens
  misc_feature: GYAE6OF01CM14C.18.39.D06.1.454.CMB.1.raw
  modified_base (351)..(357): a, c, t, g, unknown or other
  misc_feature (351)..(357): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggaggtgtgtcacaagatttgggctctgggcaccgtgggcatgggggaggtgtgtcacaagatttgggccagggcaccctggtcaccgtctcctcagcttccaccaagggcccatcggtcttcccctggcgccctgctccaggacgccacctcgtgggggcacagcggccctgggctgcctggtcaaggactacttcccatactcgtactgagcgggctggcaaggcgcatagnnnnnnn

SEQ ID NO: 240790 - DNA, 187 bp, Homo sapiens; identical to SEQ ID NO: 240763
  misc_feature: GYAE6OF01BS361.18.39.D06.1.454.CMB.1.raw
  modified_base (183)..(187): a, c, t, g, unknown or other
  misc_feature (183)..(187): n is a, c, g, or t

SEQ ID NO: 240791 - DNA, 766 bp, Homo sapiens
  misc_feature: GYAE6OF01B0V2Z.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattcccttccagaattttgatatccattgggtgcgacaggccagtggacaagggctcgagtggatgggatggatgaacggtaaaactgaccaacacaggctatgcagaggcattccgagggcagagtcaccatcgaccggaacccctccaccggcacagcctacatggagctgagcagtctgacacctgacgacacggccgtctattactgtgcgagacgccgacgaatagtcgtggtagacgaaaggtagttggttacggttttggttttcggttttcgggaccgggttagtaaccgttacgggttcgggggacccgtacgggggtccctaaccccggttggggttacccctaacccggttccgttaccctacgtaacgttcccctttaccccgaaaccccggtaaaccggggtccccctaacggtttcccgggttacccccgtttcccccccgtgggtccccgtcccccgtacggtcccttaccccggagggtacccgtcccgtaacccgttccgggtacgggggaccctaacccgggaccggggtccccgggtaccccgggttcggggtccccgtaccggggtcccgttaccgggggtaaccctaaacggggttacccctttaaccccgttaccccgttaacgtttaaccccggg

SEQ ID NO: 240792 - DNA, 440 bp, Homo sapiens
  misc_feature: GYAE6OF01AXH5O.18.39.D06.1.454.CMB.1.raw
  modified_base (228)..(228): a, c, t, g, unknown or other
  misc_feature (228)..(228): n is a, c, g, or t
  modified_base (329)..(329): a, c, t, g, unknown or other
  misc_feature (329)..(329): n is a, c, g, or t
  modified_base (431)..(440): a, c, t, g, unknown or other
  misc_feature (431)..(440): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgcgaatatggtggtgacaaaagntgggtcgtttgtttgtttggccggtgaactacgtggggccagggcaccctggtcaccgtctcctcagcttccaccaaggcccatcggtcttccccctggcnccctgctccaggcgcacctcgtgggggcacagcggccctgggctgcctggtcaaggactacttcccatactcgtactgacgcgggctggcaaggcgcatagnnnnnnnnnn

SEQ ID NO: 240793 - DNA, 445 bp, Homo sapiens
  misc_feature: GYAE6OF01BL3YK.18.39.D06.1.454.CMB.1.raw
  modified_base (227)..(227): a, c, t, g, unknown or other
  misc_feature (227)..(227): n is a, c, g, or t
  modified_base (424)..(427): a, c, t, g, unknown or other
  misc_feature (424)..(427): n is a, c, g, or t
  modified_base (429)..(445): a, c, t, g, unknown or other
  misc_feature (429)..(445): n is a, c, g, or t
tcagtacgagtatgcacgaccggtgctcgatttagtgacatctcgaggtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagntggtcttgtttgtttggccggtgaactactggggccagggcaccctggtcaccgtctcctcagcttccaccaagggcccatcggtcttccccctggccgccctgctccaggacgcacctctgggggcacagcggcctgggctgcctggtcaggactacttcccatactcgtactgagcggctggcaaggcgcatagnnnngnnnnnnnnnnnnnnnnn

SEQ ID NO: 240794 - DNA, 187 bp, Homo sapiens; identical to SEQ ID NO: 240763
  misc_feature: GYAE6OF01AV3PU.18.39.D06.1.454.CMB.1.raw
  modified_base (183)..(187): a, c, t, g, unknown or other
  misc_feature (183)..(187): n is a, c, g, or t

SEQ ID NO: 240795 - DNA, 586 bp, Homo sapiens
  misc_feature: GYAE6OF01BSV40.18.39.D06.1.454.CMB.1.raw
  modified_base (234)..(234): a, c, t, g, unknown or other
  misc_feature (234)..(234): n is a, c, g, or t
  modified_base (562)..(586): a, c, t, g, unknown or other
  misc_feature (562)..(586): n is a, c, g, or t
tcagtacgagtatgcacgaccggtgctcgatttagtgacatctcgagtggatgggatggatgaacggtaaaactgccaacacaggctatgcagaggcattccagggcagagtcaccatcgaccgggaacccctccaccggcacagcctacatggagctgagcagtctgacacctgacgacacggccgtctattactgtgcgagacgccgagaatagtggtggtgacaaaaggtnttgggttcgttttggtttttggttttcgggccggttagtaacgtacggtcgggggccgagggccacccgtggtccaccgtcctcctcacgtccttacccgaaccgaacgggccctacgttccggttcccttcccccgtggcccgtccctcgtccgtaccgagggaccgcctacccgttcgggcgggggaccaccggacggcccgggtcccgtcggggcctcggtccggtggtaccgaacgggtacccttacccgttacccaacgttaccgtccggttacgtcgggacggccgggtcgtacgggaccgtaacgggccgacgaagtacgnnnnnnnnnnnnnnnnnnnnnnnnn

SEQ ID NO: 240796 - DNA, 437 bp, Homo sapiens
  misc_feature: GYAE6OF01EDJ0V.18.39.D06.1.454.CMB.1.raw
  modified_base (226)..(226): a, c, t, g, unknown or other
  misc_feature (226)..(226): n is a, c, g, or t
  modified_base (325)..(325): a, c, t, g, unknown or other
  misc_feature (325)..(325): n is a, c, g, or t
  modified_base (427)..(437): a, c, t, g, unknown or other
  misc_feature (427)..(437): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgcgaaatatgtggtgcaaagntggttcgtttgtttgtttggccggtgaactactggggccagggcacctggtcaccgtctcctcagcttccaccaagggcccatcggtcttcccctggcnccctgctccaggacgcacctcgtgggggcacgagcggccctgggctgcctggtcaaggactacttcccatactcgtactgagcggctggcaaggcgcatagnnnnnnnnnnn

SEQ ID NO: 240797 - DNA, 197 bp, Homo sapiens
  misc_feature: GYAE6OF01B2IV7.18.39.D06.1.454.CMB.1.raw
  modified_base (185)..(197): a, c, t, g, unknown or other
  misc_feature (185)..(197): n is a, c, g, or t
tcagtacgagtatgcacgaccggtgctcgatttagtgacatctcgcgagtttctttgggctctgggcaccgtgggcatgggggaggtgtgtcacaagatttgggctcttgggcacagcggccctgggctgcctggtcaaggctacttcccatactcgtactgagcgggctggcaaggcgcatagnnnnnnnnnnnnn

SEQ ID NO: 240798 - DNA, 453 bp, Homo sapiens
  misc_feature: GYAE6OF01CD9Z3.18.39.D06.1.454.CMB.1.raw
  modified_base (141)..(141): a, c, t, g, unknown or other
  misc_feature (141)..(141): n is a, c, g, or t
  modified_base (188)..(188): a, c, t, g, unknown or other
  misc_feature (188)..(188): n is a, c, g, or t
  modified_base (230)..(230): a, c, t, g, unknown or other
  misc_feature (230)..(230): n is a, c, g, or t
  modified_base (331)..(331): a, c, t, g, unknown or other
  misc_feature (331)..(331): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
  modified_base (432)..(453): a, c, t, g, unknown or other
  misc_feature (432)..(453): n is a, c, g, or t
tcagtacgagtatgcacgaccggtgctcgatttagtgacatctcgagtggatgggatggatgaacggtaaaactgccaacacaggctatggcagaggcattccagggcagagtcaccatgaccggggaacccctcaccggnacagcctacatggagctgagcagtctgacacctgacgacacggcctntattactgtgcgagagccgcgaaatatgtggtgacaaaaggntggtcgtttgttttgtttggccggtgaactactggggccagggcaccctggtcaccgtctcctcagcttccaccaagggcccatcggtctccccctggccncctgctccaggagcacctctgggggcacagcggcctgggctgcctggtcaaggctacgttcccatactcgtactgagcgggntggcaaggcgnactagacnnnnnnnnnnnnnnnnnnnnnn

SEQ ID NO: 240799 - DNA, 619 bp, Homo sapiens
  misc_feature: GYAE6OF01DLLZW.18.39.D06.1.454.CMB.1.raw
  modified_base (610)..(610): a, c, t, g, unknown or other
  misc_feature (610)..(610): n is a, c, g, or t
tcagtacgagtatgcacgaccggtgctcgatttagtgacatctcgcagttctttggggctgtcctttggttttggggatggttttctcgatgggggctgggagggctttgttggagaccttgcacttgtactccttgccgttcagccagtcctggtgcaggacggtgaggacgctgaccacacggaacgtgctgttgaactgctcctcccgcggctttgtcttggcattatgcacctcacgccgtccacgtaccacttcgaactggacctcgggtcttcgtggctcacgtccaccaccacgcacgtgaccctcgacggggtccggaatcaagtaagggtacttccgttggggttttagggggaagtagggaagacgtcggacgtccgtacccgaggtacgttcgaggtagaacgaacccgtggggcctacgagtacggaacggtcctcgtgtacagacctagtcggtacttcccctacagtaatttgatagtcctagttggtgcgacgacgcgtagtacggacgaacgggtctacggaggtaggacgtgggtagtggaagtacggaaaaccggtaaacgtcgaaccgacacgaggtctaagtcgacaggngcgtaacgg

SEQ ID NO: 240800 - DNA, 371 bp, Homo sapiens
  misc_feature: GYAE6OF01CW0WC.18.39.D06.1.454.CMB.1.raw
  modified_base (247)..(247): a, c, t, g, unknown or other
  misc_feature (247)..(247): n is a, c, g, or t
  modified_base (363)..(371): a, c, t, g, unknown or other
  misc_feature (363)..(371): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggaagtgtgtcacaagatttgggctctgggcaccgtgggcagtgggggaggtgtgtcacaagatttgggccagggcaccctggtcaccgtctcctcagcttccaccaacggccatcggtcttcccctgcncctgctcaggacgcacctcgtggggcacgacggccggcccgtgggcctgcccgtggtaccgaaggtacctaccttcccatactcgtactgacggcggctggcaaggcgacgatagnnnnnnnnn

SEQ ID NO: 240801 - DNA, 462 bp, Homo sapiens
  misc_feature: GYAE6OF01BQS08.18.39.D06.1.454.CMB.1.raw
  modified_base (227)..(227): a, c, t, g, unknown or other
  misc_feature (227)..(227): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (443)..(443): a, c, t, g, unknown or other
  misc_feature (443)..(443): n is a, c, g, or t
  modified_base (448)..(462): a, c, t, g, unknown or other
  misc_feature (448)..(462): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgcgaatatgtggtgacaaaagntggtcgtttgtttgtttggcggtgaactacgtgggccagggcaccgtgtcaccgtctcctcagccttccacgaacggccctagtccggtccttccccnggccncccgtgcctccgaggacgccaccgtcgtcgggggcacgacgccggccgtggggctcggccgtggtacaacggtcctacctcccattactcgtactgagcgggctggcgaggcnatagnnnnnnnnnnnnnnn

SEQ ID NO: 240802 - DNA, 352 bp, Homo sapiens
  misc_feature: GYAE6OF01CFPXC.18.39.D06.1.454.CMB.1.raw
  modified_base (344)..(352): a, c, t, g, unknown or other
  misc_feature (344)..(352): n is a, c, g, or t
tcagtacgagtatgcacgaccggtgctcgatttagtgacatctcgcagttctttgggggaagaggaagactgacggtcctcccaggagttcaggtgctgggcaccgtgggcatgggggaggtgtgtcacaagatttgggctctgggcaccgtgggcatgggggagtgtgtcacaagatttgggccagggcaccctggtcaccgtctcctcagcttccaccaagggcccatcggtctcccctggcgccctgcctccaggagcacctctggggcacagcggccctgggctgcctggtcaaggactacttccatactcgtactgagcgggctggcaaggcgcatagnnnnnnnnn

SEQ ID NO: 240803 - DNA, 748 bp, Homo sapiens
  misc_feature: GYAE6OF01EC0XP.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccaggacagagtcaccatcgacccggaacccctccaccggcacacgcctacatggagctgagcagtctgacaccgtgacgacgacggccgtctattactgtgcgagacgccgacgaaatgtggtggtgacgaaagagttgggttcgtttggttttggttttcgggccgggtttagtaaaccgttacggttcgggggacccgtacggggtcctaccccggttcgggtacccctaacccggttccttcccgttccgaccgtcccgtttaccccgaacccgtaaccgggtcccctaacgtttcccgggttcccctttcccccccggtcgggtccccgtcccccgttcggtccccgttacccggaacgggtacccgccccgtaaccccggttccgggtaccgggggggacccaaccgggtaccgggcccccgggtccccggttcgggggcccttccgggtccccggttaccggggtaacctaaaccggggtaccccttttaaccccgtttccccgaacgtttaaccccgg

SEQ ID NO: 240804 - DNA, 430 bp, Homo sapiens
  misc_feature: GYAE6OF01CLH5T.18.39.D06.1.454.CMB.1.raw
  modified_base (226)..(226): a, c, t, g, unknown or other
  misc_feature (226)..(226): n is a, c, g, or t
  modified_base (425)..(430): a, c, t, g, unknown or other
  misc_feature (425)..(430): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagntggtcgttgttttgttttggccggtgaactactggggccagggcaccctggtcaccgtctcctcagcttccaccaagggcccatcggtcttcccctggcgccctgctccaggagcacctcgtgggggcacgagcggcctgggctgcctggtcaaggctactcccatactcgtactgagcgggctggcaaggcgcatagnnnnnn

SEQ ID NO: 240805 - DNA, 658 bp, Homo sapiens
  misc_feature: GYAE6OF01DKA5H.18.39.D06.1.454.CMB.1.raw
  modified_base (232)..(232): a, c, t, g, unknown or other
  misc_feature (232)..(232): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagngtcaccatcgaccgggacccctccaccggcacacgcctacatggagctgagcagtctgacacctgacgacacggccgtctattactgtgcgagacgccgcgaaatagtgtggtgacaaagatgggttcgtttgttttggttttcgggccggttagtaaccgttacggtggggcccaggggcctaccccgtgggtcccaccgttcctccgtcacgtccttacccgaaccgaacgggcccctaacgtccggttccctttcccccgtgggcccgtcccccgttggcccttacccgagggtaccgtcccgaacccgttccggtcggggggacccaccggaccgggtcccgggaccccgttgggggccctcgggtccccgttcgggtacccaaacgggtaccctttacccgttccccgtaagttaccccgg

SEQ ID NO: 240806 - DNA, 176 bp, Homo sapiens
  misc_feature: GYAE6OF01D4176.18.39.D06.1.454.CMB.1.raw
  modified_base (175)..(176): a, c, t, g, unknown or other
  misc_feature (175)..(176): n is a, c, g, or t
tcagtacgagtatgcacgaccggtgctcgatttagtgacatctcgcagttctttgggggaagaggaagactgacggtcctcccaggagttcaggtgctgggcacagcggccctgggctgcctggtcaaggactacttcccatactcgtactgagcgggctggcaaggcgcatagnn

SEQ ID NO: 240807 - DNA, 517 bp, Homo sapiens
  misc_feature: GYAE6OF01C2QEG.18.39.D06.1.454.CMB.1.raw
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
  modified_base (495)..(495): a, c, t, g, unknown or other
  misc_feature (495)..(495): n is a, c, g, or t
  modified_base (497)..(517): a, c, t, g, unknown or other
  misc_feature (497)..(517): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgngaatatggtggtgcaaaagntggtcgtttgttttgttttggccggtgaactacgtggggccagggcacccgtggtcaccgtctcctcagcttccaccaacgggcccatcggtccttcccctggccgccctgcctccaggacgccaccgtcgtgggggcacgacggccgggcccgtggggcctcggcccgttgggtaccgaaacgggtaccttacctttcccgaattaccgtccggttaacgtggaacggtcggggccttgggaccgaaagggccgacgtaatacggngnnnnnnnnnnnnnnnnnnnnn

SEQ ID NO: 240808 - DNA, 453 bp, Homo sapiens
  misc_feature: GYAE6OF01BTDW3.18.39.D06.1.454.CMB.1.raw
  modified_base (227)..(227): a, c, t, g, unknown or other
  misc_feature (227)..(227): n is a, c, g, or t
  modified_base (440)..(453): a, c, t, g, unknown or other
  misc_feature (440)..(453): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaaatatgtggtgcaaagntggtcgtttgtttgttttggccggtgaactactggggccagggcaccctggtcaccgtctcctcagcttccaccaaggcccatcggtccttcccctggccgccctgcctccgaggacgcacctcgtcgggggcacgacgccggcccgtgggctcggcctggtcaaggactacttcccatactcgtactgacgcggctggcgaaggcgcatagnnnnnnnnnnnnnn

SEQ ID NO: 240809 - DNA, 590 bp, Homo sapiens
  misc_feature: GYAE6OF01DFD16.18.39.D06.1.454.CMB.1.raw
  modified_base (162)..(162): a, c, t, g, unknown or other
  misc_feature (162)..(162): n is a, c, g, or t
  modified_base (407)..(407): a, c, t, g, unknown or other
  misc_feature (407)..(407): n is a, c, g, or t
  modified_base (431)..(431): a, c, t, g, unknown or other
  misc_feature (431)..(431): n is a, c, g, or t
  modified_base (559)..(590): a, c, t, g, unknown or other
  misc_feature (559)..(590): n is a, c, g, or t
tcagtacgagtatgcacgaccggtgctcgatttagtgacatctcgagtggatgggatggatgaacggtaaaactgccaacacaggctatgcagaggcattccgagggcagagtcaccatcggaacccgggaaccccctccgaccggcacagcctacatgganctgagcagtctgaccacctgaaccgacgaccggccgtacttattacgtggtcgcgagacgccgagtaaattgtggtggtgacgaaaagtgttgggttcgttttggtttttgggttttcgggccggttagtaaccgttacgggtcgggggacccgaggggtccctacccgttcgggtccctacccgttctcccgtcgacgtccttacccgaaccggaaccggccctagttcccgtcccttccccgnggcccgtccctgccgtccgaggcnccaccgtcgggtcggggacacggcggcccggtccgtgggccgtcgccgtggtaccacggtacctacccttccctatccgtcgtagcggtacgggccgggtcgtacgggacacgggtccgactagtcgnnnnnnnnnnnnnnnnnnnnnnnnnnnnnnnn

SEQ ID NO: 240810 - DNA, 571 bp, Homo sapiens
  misc_feature: GYAE6OF01ECOQX.18.39.D06.1.454.CMB.1.raw
  modified_base (331)..(331): a, c, t, g, unknown or other
  misc_feature (331)..(331): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagacgccgngaatatgtggtgacaaagatggtcgtttgtttgttttggccggttgaacgtacgtggggccagggccacccgtggtccaccgtctcctcacgtccttccaccgaacgggccccagttccggtccttcccccgtggcccgtcccctgcccttccgaggacgccacccgtcgtgggggccacgcggcccggcccgtgggcctcgcccgtggtccaacggtaccttaccttcccgattacccg

SEQ ID NO: 240811 - DNA, 433 bp, Homo sapiens
  misc_feature: GYAE6OF01CLMBX.18.39.D06.1.454.CMB.1.raw
  modified_base (423)..(423): a, c, t, g, unknown or other
  misc_feature (423)..(423): n is a, c, g, or t
  modified_base (428)..(433): a, c, t, g, unknown or other
  misc_feature (428)..(433): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgcgaatatgtggtgacaaagatgggtcgtttgttttgttttaggccggtgaactacgtggggccagggcacctggtcaccgtctctcagcttccaccaaggccatcggtcttcccctgccgccctgctccaggacgcacctcgtgggggcacgacgcggcctgggctgcctggtcaggctacgttcccatactcgtactgacgcgggctggcaaggcncatgnnnnnn

SEQ ID NO: 240812 - DNA, 434 bp, Homo sapiens
  misc_feature: GYAE6OF01AT4C5.18.39.D06.1.454.CMB.1.raw
  modified_base (226)..(226): a, c, t, g, unknown or other
  misc_feature (226)..(226): n is a, c, g, or t
  modified_base (428)..(434): a, c, t, g, unknown or other
  misc_feature (428)..(434): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagntggtcgttgtttgttttggccggtgaactactggggccagggcaccctggtcaccgtctcctcagcttccaccaagggcccatcggtcttccccctggcgcccctgctccaggagcacctctgggggcacagcggccctggggctgcctggtcaaggactacttcccatctcgtactgagcgggctggcaagggcgcatagnnnnnnn

SEQ ID NO: 240813 - DNA, 364 bp, Homo sapiens
  misc_feature: GYAE6OF01C0D8T.18.39.D06.1.454.CMB.1.raw
  modified_base (352)..(352): a, c, t, g, unknown or other
  misc_feature (352)..(352): n is a, c, g, or t
  modified_base (358)..(364): a, c, t, g, unknown or other
  misc_feature (358)..(364): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcatgggggaggtgtgtcacaagatttgggctctgggcaccgtgggcagtgggggaggtgtgtcacaagatttgggctctgggcaccctggtcaccgtctcctcagcttccaccaagggcccatcggtcttccccctggccgccctgcctccaggacgcacctcgtgggggcacgagcggccctggctgcctggtcaaggctactccatactcgtactgagcggctggcaaggcncatagnnnnnnn

SEQ ID NO: 240814 - DNA, 180 bp, Homo sapiens
  misc_feature: GYAE6OF01EKD6V.18.39.D06.1.454.CMB.1.raw
  modified_base (176)..(180): a, c, t, g, unknown or other
  misc_feature (176)..(180): n is a, c, g, or t
tcagtacgagtatgcacgaccggtgctcgatttagtgacatctcgcagttctttggggggaagaggaagactgacggtcctcccaggagttcaggtgctgggcacagcggccctgggctgcctggtcaaggactacttcccatactcgtactgagcgggctggcaaggcgcatagnnnnn

SEQ ID NO: 240815 - DNA, 631 bp, Homo sapiens
  misc_feature: GYAE6OF01BNOX5.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatcgacccgggaacccctccaccggcacacgcctacatggagctgagcagtctgaccacctgaccgacacggccgtctattactgtgcgagacgccgacgaatgtgtggtgacaaaagtgttggttcgttttggttttgttttcgggcccggttagtaaccgttacggtggggcccgagggccctacccgttgggtccctacccgtccgtcctaccacgtccttacccgaacccgacgggtcccctaacgttcccggttcccgttcccccgtgggcccgtccccgtcggcctcccgacgggacgcccacccgttcggtcggggccaccgacggcccggtacccgtcgggcctcgcccgtcggtacgaacggtaccttaccttcccgagtaccg

SEQ ID NO: 240816 - DNA, 490 bp, Homo sapiens
  misc_feature: GYAE6OF01C59WC.18.39.D06.1.454.CMB.1.raw
  modified_base (447)..(447): a, c, t, g, unknown or other
  misc_feature (447)..(447): n is a, c, g, or t
  modified_base (476)..(490): a, c, t, g, unknown or other
  misc_feature (476)..(490): n is a, c, g, or t
tcagtacgagtatgcacgaccggtgctcgatttagtgacatctcgagtggatgggatggatgaacggtaaactagccaacacaggctatgcagaggcattccagggcagagtcaccatgaccgggaacccctccaccggcacagcctacatggagctgagcagtctgacacctgacgacacggccgtctattactgtgcgagagccgacgaatatggtggtgacaaaagtagttgggttcgtttggtttttggtttgggtccggttgaactacgtggggccagggcaccctggtcaccgtctcctcagccttccaccgaaggcccatccgggtccttcccccgtcggccgtcccctcgcctccgaggacgcaccgtcgtgggggcacgacggccggccgtcgggctgccgtggtcaaggtcctacttcccattacctcgtacgtggngcgggctcggacgaacggtcgcagttagnnnnnnnnnnnnnnn

SEQ ID NO: 240817 - DNA, 524 bp, Homo sapiens
  misc_feature: GYAE6OF01CEFSV.18.39.D06.1.454.CMB.1.raw
  modified_base (502)..(524): a, c, t, g, unknown or other
  misc_feature (502)..(524): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgacaaagatggtcgttgttttgtttggccggtgaactacgtggggccagggcaccgtggtccaccgtctcctcacgtccttccaccgaacgggcccacgttccgggttccttcccccgtggcccgccccttcgcctccgaggacgcctaccgtcgtcgggggccacgacggccgggcccgtggggcctcggccgttggtaccgaacgggtaccttaccttccccgacttaccgtcgtacgtggacggtccgggcgtcgggaccgaacgggccgacgatacggnnnnnnnnnnnnnnnnnnnnnnn

SEQ ID NO: 240818 - DNA, 208 bp, Homo sapiens
  misc_feature: GYAE6OF01B025U.18.39.D06.1.454.CMB.1.raw
  modified_base (184)..(208): a, c, t, g, unknown or other
  misc_feature (184)..(208): n is a, c, g, or t
tcagtacgagtatgcacgaccggtgctcgatttagtgacatctcgcaggttctttagggttttgggggaagaggaagactgacggtcctcccaggagttcaggtgctgggcacagcggccctgggctgcctggtcaaggactacttctcatactcgtactgagcgggctggcaaggcgcatagnnnnnnnnnnnnnnnnnnnnnnnnn

SEQ ID NO: 240819 - DNA, 380 bp, Homo sapiens
  misc_feature: GYAE6OF01DELUE.18.39.D06.1.454.CMB.1.raw
  modified_base (263)..(263): a, c, t, g, unknown or other
  misc_feature (263)..(263): n is a, c, g, or t
  modified_base (369)..(369): a, c, t, g, unknown or other
  misc_feature (369)..(369): n is a, c, g, or t
  modified_base (374)..(380): a, c, t, g, unknown or other
  misc_feature (374)..(380): n is a, c, g, or t
tcagtacgagtatgcacgaccggtgctcgatttagtgacatctcgcagttctttgggttttgggggaagaggaagactgacggtcctcccaggagttcaggtgctgggcaccgtgggcagtggggaggtgtgtcacaagatttgggctctgggcaccgtgggcagtgggggagtgtgtcacaagatttgggctctgggcaccctggtcaccgtctcctcagccttccaccgaaggggcccatccggtccttccccctgggccnccctgcctcccaggacgcacccgtcgtcgggggcacgagccggccctggggctgcctggtcaaggacctacttcccatacctcgtactgagcgggctggcaaggcncatgnnnnnnn

SEQ ID NO: 240820 - DNA, 181 bp, Homo sapiens
  misc_feature: GYAE6OF01CCQX2.18.39.D06.1.454.CMB.1.raw
  modified_base (181)..(181): a, c, t, g, unknown or other
  misc_feature (181)..(181): n is a, c, g, or t
tcagtacgagtatgcacgaccggtgctcgatttagtgacatctcgcagttctttgggttttgggggaagaggaagactgacggtcctcccaggagttcaggtgctgggcacagcggcctgggctgcctggtcaaggactacttcccatactcgtactgagcgggctggcaaggcgcatagn

SEQ ID NO: 240821 - DNA, 489 bp, Homo sapiens
  misc_feature: GYAE6OF01CSXNQ.18.39.D06.1.454.CMB.1.raw
  modified_base (228)..(228): a, c, t, g, unknown or other
  misc_feature (228)..(228): n is a, c, g, or t
  modified_base (470)..(489): a, c, t, g, unknown or other
  misc_feature (470)..(489): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgacgaatatgtggtgacaaagntggtcgttgttttgtttggccggtgaactacgtggggccagggccacccgtggtccaccgtctcctcagccttccaccgaagggcccatccggtccttcccccgtggcccgtccctgcctccgaggacgcctacctcgtcggggccacgacggccggcccgtggggcctggcccgtggtacaacgggtccttacgttcccattacctcgtactggacgcgggctggacaaggcgacatagcnnnnnnnnnnnnnnnnnnnn

SEQ ID NO: 240822 - DNA, 177 bp, Homo sapiens
  misc_feature: GYAE6OF01CEQ5O.18.39.D06.1.454.CMB.1.raw
  modified_base (175)..(177): a, c, t, g, unknown or other
  misc_feature (175)..(177): n is a, c, g, or t
tcagtacgagtatgcacgaccggtgctcgatttagtgacatctcgcagttctttgggggaagaggaagactgacggtcctcccaggagttcaggtgctgggcacagcggccctgggctgcctggtcaaggactacttcccatactcgtactgagcgggctggcaaggcgcatagnnn

SEQ ID NO: 240823 - DNA, 634 bp, Homo sapiens
  misc_feature: GYAE6OF01ANNHC.18.39.D06.1.454.CMB.1.raw
  modified_base (592)..(592): a, c, t, g, unknown or other
  misc_feature (592)..(592): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
  modified_base (609)..(610): a, c, t, g, unknown or other
  misc_feature (609)..(610): n is a, c, g, or t
  modified_base (612)..(612): a, c, t, g, unknown or other
  misc_feature (612)..(612): n is a, c, g, or t
  modified_base (614)..(619): a, c, t, g, unknown or other
  misc_feature (614)..(619): n is a, c, g, or t
  modified_base (621)..(634): a, c, t, g, unknown or other
  misc_feature (621)..(634): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacgacgcctacatggagctgagctagtctgacacctgacgacgacggtccgttctatttacgtgtcggcgaagcgccgacgaaattagttggtcggtagaccaaaaaggtgttgggttccgttttggtttttgggttttcggccggttagtaacgtacgtcggggcgtaggcctaccgtggtcaccgttctctcgtagtccttaccaccggaacggcctagttccggtccttcccgtcggccgaccttcgctacccgaggcgtccaccgtcggtcggggcaacgtcggcccggtccgtacgggtcgtccggtccgtacgggtaccgtaacggtaccccgtttacccgtttaccccgtaacgtttaccccgttcggttacccgtaggtaccgggggtacccgggccggtttaccgggaaccggtaaaccgggccgtaaccgtaaggttcgcgtnacggcncgngcaagcgnncncnnnnnngnnnnnnnnnnnnnn

SEQ ID NO: 240824 - DNA, 197 bp, Homo sapiens
  misc_feature: GYAE6OF01DHOMX.18.39.D06.1.454.CMB.1.raw
  modified_base (175)..(175): a, c, t, g, unknown or other
  misc_feature (175)..(175): n is a, c, g, or t
  modified_base (181)..(197): a, c, t, g, unknown or other
  misc_feature (181)..(197): n is a, c, g, or t
tcagtacgagtatgcacgaccggtgctcgatttagtgacatctcgcagttcgtttgggttttggggggaagaggaagactgacggtcctcccaggagttcaggtgctggcacagcggccctggctgcctggtcaaggactacttcccatactcgtactgagcggctggcaaggcncatagnnnnnnnnnnnnnnnnn

SEQ ID NO: 240825 - DNA, 539 bp, Homo sapiens
  misc_feature: GYAE6OF01BANW2.18.39.D06.1.454.CMB.1.raw
  modified_base (222)..(222): a, c, t, g, unknown or other
  misc_feature (222)..(222): n is a, c, g, or t
  modified_base (229)..(229): a, c, t, g, unknown or other
  misc_feature (229)..(229): n is a, c, g, or t
  modified_base (512)..(539): a, c, t, g, unknown or other
  misc_feature (512)..(539): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaaccccctccaccggcacagcctacatggagctgagcagtctgacacctgacgacacggccgtctattactgtgcgagagccgcgaatatggtggtnacaaagntggtcgtttgttttgtttggccggtgaactacgtgggccgagggccaccgtggtccaccgtctcctcagtccttccaccgaacgggcccctagttccggttcccttcccccgtggcccgcccctgcctccgaggacgccaccgtcggtcgggggcacgcggccggcccgtgggcctcggtccgtggtacgaacggtacccttaccgttccccgtaattaccgttccggtacgttcggaacgggtccgggtcgtcgggaccgaacgggtccgacgtaagtacgnnnnnnnnnnnnnnnnnnnnnnnnnnnn

SEQ ID NO: 240826 - DNA, 632 bp, Homo sapiens
  misc_feature: GYAE6OF01A6D25.18.39.D06.1.454.CMB.1.raw
  modified_base (202)..(202): a, c, t, g, unknown or other
  misc_feature (202)..(202): n is a, c, g, or t
  modified_base (311)..(311): a, c, t, g, unknown or other
  misc_feature (311)..(311): n is a, c, g, or t
  modified_base (459)..(459): a, c, t, g, unknown or other
  misc_feature (459)..(459): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (516)..(516): a, c, t, g, unknown or other
  misc_feature (516)..(516): n is a, c, g, or t
  modified_base (522)..(522): a, c, t, g, unknown or other
  misc_feature (522)..(522): n is a, c, g, or t
  modified_base (534)..(534): a, c, t, g, unknown or other
  misc_feature (534)..(534): n is a, c, g, or t
  modified_base (543)..(543): a, c, t, g, unknown or other
  misc_feature (543)..(543): n is a, c, g, or t
tcagtacgagtatgcacgaccggtgctcgatttagtgacatctcgtcgggagttctttgggtttgggggaagaggaagactgacggtccgtcccaggagttccacggtgcgtcggcgacccgtgggcatgggggagtcgtcgtccacaagatttgggcgtctgggcgaccgtgggccagtggggaggtcgtgtcacaaggtntttggcctcgtgggcacccgttggtcaccggtctccgtcgagccttaccaccgaacgggcccagtccggtccttccccgaggccgccctgtccgtaccgtaggggtacncctacctcgtcgggggtccaccgtacggccggacccgtgggacctacgcccgtggtaccaaacggtacctacccttaccctacgtacctccggttaacttaggacggtccgggtactagggaccgaacggtccgtacgtaagttacgntcgctctcgcgctacngctcgacncgtccgcactcgactctcgcgcgcgtcgcgcgngagcgngtacgtgtactntctctcgcngtctctagtactatcgagtgtgtagtcgtcgtacgtacgtacgtacgtacgtacgtactacgtcgtcgtacgtacgacgccgacgaccg

SEQ ID NO: 240827 - DNA, 546 bp, Homo sapiens
  misc_feature: GYAE6OF01C0S1P.18.39.D06.1.454.CMB.1.raw
  modified_base (314)..(314): a, c, t, g, unknown or other
  misc_feature (314)..(314): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (473)..(473): a, c, t, g, unknown or other
  misc_feature (473)..(473): n is a, c, g, or t
tcagtacgagtatgcacgaccggtgctcgatttagtgacatctcgcagttctttgggctgaggtgaagaaccctggggcctcagtgaaggtctcctgtcagacctatggattccccttccagaattttgatatccattgggtgcgacaggccagtggacaagggctcgagtggatgggatggatgaacggtaaaactgaccaacacaggctatgcagaggcattccagggcagagtcaccatcgaccggaaccctccgaccggcacacgcctacatggagctgacgcagtctgacaccgtgacgcgacggcctntatactgtgcgagacgccgacgaatgtgtggtnacaaagntggtacgtttgtttgtttggccgtagactgtggcaggcaccgtggtcaccgtctcctcacgtctccaccgaacggccctacgtccgtcctccccgtcgccgccctgtcctccgcggacncaccgtcgtcgggcacgacgccggccgtggccgtcgtccgtcggtacaacggtacttacctcccgattacccg

SEQ ID NO: 240828 - DNA, 724 bp, Homo sapiens
  misc_feature: GYAE6OF01BKTER.18.39.D06.1.454.CMB.1.raw
  modified_base (215)..(215): a, c, t, g, unknown or other
  misc_feature (215)..(215): n is a, c, g, or t
  modified_base (365)..(365): a, c, t, g, unknown or other
  misc_feature (365)..(365): n is a, c, g, or t
tcagtacgagtatgcacgaccggtgctcgatttagtgacatctcgcagttctggggctgaggtgaagaaccctgggcctcagtgaaggtctcctgtcagacctatggacttccccttcagtaattttgatatccattgggtgcgacaggccagtggacaagggctcgagtggatgggatggataggaaacggtaaaactgaccaacacaggctangcagaggcatccgaggcagagtcaccagtcgaccggaccctccgaccggcacacgtcctaacagtggacgctgacgcagtctacgacacctgaccgacgaccggccgttactaattacgtgtgacgagacgccgacgtaatgtgtggtanaacgtaaagtgttcggttacgttttggttttcggtttcggccggttaagtaaaccggttcggtcgggggtaccgtaacgggtcctacccgttcgggtaccctaccgttcctccgtacgtacgtcccttaccgaaccgtaccgggcccctacgttcccggttccccttccccggtacggcccgtccccgtcgtcccgtacccgagggtacctcccggtcccgtacgggtccgggggaccacccgggacccggtccccgggtccccggtcggggtcccgtaccgggtacccccgtttaagggggtacccccgaaacgggttaacccttaaccccgttttaccccccgaaagtttaccccgg

SEQ ID NO: 240829 - DNA, 404 bp, Homo sapiens
  misc_feature: GYAE6OF01DA4BY.18.39.D06.1.454.CMB.1.raw
  modified_base (179)..(179): a, c, t, g, unknown or other
  misc_feature (179)..(179): n is a, c, g, or t
  modified_base (359)..(359): a, c, t, g, unknown or other
  misc_feature (359)..(359): n is a, c, g, or t
  modified_base (365)..(404): a, c, t, g, unknown or other
  misc_feature (365)..(404): n is a, c, g, or t
tcagtacgagtatgcacgaccggtgctcgatttagtgacatctcgctagttctttggggggaagaggaagactgacggtcctcccaggagttcgaggtgctgggcaccgtgggcatgggggagtgtgtcacaagatttgggctctgggcaccgtgggcatgggggagtgtgtcacaagntttgggccagggcaccctggtctaccgtctcctcagccttccaccaagggccccagtccggtccttcccccgtggccgccctgcctccaggacgcacctgtgggggcacagccggccctgggcctgcctggtcaaggctaccttcccattacctcgtactggagcgggctggacaaggcncatagnnnnnnnnnnnnnnnnnnnnnnnnnnnnnnnnnnnnnnnn

SEQ ID NO: 240830 - DNA, 689 bp, Homo sapiens
  misc_feature: GYAE6OF01DPX6D.18.39.D06.1.454.CMB.1.raw
  modified_base (236)..(236): a, c, t, g, unknown or other
  misc_feature (236)..(236): n is a, c, g, or t
  modified_base (638)..(638): a, c, t, g, unknown or other
  misc_feature (638)..(638): n is a, c, g, or t
  modified_base (641)..(641): a, c, t, g, unknown or other
  misc_feature (641)..(641): n is a, c, g, or t
  modified_base (658)..(658): a, c, t, g, unknown or other
  misc_feature (658)..(658): n is a, c, g, or t
  modified_base (667)..(667): a, c, t, g, unknown or other
  misc_feature (667)..(667): n is a, c, g, or t
  modified_base (678)..(678): a, c, t, g, unknown or other
  misc_feature (678)..(678): n is a, c, g, or t
tcagtacgagtatgcacgaccggtgctcgatttagtgacatctcgaggtggatgggatggatgaacggtaaaacctgccaacacaggctatgcagaggcattccagggccagagtcaccatgaccgggaaccctcaccggcacacgcctacgatggagcttgagcagtcgtagacacctcgacgacacggccgtctattactgtgcgagagccgacgaatatgtggtgacaaaagntggtacgtttgtttcggtttggccggtgaactacgtcggggccagggctaccgtggtcaccgtctcctcacgtctccaccgaacgggcccacgtccggtccttcccccgtggtccgtcccgttcgccgttccgacgggtacgccgtaaccgtccggttacgggggacctacgacggtcccgggtccccgtacgggggtccttacgggacccgttacgggttaccgtaaacgggtaaccctttaacccgtttaccccgtaacgtttaacccgtttaccgggttaaccgttacgggtaacgggttacccggggtaccgttaccggggtacccgtaaacggggtaccccggtaccgtaaaggttaacggtctacgtaacgtcgaactccgtagtgtcgagacagnganacgacacgtagacgcgnacgtcactntacgtctactntctcgtcgtcg

SEQ ID NO: 240831 - DNA, 439 bp, Homo sapiens
  misc_feature: GYAE6OF01AY68V.18.39.D06.1.454.CMB.1.raw
  modified_base (227)..(227): a, c, t, g, unknown or other
  misc_feature (227)..(227): n is a, c, g, or t
  modified_base (430)..(439): a, c, t, g, unknown or other
  misc_feature (430)..(439): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaaagntggtcgttgtttgttttggccggtgaactactggggccagggcaccctggtcaccgtctcctcagcttccaccaaggcccatccggtcttccccctggcgcccctgcctccaggcgcacctctgggggcacagcggccctgggctgcctggtccaaggactacttcccatactcgtactgagcgggctggcaaggcgcatagnnnnnnnnnn

SEQ ID NO: 240832 - DNA, 477 bp, Homo sapiens
  misc_feature: GYAE6OF01EJPCD.18.39.D06.1.454.CMB.1.raw
  modified_base (188)..(188): a, c, t, g, unknown or other
  misc_feature (188)..(188): n is a, c, g, or t
  modified_base (230)..(230): a, c, t, g, unknown or other
  misc_feature (230)..(230): n is a, c, g, or t
  modified_base (353)..(353): a, c, t, g, unknown or other
  misc_feature (353)..(353): n is a, c, g, or t
  modified_base (466)..(477): a, c, t, g, unknown or other
  misc_feature (466)..(477): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtntattactgtgcgagagccgcgaaattatggtggtgacaaagntggtcgtttgtttgttttggccggtgaactacgtgggccagggcacctggtcaccgtctcctcacgcttccaccaacgggcccagtccggtccttcccctggccgcccctgcctccgaggacnccaccgtcgtcgggggccacgacggccgggccctggggcctggccgttgggtcaaacgggtactaccgttccccattaccgtcgtactggagcgggctggacaaggcgcatgnnnnnnnnnnnn

SEQ ID NO: 240833 - DNA, 364 bp, Homo sapiens
  misc_feature: GYAE6OF01BK1HK.18.39.D06.1.454.CMB.1.raw
  modified_base (271)..(271): a, c, t, g, unknown or other
  misc_feature (271)..(271): n is a, c, g, or t
  modified_base (349)..(349): a, c, t, g, unknown or other
  misc_feature (349)..(349): n is a, c, g, or t
  modified_base (355)..(364): a, c, t, g, unknown or other
  misc_feature (355)..(364): n is a, c, g, or t
tcagtacgagtatgcacgaccggtgctcgatttagtgacatctcgcagttctttgggttttgggggaagaggaagactgacggtcctcccaggagttcaggtgctgggcaccgtgggcatgggggaggtgtgtcacaagatttgggctctgggcaccgtgggcatgggggaggtgtgtcacaagatttgggctctgggcaccctggtcaccgtctcctcagcttccaccaagggcccatcggtcttccccctggccgccctgctccaggancacctctggggcacagcggccctgggctgcctggtcaaggctacttcccatacctcgtactgagcggctggcaaggcncatagnnnnnnnnnn

SEQ ID NO: 240834 - DNA, 520 bp, Homo sapiens
  misc_feature: GYAE6OF01D4FKF.18.39.D06.1.454.CMB.1.raw
  modified_base (232)..(232): a, c, t, g, unknown or other
  misc_feature (232)..(232): n is a, c, g, or t
  modified_base (500)..(520): a, c, t, g, unknown or other
  misc_feature (500)..(520): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaaccccctccaccggcacagcctacatggagctgagcagtctgacacctgacgacacggccgtctattactgtgcgagagccgcgaattatggtggtgacaaaaggnttgggtcgtttgttttggttttggccggtgaactacgtggggccagggccacccgtggtcaccgtctcctcacgtccttccaccgaacgggcccctagtccggttcccttcccccgtggcccgcccctcgcctccgaggcgcctaccgtcggtcgggggcacgacggccggcccgtgggctcggccgtggtacgaaggtaccttaccttcccattaccgtcgttactggacggccgggtcgtgggaccgtaagggccgaccagtacgnnnnnnnnnnnnnnnnnnnnn

SEQ ID NO: 240835 - DNA, 606 bp, Homo sapiens
  misc_feature: GYAE6OF01ASR3Z.18.39.D06.1.454.CMB.1.raw
  modified_base (279)..(279): a, c, t, g, unknown or other
  misc_feature (279)..(279): n is a, c, g, or t
  modified_base (318)..(318): a, c, t, g, unknown or other
  misc_feature (318)..(318): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatcgaccggaacccctccaccggcacacgcctacagtgganctgagcagtctgacacctgacgacacggcgtctattacngtgcgagagccgcgaatagtggtggtgacaaaggtagttggttacgtttgttttggttttcggccggtagtacgtacgtcggggccgacgggcctacccgtggtcaccgtctcctcgacgtccttaccaccgacggccctagtccggttccctccccgtcggcccgtcccgtcgcctcccgaggacgccgaccgtcggtcggggccaccggaccggccggtccccgtgggtccctcggtcccgtacgggtacgaacggtacccttacccgttcccgtacgttacccgg

SEQ ID NO: 240836 - DNA, 765 bp, Homo sapiens
  misc_feature: GYAE6OF01ED6ZW.18.39.D06.1.454.CMB.1.raw
  modified_base (358)..(358): a, c, t, g, unknown or other
  misc_feature (358)..(358): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacatgctatgcagaggcattccagggcagagtcaccatcgacccgggaacccctccaccggcacacgcctacatggagctgagcagtctgacacctgacgacacggcctctattactgtcgcgagacgccgacgaatatggtggtgacaaaaggtntgggttcgtttgttttggttttcgggcccgggttagaaccgttacggtcgggggcccgtaacgggggcctaaccccgttgggtccctacccggttccttccccgtcgtacggtccctttaccccgacccgtaacgggccccctaacggttcccgggtttcccgtttccccccccgtggggtcccccgtcccccgttcgccccgttaccccgaacggggtaccgtaccccgtaaccccggttccgggttaccggggggggacccctaaacccgggaccggggtcccccggggtaccccccgggttcgggggggccccgtttacccgggccccccggtttacgggggtaaccccgtaaaaccggggttaaccccctttaacccccgtttacccccccgttaaaacccgg

SEQ ID NO: 240837 - DNA, 657 bp, Homo sapiens
  misc_feature: GYAE6OF01A955Y.18.39.D06.1.454.CMB.1.raw
  modified_base (287)..(287): a, c, t, g, unknown or other
  misc_feature (287)..(287): n is a, c, g, or t
tcagtacgagtatgcacgaccggtgctcgatttagtgacatctcgcagttctggggctgaggtgaagaaccctggggcctcagtgaaggtctcctgtcagacctatggacttccccttccagtaattttgatatccattgggtgcgacaggccagtggacaagggctcgagtggatgggatggatgaaacggtaaaactgccaacacaggctatgcagaggcattccgagggcagacgtcaccatcggaccccgggacccctccgaccggcacacgcctacatgganctgagcagtctgaccacctgaccgacaccggccgtctattacgtgtgcgagcgccgacgaatcgtgtggtgacaaagtgttggttcgtttggttttggttttcgggccggttagtaaccgttacggtcggggtacccgacgggtcctacccgtgggtaccctacccgttcctcccgtccacgtcccttacccgaaccgaacgggcccctaacgttcccggttccccgtttacccccgtgggccccgtccccgtcgtcccgtccgacgggtacgccctacccgtcgggtcggggccaccgaccggcccggtcccgtggggcctcggcccgttcggtaccgaacggtacccttacccttcccgacgttaccg

SEQ ID NO: 240838 - DNA, 580 bp, Homo sapiens
  misc_feature: GYAE6OF01D3FMC.18.39.D06.1.454.CMB.1.raw
  modified_base (234)..(234): a, c, t, g, unknown or other
  misc_feature (234)..(234): n is a, c, g, or t
  modified_base (535)..(535): a, c, t, g, unknown or other
  misc_feature (535)..(535): n is a, c, g, or t
  modified_base (540)..(540): a, c, t, g, unknown or other
  misc_feature (540)..(540): n is a, c, g, or t
  modified_base (543)..(543): a, c, t, g, unknown or other
  misc_feature (543)..(543): n is a, c, g, or t
  modified_base (545)..(547): a, c, t, g, unknown or other
  misc_feature (545)..(547): n is a, c, g, or t
  modified_base (550)..(550): a, c, t, g, unknown or other
  misc_feature (550)..(550): n is a, c, g, or t
  modified_base (553)..(553): a, c, t, g, unknown or other
  misc_feature (553)..(553): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (561)..(565): a, c, t, g, unknown or other
  misc_feature (561)..(565): n is a, c, g, or t
  modified_base (567)..(580): a, c, t, g, unknown or other
  misc_feature (567)..(580): n is a, c, g, or t
tcagtacgagtatgcacgaccggtgctcgatttagtgacatctcgagtggatgggatggatgaacggtaaaactgccaacacaggctatgcagaggcattccagggcagagtcaccatcgaccgggaacccctccaccggcacagcctacatggagctgagcagtctgacacctgacgacacggccgtctattactgtgcgagagccgacgaattagtggtggtgacaaaaggngttgggttcgttttggttttggttttggccggtgaacctacgtcggggccaggccaccgtggtccaccggttctcctcacgtccttacccgaaccgaaccgggcccacgttccggttcccttcccccgtggcccgcccttgcctccgacggacgcctaccgtcggtcgggggaccacgacggtccggtccgtcggggctcggccgtcggtacaacggtccttacccgttccctaacgttaccgtcgttaacgtggacggtccgggtcgtacggaccgtaacgggccgacgtaagttacggntacgngcncnnncgncgngcncgngnnnnngnnnnnnnnnnnnnn

SEQ ID NO: 240839 - DNA, 359 bp, Homo sapiens
  misc_feature: GYAE6OF01D6CP0.18.39.D06.1.454.CMB.1.raw
  modified_base (345)..(345): a, c, t, g, unknown or other
  misc_feature (345)..(345): n is a, c, g, or t
  modified_base (351)..(359): a, c, t, g, unknown or other
  misc_feature (351)..(359): n is a, c, g, or t
tcagtacgagtatgcacgaccggtgctcgatttagtgacatctcgcagttctttgggttttgggggaagaggaagactgacggtcctcccaggagttcaggtgctgggcaccgtgggcatgggggaggtgtgtcacaagatttgggctctgggcaccgtgggcatgggggagtgtgtcacaagatttgggctctgggcaccctggtcaccgtctcctcagcttccgccaagggcccatcggtcttccccctggccgccctgcctccaggacgcacctctggggcacagcgcctggctgcctggtcaaggctactcccatactcgtactgagcggctggcaaggcncatagnnnnnnnnn

SEQ ID NO: 240840 - DNA, 479 bp, Homo sapiens
  misc_feature: GYAE6OF01AVQ68.18.39.D06.1.454.CMB.1.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (467)..(479): a, c, t, g, unknown or other
  misc_feature (467)..(479): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgngaatatgtggtgcaaagntggtcgtttgtttgttttggccggtgaactacgtggggccagggccaccgtggtccaccgtctcctcagccttccaccgaacgggcccagttccggtccttcccccgtggcccgccctgcctccgaggacgccaccgtcgtcgggggcacgacggccggccctggggcctggccgtgggtacaacgggtaccttaccttcccattacctcgtactggacggcgggctggacaggcgcatgnnnnnnnnnnnnn

SEQ ID NO: 240841 - DNA, 436 bp, Homo sapiens
  misc_feature: GYAE6OF01EG6DM.18.39.D06.1.454.CMB.1.raw
  modified_base (229)..(229): a, c, t, g, unknown or other
  misc_feature (229)..(229): n is a, c, g, or t
  modified_base (326)..(326): a, c, t, g, unknown or other
  misc_feature (326)..(326): n is a, c, g, or t
  modified_base (425)..(425): a, c, t, g, unknown or other
  misc_feature (425)..(425): n is a, c, g, or t
  modified_base (431)..(436): a, c, t, g, unknown or other
  misc_feature (431)..(436): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaaatatgtggtgacaaaagntggtcgtttgtttgtttggccggtgaactactgggccagggcaccctggtcaccgtctcctcagcttccaccaagggccatcggtcttcccctggcnccctgcctccaggacgcacctcgtcgggggcacaggcggccctgggctgcctggtcaaggactacttccatactcgtactgagcgggactggcaaggcncatagnnnnnn

SEQ ID NO: 240842 - DNA, 663 bp, Homo sapiens
  misc_feature: GYAE6OF01AHFKG.18.39.D06.1.454.CMB.1.raw
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (627)..(627): a, c, t, g, unknown or other
  misc_feature (627)..(627): n is a, c, g, or t
  modified_base (631)..(631): a, c, t, g, unknown or other
  misc_feature (631)..(631): n is a, c, g, or t
  modified_base (634)..(634): a, c, t, g, unknown or other
  misc_feature (634)..(634): n is a, c, g, or t
  modified_base (636)..(637): a, c, t, g, unknown or other
  misc_feature (636)..(637): n is a, c, g, or t
  modified_base (639)..(663): a, c, t, g, unknown or other
  misc_feature (639)..(663): n is a, c, g, or t
tcagtacgagtatgcacgaccggtgctcgatttagtgacatctcgagtggatgggatggatgaaacggtaaaactgccaacacaggctatgcagaggcattccagggcagagtcaccatcgaccgggaacccctccaccggcacagcctacatggagctgagcagtctgaccacctgacgacacggcctntattacngtgcgagacgccgagaatatggtggtgacaaaagtgttggttcgttttgtttttggttttcgggccggttagaacgttacggtcggggccaggggcctacccggttggtccaccgttcctccctcgacgtccttaccccgaaccgaaccggggtcccctacgtttcccgggtttacccctttccccccggtgggcccccgtcccccgttcggcccgttacccggacgggtaccgtacccgtacccggtcggggtcggggggaccccaaccgggtccgggcccgggtccccggttcgggggtccgtccgggtcccggttacgggtacctaaacccgggttaccttaccctttaccccgattacccgttaccggttacgtcggaccggggtccgggtccgtagggaaccgtacggggcccacgttaggacgngtcngcngnngnnnnnnnnnnnnnnnnnnnnnnnnn

SEQ ID NO: 240843 - DNA, 504 bp, Homo sapiens
  misc_feature: GYAE6OF01EVGDU.18.39.D06.1.454.CMB.1.raw
  modified_base (228)..(228): a, c, t, g, unknown or other
  misc_feature (228)..(228): n is a, c, g, or t
  modified_base (484)..(504): a, c, t, g, unknown or other
  misc_feature (484)..(504): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgacaaaagntggttcgtttgttttggttttggccggtgaactacgtggggccagggccacccgtggtccaccgtctcctcagcttccaccgacggcccatccggtccttccccgtggccgtcccctgcctccgaggacgccaccgttcgtgggggccacgacggcccgggcccgtggggcctcggcccgtggtaccgaacggtacccttacttaccccattaccgtacgtactcggacgcgggctgggacgaagggcgcagtagnnnnnnnnnnnnnnnnnnnnn

SEQ ID NO: 240844 - DNA, 509 bp, Homo sapiens
  misc_feature: GYAE6OF01AD1HQ.18.39.D06.1.454.CMB.1.raw
  modified_base (180)..(180): a, c, t, g, unknown or other
  misc_feature (180)..(180): n is a, c, g, or t
  modified_base (487)..(487): a, c, t, g, unknown or other
  misc_feature (487)..(487): n is a, c, g, or t
  modified_base (493)..(509): a, c, t, g, unknown or other
  misc_feature (493)..(509): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacncggccgtctattactgtgcgagagccgcgaatatgtggtgacaaagagttgggttcgtttggttttggttttcgggccggtagaacgtacgtggggccgagggccacccgtggtcacccggtctcctcacgtccttccaccaacgggccctagtccggttccctttcccccgtgggcccgcccctcgcctccgaggacgccaccgtcggtcgggggcacgcggccggcccgtggggctcggccgtggtcgaaggtaccttacctcccactacgtcgtactgacggcgggcgtcggacgacggcgacngtacgnnnnnnnnnnnnnnnnn

SEQ ID NO: 240845 - DNA, 406 bp, Homo sapiens
  misc_feature: GYAE6OF01DKX00.18.39.D06.1.454.CMB.1.raw
  modified_base (357)..(357): a, c, t, g, unknown or other
  misc_feature (357)..(357): n is a, c, g, or t
  modified_base (364)..(365): a, c, t, g, unknown or other
  misc_feature (364)..(365): n is a, c, g, or t
  modified_base (367)..(367): a, c, t, g, unknown or other
  misc_feature (367)..(367): n is a, c, g, or t
  modified_base (369)..(369): a, c, t, g, unknown or other
  misc_feature (369)..(369): n is a, c, g, or t
  modified_base (371)..(372): a, c, t, g, unknown or other
  misc_feature (371)..(372): n is a, c, g, or t
  modified_base (374)..(406): a, c, t, g, unknown or other
  misc_feature (374)..(406): n is a, c, g, or t
tcagtacgagtatgcacgaccggtgctcgatttagtgacatctcgctaggttctttggggggaagaggaagactgacggtcctcccaggagttcgaggtgctgggcaccgtgggcatgggggagtgtgtcacaagatttgggctctgggcaccgtgggcagtgggggagtgtgtcacaagatttggccaggcacctggtcacgtctcctcagctccaccaaggccatcggtctccccgtggccgccctgctccgaggacgcaccgtcgtcgggggccaaccgaggccggcccgtgggctcggccgtggtacgaaggtcctacttcccgatactcgtactgacggcggctggcaggcncactagnntncncnncnnnnnnnnnnnnnnnnnnnnnnnnnnnnnnnnn

SEQ ID NO: 240846 - DNA, 540 bp, Homo sapiens
  misc_feature: GYAE6OF01DGC4W.18.39.D06.1.454.CMB.1.raw
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (524)..(540): a, c, t, g, unknown or other
  misc_feature (524)..(540): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagacgccgacgaatatgtgggtnacaaaagnttgggttcgtttggttttggttttggccggttgaactacggtggggccagggcaccgtggtctaccgtctcctcacgtccttccaccgaacgggccctagtccggttcccttcccccgtgggcccgccccgtacgccgtccgaggtcgcctaccgtcggtcgggggcctacgacggccggcccgtggggccttcggccgttcggtacaacgggtacccttaccgttcccaattaacccgttcgtacgtcgggaacggccggggtacgtcggaccggaacggccgacagtacgnnnnnnnnnnnnnnnnn

SEQ ID NO: 240847 - DNA, 182 bp, Homo sapiens
  misc_feature: GYAE6OF01B9MKD.18.39.D06.1.454.CMB.1.raw
  modified_base (176)..(182): a, c, t, g, unknown or other
  misc_feature (176)..(182): n is a, c, g, or t
tcagtacgagtatgcacgaccggtgctcgatttagtgacatctcgcagttctttggggggaagaggaagactgacggtcctcccaggagttcaggtgctgggcacagcggccctgggctgcctggtcaaggactacttcccatactcgtactgagcgggctggcaaggcgcatagnnnnnnn

SEQ ID NO: 240848 - DNA, 277 bp, Homo sapiens
  misc_feature: GYAE6OF01B18UQ.18.39.D06.1.454.CMB.1.raw
  modified_base (273)..(277): a, c, t, g, unknown or other
  misc_feature (273)..(277): n is a, c, g, or t
tcagtacgagtatgcacgaccggtgctcgatttagtgacatctcgcagttctttgggttttgggggaagaggaagactgacggtcctcccaggagttcaggtgctgggcaccgtgggcatggggaggtgtgtcacaagatttgggctctgggcaccgtgggcagtgggggagtgtgtcacaagatttgggctctgggcacagcggccctgggctgcctggtcaaggactacttcccatactcgtactgagcgggctggcaaggcgcataaggnnnnn

SEQ ID NO: 240849 - DNA, 771 bp, Homo sapiens
  misc_feature: GYAE6OF01CWZC7.18.39.D06.1.454.CMB.1.raw
  modified_base (243)..(243): a, c, t, g, unknown or other
  misc_feature (243)..(243): n is a, c, g, or t
  modified_base (721)..(721): a, c, t, g, unknown or other
  misc_feature (721)..(721): n is a, c, g, or t
  modified_base (743)..(743): a, c, t, g, unknown or other
  misc_feature (743)..(743): n is a, c, g, or t
  modified_base (745)..(748): a, c, t, g, unknown or other
  misc_feature (745)..(748): n is a, c, g, or t
  modified_base (750)..(751): a, c, t, g, unknown or other
  misc_feature (750)..(751): n is a, c, g, or t
  modified_base (753)..(753): a, c, t, g, unknown or other
  misc_feature (753)..(753): n is a, c, g, or t
  modified_base (755)..(755): a, c, t, g, unknown or other
  misc_feature (755)..(755): n is a, c, g, or t
  modified_base (757)..(757): a, c, t, g, unknown or other
  misc_feature (757)..(757): n is a, c, g, or t
  modified_base (759)..(761): a, c, t, g, unknown or other
  misc_feature (759)..(761): n is a, c, g, or t
  modified_base (764)..(764): a, c, t, g, unknown or other
  misc_feature (764)..(764): n is a, c, g, or t
  modified_base (766)..(770): a, c, t, g, unknown or other
  misc_feature (766)..(770): n is a, c, g, or t
tcagtacgagtatgcacgaccggtgctcgatttagtgacatctcgagtgggatgggatggatgaacggtaaaactgccaacacaggctatgcagaggcattccagggcagagtcaccatcgaccgggaacccctccaccggcacagcctacatggagctgagcagtctgacactgacgacacggccgtctaattactgtcgcgagacgccgacgaaattagtggtgggtagacgtaaaaaggngtttgggttccggtttttggttttttcgggtttttcggggtacccgggttacggtaaaaccgttaccggttacggggggtacccgaacgggggtaccctaacccggttcgggttaccccgtaacccggtttcccttcccccgttacctacggttacccttttacccgaacccgtaaaacgggggtccccctaaccggtttcccggggtttcccgttttcccccccggttcgggtccccggtcccccgttcggacccgtttacccggtaacggggaccggtaccgtaaccccggtttccggggttacgggggggacccaaccgggtaccggtcccgggtccccgttcggggtccgttcggtcccggttcgggttaccgaaacgggtacctttaacccgtttacccacgttaaccgttcgttacgttacggtacggtcggggtaccgttcgggaccgaacgggtccgacgtaagtacggnctcgctcgctctcgcgacgacngnnnnanngngncncnnntcncnnnnnc

SEQ ID NO: 240850 - DNA, 181 bp, Homo sapiens
  misc_feature: GYAE6OF01D4D88.18.39.D06.1.454.CMB.1.raw
  modified_base (179)..(181): a, c, t, g, unknown or other
  misc_feature (179)..(181): n is a, c, g, or t
tcagtacgagtatgcacgaccggtgctcgatttagtgacatctcgcagttctttgggtttgggggaagaggaagactgacggtcctcccaggagttcaggtgctgggcacagcggccctgggctgcctggtcaaggactacttccaactcgtactgagcgggctggcaaggcgcatagnnn

SEQ ID NO: 240851 - DNA, 377 bp, Homo sapiens
  misc_feature: GYAE6OF01DVJJI.18.39.D06.1.454.CMB.1.raw
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (360)..(377): a, c, t, g, unknown or other
  misc_feature (360)..(377): n is a, c, g, or t
tcagtacgagtatgcacgaccggtgctcgatttagtgacatctcgcagttctttggggggaagaggaagactgacggtcctcccaggagttcaggtgctgggcaccgtgggcatggggggagtgtgtcacaagatttgggctctgggcaccgtgggcatggggggaggtgtgtcacaagatttgggccagggcaccctggtcaccgtctcctcagctccacaaggccatcgtctcccctgcncctgctccaggacncacctcgtggggcacgaggccggcccgtgggcctggccgtggtcaaaggtacctaccttcccataccgttcgtactgacggcggctggacaaggcgacagtagnnnnnnnnnnnnnnnnnn

SEQ ID NO: 240852 - DNA, 352 bp, Homo sapiens
  misc_feature: GYAE6OF01CMJF9.18.39.D06.1.454.CMB.1.raw
  modified_base (347)..(352): a, c, t, g, unknown or other
  misc_feature (347)..(352): n is a, c, g, or t
tcagtacgagtatgcacgaccggtgctcgatttagtgacatctcgcagttctttgggggaagaggaagactgacggtcctcccaggagttcaggtgctgggcaccgtgggcatgggggagtgtgtcacaagatttgggctctgggcaccgtgggcatgggggaggtgtgtcacaagatttgggccagggcaccctggtcaccgtctcctcagcttccaccaagggcccatcggtcttccccctggcgccctgctccaggacgcacctctggggcacagcggccctgggctgcctggtcaaggactacttcccatactcgtactgagcggctggcaaggcgcgatagnnnnnn

SEQ ID NO: 240853 - DNA, 671 bp, Homo sapiens
  misc_feature: GYAE6OF01DZLR9.18.39.D06.1.454.CMB.1.raw
  modified_base (157)..(157): a, c, t, g, unknown or other
  misc_feature (157)..(157): n is a, c, g, or t
  modified_base (425)..(425): a, c, t, g, unknown or other
  misc_feature (425)..(425): n is a, c, g, or t
  modified_base (642)..(642): a, c, t, g, unknown or other
  misc_feature (642)..(642): n is a, c, g, or t
  modified_base (646)..(671): a, c, t, g, unknown or other
  misc_feature (646)..(671): n is a, c, g, or t
tcagtacgagtatgcacgaccggtgctcgatttagtgacatctcgagtggatgggatggatgaacggtaaaactgccaacacaggctatgcagaggcattccagggcagagtcaccatcgacccgggaacccctccaccggcacagcctacatgganctgagcagtctagaccacctgacgaccgaccggtccttcttattactgtcgacgagacgcccgagtaattagtggtggtagaacgtaaaggttgtttgggtttcggtttttggtttttcggtttcgggaccggttagtaaaccgttcgggtcggggacccgtacggggtaccctaccgttcggtaccctacccgttcctcccgtcacgtccccttacccgaaccggtaaccgggtccctacggttcccggttcccctttacccccggnggccccgtcccgtgtcccgtaccggaggaccgtcccgtaccgttcggggcggggacctaccggacggtccccgggtccggtcgggccgttcggtacccggttaggtaacccgtaaacgggttaccctttaaccccgtacccgtaacgtttacccgtacggtaccggttcgggacggggtcccgggtacggtacgggacccgtaaagggcccagtaancggnnnnnnnnnnnnnnnnnnnnnnnnnn

SEQ ID NO: 240854 - DNA, 514 bp, Homo sapiens
  misc_feature: GYAE6OF01B2H5Z.18.39.D06.1.454.CMB.1.raw
  modified_base (170)..(170): a, c, t, g, unknown or other
  misc_feature (170)..(170): n is a, c, g, or t
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (483)..(514): a, c, t, g, unknown or other
  misc_feature (483)..(514): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacncctgacgacacggccgtctattactgtgcgagagccgacgaatatgtggtnacaaagntggtcgtttgtttgtttggcggtgaactacgtgggccgagggccaccgtggtccaccgtctcctcagccttccaccgacgggcccagtccggtccttcccccgtggccgccctgcctccgaggacgccaccgtcggtcgggggcacgcggccggcccgtcgggctcggccgtcggtacaacgggtaccttaccttcccattacctcgttacgtggacggccgggcgtcgggacgaacgggcgacctaagtacgcnnnnnnnnnnnnnnnnnnnnnnnnnnnnnnnn

SEQ ID NO: 240855 - DNA, 369 bp, Homo sapiens
  misc_feature: GYAE6OF01B3E3S.18.39.D06.1.454.CMB.1.raw
  modified_base (359)..(369): a, c, t, g, unknown or other
  misc_feature (359)..(369): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcagtgggggaggtgtgtcacaagatttgggctctgggcaccgtgggcatgggggaggtgtgtcacaagatttgggctctgggcaccctggtcaccgtctcctcagcttccaccaagggcccatcggtcttccccctggccgccctgctccaggacgccacctcgtgggggcacagcggccctgggctgcctggtcaggactactcccatctcgtactgagcgggctggcaaggcgcatagnnnnnnnnnnn

SEQ ID NO: 240856 - DNA, 234 bp, Homo sapiens
  misc_feature: GYAE6OF01DS54L.18.39.D06.1.454.CMB.1.raw
  modified_base (227)..(234): a, c, t, g, unknown or other
  misc_feature (227)..(234): n is a, c, g, or t
tcagtacgagtatgcacgaccggtgctcgatttagtgacatctcgcagttctttggggttttggggggaagaggaagactgacggtcctcccaggagttcaggtgctgggcaccgtgggcagtgggggagtgtgtcacaagatttgggctctgggcacagcggccctgggctgcctggtcaaggactactcccatactcgtactgagcggctggcaaggcgcatagnnnnnnnn

SEQ ID NO: 240857 - DNA, 565 bp, Homo sapiens
  misc_feature: GYAE6OF01DZEVG.18.39.D06.1.454.CMB.1.raw
  modified_base (148)..(148): a, c, t, g, unknown or other
  misc_feature (148)..(148): n is a, c, g, or t
  modified_base (212)..(212): a, c, t, g, unknown or other
  misc_feature (212)..(212): n is a, c, g, or t
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (361)..(361): a, c, t, g, unknown or other
  misc_feature (361)..(361): n is a, c, g, or t
  modified_base (533)..(533): a, c, t, g, unknown or other
  misc_feature (533)..(533): n is a, c, g, or t
  modified_base (535)..(565): a, c, t, g, unknown or other
  misc_feature (535)..(565): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctanatggagctgagcagtctgacacctgacgacacggcctctattactgtgcgagagccgcgaaatntggtggtanacaaaagngttgggtcgtttgtttttggttttcggccggttagaaccttacgtcggggccaggggccacccgttgggtccacccggtctccctcgacgctttcccaaccgaacgggccccagtccggttcccttccccgnggcccgtcccctgccctcgaggcgccaccgtcggtggggcctacgcggccggtcccgtggggctcggcccgtagggtaccaacgggtacctttacccgttaccctaacttacccgttcggtaccgtggacgggtccgggtacggtcggaccgaaacgggcgacctagtacgngnnnnnnnnnnnnnnnnnnnnnnnnnnnnnnn

SEQ ID NO: 240858 - DNA, 789 bp, Homo sapiens
  misc_feature: GYAE6OF01DH36Z.18.39.D06.1.454.CMB.1.raw
  modified_base (293)..(293): a, c, t, g, unknown or other
  misc_feature (293)..(293): n is a, c, g, or t
  modified_base (327)..(327): a, c, t, g, unknown or other
  misc_feature (327)..(327): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagtaattttgatatccattgggtgcgacaggccagtggacaagggctcgagtggatgggatggatgaaacggtaaaactgaccaacacaggctatgcagaggcattccgagggcagacgtcaccagtcggacccgggaaccccctccgaccggccacgacgcctacagtcgganctgacgcagtctgaccacgtgacgacacggcctntatactgtcgcgagcgccgacgtaatacgtggtgacgaacgtaaaagtgttggtttcgttttaggtttttcgggttttacgggacccggtttagaaccgttacgggtcggggtaccccgacgggtcccctaaccccggtcgggttaccccgtacccggttcccttaccgtccgaacgtcccctttacccgaacccggtaaaccgggcccccttaacggttccccggtttccccgttaccccccggtggcccccgtaccccgtttcgaccccgttacccggaacgggtaccccgtacccgttaccccggttcccggggtccgggggaccctaacccgggtaccggggcccccgggttccccgggtacgggggtcccttcccggggtaccccgtttacggggtaccctaaaacccggggtttacccccttaccccgtttaacccccgtaaggtttacccccggg

SEQ ID NO: 240859 - DNA, 399 bp, Homo sapiens
  misc_feature: GYAE6OF01EBCL8.18.39.D06.1.454.CMB.1.raw
  modified_base (380)..(380): a, c, t, g, unknown or other
  misc_feature (380)..(380): n is a, c, g, or t
  modified_base (386)..(399): a, c, t, g, unknown or other
  misc_feature (386)..(399): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcagtgggggaggtgtgtcacaagatttgggctctgggcaccgtgggcagtgggggagtgtgtcacaagatttgggctcgtggcacctggtcaccgtctcctcagccttccaccgaacgggcccatccggtccttcccccgtggccgccctgcctccgaggacgccaccgtcgtgggggccacgacggccggcccgtggggctcgcctggtacaaggtccttacctcccatacctcgtactgacgcgggtctggacaaggccnaagtgnnnnnnnnnnnnnn

SEQ ID NO: 240860 - DNA, 727 bp, Homo sapiens
  misc_feature: GYAE6OF01B1DN1.18.39.D06.1.454.CMB.1.raw
  modified_base (254)..(254): a, c, t, g, unknown or other
  misc_feature (254)..(254): n is a, c, g, or t
  modified_base (325)..(325): a, c, t, g, unknown or other
  misc_feature (325)..(325): n is a, c, g, or t
tcagtacgagtatgcacgaccggtgctcgatttagtgacatctcgcagtttctttgggttttggggggaagaggaagactgacggtcctcccaggagttcaggtgaagaaccctggggcctcagtgaaggtctcctgtcagacctatggattccccttccagtaattttgatatccattgggtgcgacaggccagtggacaagggctcgagtggatgggatggatgaacggtaaaactgaccaacacaggctangcagaggcatccgaggcagagtcaccagtcgacccgggaaccctcgaccggcaccagccctacgatggacnctaggacgcagtctagaccaccgtgaccgaaccgaccgggtcctactacgtttactggtacgacgaacggacgccgacgaaattatggtggtagacgaaaaggtgttacgggttcgttttggtttttggttttcggggtcccggttaggttaaccgttacggtcgggggaccacggggtccctacccgttcgggtaccctacccggttcccttcccgtactaccgtacccgtttaccccgaacccggtaaccgggtcccctaacggttccccgggtttccccttaccccccggtcgggtccccgtccccgtcggtcccgtcccggaaggacccgtcccgaccccggttcgggtcggggacccaacccgtaccgggccccggttcccggtccggggtacccgg

SEQ ID NO: 240861 - DNA, 543 bp, Homo sapiens
  misc_feature: GYAE6OF01CXI1Q.18.39.D06.1.454.CMB.1.raw
  modified_base (231)..(231): a, c, t, g, unknown or other
  misc_feature (231)..(231): n is a, c, g, or t
  modified_base (515)..(543): a, c, t, g, unknown or other
  misc_feature (515)..(543): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgacgaatagtgtgggtgacaaaagnttgggtcgttttggtttttggtttgggccggttgaactacggtggggccagggccacccgtggtccaccgtctccctcgacgccttccaaccgaacgggccccagttccggttcccttccccccgtgggcccgcccctcgcctccgaggacgctaccgtcggtgggggccacgacggccggccgtgggcctcggccgtgggtaccaacgggtaccttaaccgttccctaactaccgttacggtactcggacggcgggcgtgggacgaacggccgactagtacgnnnnnnnnnnnnnnnnnnnnnnnnnnnnn

SEQ ID NO: 240862 - DNA, 241 bp, Homo sapiens
  misc_feature: GYAE6OF01BXAWM.18.39.D06.1.454.CMB.1.raw
  modified_base (227)..(241): a, c, t, g, unknown or other
  misc_feature (227)..(241): n is a, c, g, or t
tcagtacgagtatgcacgaccggtgctcgatttagtgacatctcgcagttctttggggtttgggggaagaggaagactgacggtcctcccaggagttcaggtgctgggcaccgtgggcagtgggggagtgtgtcacaagatttgggctcgtgggcacagcggccctgggctgcctggtcaaggactacttcccatactcgtactgagcgggctggcaagcgcatagnnnnnnnnnnnnnnn

SEQ ID NO: 240863 - DNA, 737 bp, Homo sapiens
  misc_feature: GYAE6OF01DC9ZT.18.39.D06.1.454.CMB.1.raw
  modified_base (703)..(703): a, c, t, g, unknown or other
  misc_feature (703)..(703): n is a, c, g, or t
  modified_base (709)..(737): a, c, t, g, unknown or other
  misc_feature (709)..(737): n is a, c, g, or t
tcagtacgagtatgcacgaccggtgctcgatttagtgacatctcgagtggatgggatggatgaaacggtaaaactgccaacacaggctatgcagaggcattccgagggcagagtcaccatcgacccgggaaccccctccgacccggcacagcctacagtggagctggagcagtctgaccacctgaaccgacgaccggcctacttattacgtggtcgcgagacggcccgagtaattagtggtggtacgaacgaaaaggtgtttgggtttcggttttttgggtttttcgggttttccgggaccggttaggtaaaccgttccgggtcgggggaccaacggggtcccctaccggttcgggtacccctacccggttccttcccgtaccgtaaccgttccccgttacccccgaaacccgggtaaccgggtcccccgttaacggtttcccccgggttttcccccttccccccgggtgggtccccccgtccccgttcggtaccccgtaccggaagggcccgtcccgtacccggttcgggggcggggacccaccgggtccgggtccccgggtcccggttggggcccttccgggtacccggtttagggtaaaccggtaaaccggttacctttaccccgttaccgtaacgttcccgttacggtaaccgtgggaccgggccgggtacgtacgggaccgtaacgggtcctaaaggntaggcnnnnnnnnnnnnnnnnnnnnnnnnnnnnn

SEQ ID NO: 240864 - DNA, 460 bp, Homo sapiens
  misc_feature: GYAE6OF01DVVOC.18.39.D06.1.454.CMB.1.raw
  modified_base (303)..(303): a, c, t, g, unknown or other
  misc_feature (303)..(303): n is a, c, g, or t
  modified_base (438)..(460): a, c, t, g, unknown or other
  misc_feature (438)..(460): n is a, c, g, or t
tcagtacgagtatgcacgaccggtgctcgatttagtgacatctcgcagttctttggggggaagaggaagactgacggtcctcccaggagttcaggtgctgggcaccgtgggcagtgggggaggtgtgtcacaagatttgggctcgtggcaccggtgggcagtggggggagtgtgtcacaagtagtttgggccgagggccacccgtggtccacccgtcctcctcacgtccttacccaaccgaacgggcccctacgttccgggttccccttcccccgtggcccgtcccctcgcctccgacggacnccgtaccgtcggtcggggccaacgcggcccggccgtcgggctcggtaccgtggtacaacggtaccttaacccttcccgtactccgttacgtacgtacggcggtccggcgtcggaccgaaggccgagtaagtgctnnnnnnnnnnnnnnnnnnnnnnn

SEQ ID NO: 240865 - DNA, 366 bp, Homo sapiens
  misc_feature: GYAE6OF01AO899.18.39.D06.1.454.CMB.1.raw
  modified_base (350)..(350): a, c, t, g, unknown or other
  misc_feature (350)..(350): n is a, c, g, or t
  modified_base (356)..(366): a, c, t, g, unknown or other
  misc_feature (356)..(366): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggaggtgtgtcacaagatttgggctctgggcaccgtgggcatgggggagtgtgtcacaagatttgggccagggcaccctggtcaccgtctcctcagcttccaccaagggcccatcggtctcccctggcgccctgctccaggagcacctcgtgggggccacagccggcccgtgggctcgcctggtcaaggacctaccgttcccatacctcgtactgacgcgggctggcaaggcncatagnnnnnnnnnnn

SEQ ID NO: 240866 - DNA, 507 bp, Homo sapiens
  misc_feature: GYAE6OF01COSW6.18.39.D06.1.454.CMB.1.raw
  modified_base (230)..(230): a, c, t, g, unknown or other
  misc_feature (230)..(230): n is a, c, g, or t
  modified_base (476)..(507): a, c, t, g, unknown or other
  misc_feature (476)..(507): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaaccccctccaccggcacagcctacatggagctgagcagtctgacacctgacgacacggccgtctattactgtgcgagagccgacgaatatgtggtgacaaaagntggtcgtttgttttgtttggccggtgaactacgtggggccagggcaccctggtccaccgtctcctcagccttccaccaagggcccatccggtcttccccctggcccgccctgcctccgaggacgccacctcgtgggggccacgagccggcccgtgggctcgcctggtcaaggtactaccttccccattaccgtccgtactcggacggccgggcgtcggaccgaacgggccgtaccaagttaggacnnnnnnnnnnnnnnnnnnnnnnnnnnnnnnnn

SEQ ID NO: 240867 - DNA, 660 bp, Homo sapiens
  misc_feature: GYAE6OF01EYKJW.18.39.D06.1.454.CMB.1.raw
  modified_base (277)..(277): a, c, t, g, unknown or other
  misc_feature (277)..(277): n is a, c, g, or t
  modified_base (288)..(289): a, c, t, g, unknown or other
  misc_feature (288)..(289): n is a, c, g, or t
  modified_base (296)..(296): a, c, t, g, unknown or other
  misc_feature (296)..(296): n is a, c, g, or t
  modified_base (478)..(478): a, c, t, g, unknown or other
  misc_feature (478)..(478): n is a, c, g, or t
tcagtacgagtatgcacgaccggtgctcgatttagtgacatctcgcagttctggggctgaggtgaagaacccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgacccggaaccctccaccggcacagcctacatgganctgagcagttnnctacacncgtcgaccgaccgaccggtccgtacttaacttacgtgtcgacgacgacgccgacgtaactagtggtggtacgacgaaagtagttcggttcgttttggttttcggtttcgggtaccggtacgtaacgtacggtcgggaccgacggtaccgtacccgtcgtccgtacccgactcctccgtacgnttcccgacccgtaacgggaccccaacgtcccggtacctttccccccgttcggtccccgtccccgttcgcccttcccgaccggtaccgtccgacccgtccgtcggggccgaccggacgccggccccgtcggggtcccgtcggcccgttcggtacccgtaacgggtaccgtaaccgttaccccg

SEQ ID NO: 240868 - DNA, 620 bp, Homo sapiens
  misc_feature: GYAE6OF01B28KP.18.39.D06.1.454.CMB.1.raw
tcagtacgagtatgcacgaccggtgctcgatttagtgacatctcgcagttctttggggctgtcctttggttttggagatggttttctcgatgggggctgggagggctttgttggagaccttgcacttgtactccttgccgttcagccagtcctggtgcaggacggtgaggacgctgaccacacggaacgtgctgttgaactgctcctcccgcggctttgtcttggcattatgcacctccacgccgtccacgtaccacttgaactggacctcgggtcttcgtggctcaagtccaccaccacgcacgtgacctcgaggggtccggaaatcataagggtatccgttggggttttgggggaagtaggaagactgacggtcctcccgaggagttcaggtgaacggaaccctggggcctcgaggtgaaggtctcctgtcagacctatggacttcccctacagtaattttgattatccgtagttcgggtgacgtacagggcccaggttcggaacgtaaggggctacggagttagggagttggggattgggaagttacggaaacgggttaaaactcgggaacccaaacgaccgaagggtccttaagttaggactaagggaggtacccg

SEQ ID NO: 240869 - DNA, 671 bp, Homo sapiens
  misc_feature: GYAE6OF01DD81A.18.39.D06.1.454.CMB.1.raw
  modified_base (639)..(639): a, c, t, g, unknown or other
  misc_feature (639)..(639): n is a, c, g, or t
  modified_base (641)..(671): a, c, t, g, unknown or other
  misc_feature (641)..(671): n is a, c, g, or t
tcagtacgagtatgcacgaccggtgctcgatttagtgacatctcgagtggatgggatggatgaacggtaaaactgccaacacaggctatgcagaggcattccagggcagagtcaccatcgaccggggaacccctccgaccggcacacgcctacatggagctggagcagtctgacacctgacgacgacggccgtcttattactggcggcgagacgcccgagtaatagtggtgggtacgaacaaaagtggtttgggtttcggtttttggttttttcggggtttacggcccgggttagtaaaccgtacgggtcggggggacccaggggcccctacccggttggtaccctacccgttccttacccgtacgacgttccccttacccgaaccgggtaaccgggtccccttacggttcccgtttcccccgtccggcggtccccgtccgtcgaccgtcggagccgccccgtacgggttcgggggacgaccacgggacccgggtcccggtaccgggtcggtccgttccggtacccgggttagtaaacccggtacccggtttaccctttacccgtacccttacgttacccggttacggtggtacgggaccggggtccgtaggaaccgggacggtacggcctagagtcgnannnnnnnnnnnnnnnnnnnnnnnnnnnnnnn

SEQ ID NO: 240870 - DNA, 808 bp, Homo sapiens
  misc_feature: GYAE6OF01DIDFZ.18.39.D06.1.454.CMB.1.raw
  modified_base (716)..(716): a, c, t, g, unknown or other
  misc_feature (716)..(716): n is a, c, g, or t
  modified_base (741)..(741): a, c, t, g, unknown or other
  misc_feature (741)..(741): n is a, c, g, or t
  modified_base (750)..(750): a, c, t, g, unknown or other
  misc_feature (750)..(750): n is a, c, g, or t
tcagtacgagtatgcacgaccggtgctcgatttagtgacatctcgagtggatgggatggatgaacggtaaaactgccaacacaggctatgcagaggcattccgagggcagacgtcaccagtcggaacccgggaacccctccgaaccggcaacacgcctacagtggagctgagcagtctgacacctgacgacgacggtccttcttattacgtgtcgcgagacgccgacgtaatgtggtggtagaacgaaagtgttcgggttcgttttggtttttcgggtttcgggccggttagtaacgttcgggtcggggaccgtaacgggtccctaccggttcggtacccgtaccgttccttccctacgaccggttcccgttaccccgaaccggtaaccgggtccctacggtttccccggtttccctttcccccggtggccccgttccccgttcgccgtacccgagggtaccgacccgttaccggtccggggtaccgggggacctaaccggaccgggtccccgggtccgggttcgggggtacccgttaccgggtaccggtttaccgggtaaaccgtaaacccgggttaaccccttttacccggtttaccccgtaaacggtttacccccggtttacgggtttaaccgggacggggtaccggggtacccgggggtaccgttaacggggaacccgtaacggggtaccctaacggtaaacgttgggaccngtacgcgtcgcgtacgcgtacgtcncgtacgtcncgtcgtcgacgtcgtcgtcgtcgcgtcgtcgtagtcgtcgtcgtacgcgtcgtcgtcg

SEQ ID NO: 240871 - DNA, 862 bp, Homo sapiens
  misc_feature: GYAE6OF01D82VI.18.39.D06.1.454.CMB.1.raw
  modified_base (235)..(235): a, c, t, g, unknown or other
  misc_feature (235)..(235): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (340)..(340): a, c, t, g, unknown or other
  misc_feature (340)..(340): n is a, c, g, or t
tcagtacgagtatgcacgaccggtgctcgatttagtgacatctcgcgagttctggggctgaggtgaagaaccctggggcctcagtgaaggtctcctgtcagacctatggattccccttccagaattttcgatatccattgggtgcgacaggccagtggacaagggctcgagtggatgggatggatgaacggtaaactgccaacacaggctatgacagagcacttccgagggcagngtcaccagtcggaccggaccctccgacggcacagcctacatggacnctagancacgtcngaccacctgacgacgcggtcctctattactgtacggcgaaggtacnccggacgtaagtcgtggttcgggtagaacgaaaggtcgttggtttacggttttgttttcgggttttccgggaccggtttacgtaaaccggttacgggtcggggacccgtacggggtaccctaaccccggttgggtaccccgtaacccgtttccgttacccgttaccggtaaccgttcccgtttaacccggaacccggtaaccggggtcccccttaacggtttccccgggtttaccccgtttaccccccggtacggggtcccccgttacccccgttccggggtaccccttacccgggtaaccgggtacccggttaccccgtaaccccgggtttaccgggtacccgggggggggtaacccctaacccggggtaacccggggtccccggggtccccccgggtttacgggggtcccccgttaacccgggggtcccccgttaaaccggggtttaccccgggaaaacccgggttacccccgtttttaaccccgttaaccccccggttaacggttttaaaccccccggg

SEQ ID NO: 240872 - DNA, 529 bp, Homo sapiens
  misc_feature: GYAE6OF01DQ84T.18.39.D06.1.454.CMB.1.raw
  modified_base (232)..(232): a, c, t, g, unknown or other
  misc_feature (232)..(232): n is a, c, g, or t
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (502)..(502): a, c, t, g, unknown or other
  misc_feature (502)..(502): n is a, c, g, or t
  modified_base (504)..(529): a, c, t, g, unknown or other
  misc_feature (504)..(529): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagacgccgacgaatatggtggtgacaaaagtnttgggttcgttttgtttttggttttcgggccggttagaaccgtacggtgggggccaggggtccacccgttggtcctaccgtctacctcagtccttccaccgaacggcccacgtccgtcccttccccgnggcctccctgcctccgaggacgcaccgtcggnggggccagcggcgccgtggctcgccgtgtacgaacggtactaccgttccacttaccgtacgtacgtgacgggccgggtcgacgggtaccgaagggtccgacgtagtacgngnnnnnnnnnnnnnnnnnnnnnnnnnn

SEQ ID NO: 240873 - DNA, 446 bp, Homo sapiens
  misc_feature: GYAE6OF01C12CD.18.39.D06.1.454.CMB.1.raw
  modified_base (427)..(446): a, c, t, g, unknown or other
  misc_feature (427)..(446): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggagtgtgtcacaagatttgggctctgggcaccgtgggcatgggggagtgtgtcacaagatttgggccagggcaccctggtcaccgtctcctcagctccaccaagggcccatccggtccttccccccgtggccgcccctgcctacccgaggacgccacccgtcgtcggggggccaccgacggccgggccccgtgggggcctcggcccttggggtaccaaacgggtacctaccgtttcccccaattaaccgtccgttaacgtggtaacgggccgggggtcttcgggacccgtaaagggccgacaagtaggnnnnnnnnnnnnnnnnnnnn

SEQ ID NO: 240874 - DNA, 750 bp, Homo sapiens
  misc_feature: GYAE6OF01BR9LA.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatggaccggaacccctccaccggcacacgcctacatggagctgagcagtctgacacctgaccgacgacggccgtcttacttacgtgtgcgagacgcccgacgaatagtggtggtacgacaaaaggtgttggttcgttttggttttaggttttcgggaccgggtttagaaccgttacgggtcggggaccccgaggggtcccctaccccggttgggtaccctacccggttcctcccgttacgaaccgtccctttacccgaacccgtaacggggtccccctaagtttcccgggttacccctttccccccggtgggcccccgtacccccgttgggaccccttacccggaacgggaccgtaccccgtaaccccgtccgggaaggacccgaccgaacccgccggggtccccgggttacccccggttcgggggccccttaaccggggtccccggtttaggggttaaccccccgaaaaggggtttaccccctttaaaccccgttccccccgttaaaacgg

SEQ ID NO: 240875 - DNA, 803 bp, Homo sapiens
  misc_feature: GYAE6OF01E0GMY.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggacttccccttccagtaattttgatatccagttgggtgcgacaggccaggtggacaagggctcggaggtggagtggggatggataggaaacggtaaactcgaccaacacgaggctatgcagagctacgtccgagggcagacgtccaccgagtaccggaccccggacccctcccgaccggaccacgacgaccctacgagtcgggacgcgtaggacgtcgtacgtcctacgaacccgtaccgtcggaaccgaccggtacccggtccgttacttaacgttccgtggtcgaccggacggaccgcccgagtaagttacggtgggtcggtacgaacgtaaaggttcggtttcgggtttcggttttttggttttcgggtttacgggaccggttaaggtaaccgttcggggtcgggacccgtacgggtcccctaaccggttccggttaccccgtccttccgtccgtaccgtaccgttccctaacccggaacccgtaccgggtcccttacggtttccccggttccccttccccgggtggtccccctcccttcgggaccctccggaaccggtcccgtacccgtaccggtccggggtaccggaccacccgggtaccggtccccgggtcccggttcgggcccttacccgggtccggttacgggtaacccgttaacgttacccttacccgttacgtaccgttacccggg

SEQ ID NO: 240876 - DNA, 459 bp, Homo sapiens
  misc_feature: GYAE6OF01B8AU6.18.39.D06.1.454.CMB.1.raw
  modified_base (231)..(231): a, c, t, g, unknown or other
  misc_feature (231)..(231): n is a, c, g, or t
  modified_base (298)..(298): a, c, t, g, unknown or other
  misc_feature (298)..(298): n is a, c, g, or t
  modified_base (352)..(352): a, c, t, g, unknown or other
  misc_feature (352)..(352): n is a, c, g, or t
  modified_base (449)..(449): a, c, t, g, unknown or other
  misc_feature (449)..(449): n is a, c, g, or t
  modified_base (451)..(459): a, c, t, g, unknown or other
  misc_feature (451)..(459): n is a, c, g, or t
tcagtacgagtatgcacgaccggtgctcgatttagtgacatctcgagtggatgggatggatgaacggtaaaactgccaacacaggctatgcagaggcattccagggcagagtcaccatcgaccgggaacccctccaccggcacagcctacatggagctgagcagtctgacacctgacgacacggccgtctattactgtgcgagagccgacgaatagtgtggtgacaaaagntgggtcgtttggttttgtttggccggtgaactacgtgggccaggccaccgtggtcaccgtctcctcngcttccaccgacggccctagtccgtcttcccccgtgccgccctgctcgacggcncaccgtcgtggggccacgcgccggcccgtgggctcgcgtggtacacggtctaccttccatacctcgtactggacgtcgggctgggacaaggccatangnnnnnnnnn

SEQ ID NO: 240877 - DNA, 191 bp, Homo sapiens
  misc_feature: GYAE6OF01C3AWL.18.39.D06.1.454.CMB.1.raw
  modified_base (164)..(164): a, c, t, g, unknown or other
  misc_feature (164)..(164): n is a, c, g, or t
  modified_base (174)..(174): a, c, t, g, unknown or other
  misc_feature (174)..(174): n is a, c, g, or t
  modified_base (180)..(191): a, c, t, g, unknown or other
  misc_feature (180)..(191): n is a, c, g, or t
tcagtacgagtatgcacgaccggtgctcgatttagtgacatctcgcgaggttctttgggtttgggggaagaggaagactgacggtcctcccaggagttcaggtgctggcacagcggccctggctgcctggtcaaggctacttccatactcgtactgagccgggntggcaaggcncatagnnnnnnnnnnnn

SEQ ID NO: 240878 - DNA, 364 bp, Homo sapiens
  misc_feature: GYAE6OF01BMMGL.18.39.D06.1.454.CMB.1.raw
  modified_base (358)..(364): a, c, t, g, unknown or other
  misc_feature (358)..(364): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcatgggggaggtgtgtcacaagatttgggctctgggcaccgtgggcatgggggaggtgtgtcacaagatttgggctctgggcaccctggtcaccgtctcctcagcttccaccaagggcccatcggtcttccccctggccgccctgctccaggagccacctccgagacgcacagcccgcctgggctgcctggtcaaggctacttcccatctcgtactgagcgggctggcaaggcgcatagnnnnnnn

SEQ ID NO: 240879 - DNA, 1019 bp, Homo sapiens
  misc_feature: GYAE6OF01DP2ZR.18.39.D06.1.454.CMB.1.raw
  modified_base (146)..(146): a, c, t, g, unknown or other
  misc_feature (146)..(146): n is a, c, g, or t
  modified_base (355)..(355): a, c, t, g, unknown or other
  misc_feature (355)..(355): n is a, c, g, or t
tcagtacgagtatgcacgaccggtgctcgatttagtgacatctcgcagttctggggctgaggtgaagaacccgtggggcctcagtgaaggtctcctgtcagacctatggacttccccttcagtaattttgatactccgattgggtncgacgacggccaggtggacaagggctcgagtggagtgggatggacttacggaaacggtaaactgaccaaacgacgaggtacctaagtggacaggacggtactacgttaccggagggaccaggtacgtaccaccgtagtaccggaaccccggtacccctcgacccggacacgacgtacctacaggtggactcgtagacgcgtcggttacncgtaacccacgtcggaccgtaaccggtaccgggtccttaacgtaacgtttacggtccggtaggacccggtaaagggtaccgtaccgggtaaccgtaaaacggtttggttaacggggttaccgggaaaccgtaaaacggtaaaaccggtttggggtttttaccgggttttaacggttttttccgggggttttttacgggttacccggggtaaaccgggttacggttaaacccccggttcggggtaaccgggggtcccgtaacggggttaccccccggttaaccggtttcccggggttaaaccccgtaaccccgtttccccgggtcccttaagggtaaccccgtttaccccggttaacccggtaaacccccggaccgggtttaccccccgttaccgggttttaacccccgggtttccccccttccccggggttaaccggtcccccggtccccggttacggttacccccggttacggaaacccggttccccgggtaccccgtaccggggttcccggggtaacgggtaacccggtaccccggtaacgggcccccggggtttccgggttaacccgggtcccggttaaccccgggacccggtttaaccggggtaaccgttaaccccggttaaacccttcccggttttaaccccaacggggtttacccccg

SEQ ID NO: 240880 - DNA, 539 bp, Homo sapiens
  misc_feature: GYAE6OF01DH3XI.18.39.D06.1.454.CMB.1.raw
  modified_base (234)..(234): a, c, t, g, unknown or other
  misc_feature (234)..(234): n is a, c, g, or t
  modified_base (394)..(394): a, c, t, g, unknown or other
  misc_feature (394)..(394): n is a, c, g, or t
  modified_base (516)..(516): a, c, t, g, unknown or other
  misc_feature (516)..(516): n is a, c, g, or t
  modified_base (522)..(539): a, c, t, g, unknown or other
  misc_feature (522)..(539): n is a, c, g, or t
tcagtacgagtatgcacgaccggtgctcgatttagtgacatctcgagtggatgggatggatgaacggtaaaactgccaacacaggctatgcagaggcattccagggcagagtcaccatcgaccgggaacccctccgaccggcacagcctacatggagctgagcagtctgacacctgacgacacggcctctattactgtgcgagacgccgacgaatagtggtggtagacaaaagngttgggttcggttttggtttttggttttcggccggttagaaaccgtcggtcggggccaggggccaccgttggtccaccgtcctcctcacggtccttaccgaccgtaacgggccctagtcccggtttcctcccccgtggccgcccttgcctaccgaggacnccaccgtcggtcggggaccacgacggcccggtccgtgggacctcgtccgtcgggtcaaaacggtcctttaaccgtcccaagttaccgtacgtacgtgacggcgggcgtggaacgaggccganatacgnnnnnnnnnnnnnnnnnn

SEQ ID NO: 240881 - DNA, 567 bp, Homo sapiens
  misc_feature: GYAE6OF01AXSFO.18.39.D06.1.454.CMB.1.raw
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (535)..(538): a, c, t, g, unknown or other
  misc_feature (535)..(538): n is a, c, g, or t
  modified_base (540)..(567): a, c, t, g, unknown or other
  misc_feature (540)..(567): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagcccgnaaatagtggtggtgacaaaaggnttgggttcgttttggttttggtttttcgggccggttgaacttacggtggggccaggggccacccgttggtccacccgttctccctcacgtccttaccaccgaacgggtccctacgttccgggtccctttccccccgtggcccgtccctcgccctccgaggcgcctaccgtcggtcgggggcaccgcggcccggtcccgtggggctcggcccgtgggtaccgaacggtaccttaccgttcccagttaccgtcggtaactgggacgggccgggtcgtacgggactaacgggccgacgtaagtagnnnngnnnnnnnnnnnnnnnnnnnnnnnnnnnn

SEQ ID NO: 240882 - DNA, 476 bp, Homo sapiens
  misc_feature: GYAE6OF01CHQTQ.18.39.D06.1.454.CMB.1.raw
  modified_base (295)..(295): a, c, t, g, unknown or other
  misc_feature (295)..(295): n is a, c, g, or t
  modified_base (442)..(442): a, c, t, g, unknown or other
  misc_feature (442)..(442): n is a, c, g, or t
  modified_base (447)..(476): a, c, t, g, unknown or other
  misc_feature (447)..(476): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcagtggggggaggtgtgtcacaagatttggactctgggcaccgtgggcagtggggggagtgtgtcacaagtagttgggccaggggcacccgtggtcaccgtctcctcagcttccaccaagggcccatccggtccttccccgtggcccgccctgcctaccgaggacgccaccgttcgnggggggccacgcggccggccgtcggggctcggaccgtcgggtaccgaaggtacccttaaccgttcccaacgttaccgttaccggtaacgttcgggaacggggtccgggtaccgttacggggaccgaaacgggtccgaccggttaaanagggnnnnnnnnnnnnnnnnnnnnnnnnnnnnnn

SEQ ID NO: 240883 - DNA, 717 bp, Homo sapiens
  misc_feature: GYAE6OF01DNMGU.18.39.D06.1.454.CMB.1.raw
  modified_base (145)..(145): a, c, t, g, unknown or other
  misc_feature (145)..(145): n is a, c, g, or t
  modified_base (223)..(223): a, c, t, g, unknown or other
  misc_feature (223)..(223): n is a, c, g, or t
  modified_base (677)..(677): a, c, t, g, unknown or other
  misc_feature (677)..(677): n is a, c, g, or t
  modified_base (706)..(706): a, c, t, g, unknown or other
  misc_feature (706)..(706): n is a, c, g, or t
tcagtacgagtatgcacgaccggtgctcgatttagtgacatctcgcagttctggggctgaggtgaagaaccctggggcctcagtgaaggtctcctgtcagacctatggacttccccttcagtaattttgatactccagttgggtncgacaggccagtaggacgaagggctcggagtggagtgggatggataggaaacggtaaactgaccaacacgaggctagngcgagagctagtaccgaggcagagtaccaccgagtaccggaacccggacccctaccgaccggcaaccgacgacctaacgagtcgggactcgtagacgctaaggttccacgaacctaccgtacggaacccgaccggtaccgtccgttacttacgttacgtcggacggacgaggacccgaccgtaacgtaagtgtacgggtacggtagaaacgtaaaggttcggtttggtttaccgtttttggttttacgggtttaccgggacggttacgttaacccgggtcgggttacccggggaccgtacgggtcccctacgggttccgtaccctacccgtctactacgacctcccgtaaccgaccggtaccggacctccggttcccgtcccctcccgtccgaccctcccgtcgaccgtacgcttccgaccgtgggaccgcaacggccggccgtccggtgtccncggtacgtacgtactccgtactacccgtnacgttcgtcgg

SEQ ID NO: 240884 - DNA, 402 bp, Homo sapiens
  misc_feature: GYAE6OF01C6XVM.18.39.D06.1.454.CMB.1.raw
  modified_base (262)..(262): a, c, t, g, unknown or other
  misc_feature (262)..(262): n is a, c, g, or t
  modified_base (369)..(402): a, c, t, g, unknown or other
  misc_feature (369)..(402): n is a, c, g, or t
tcagtacgagtatgcacgaccggtgctcgatttagtgacatctcgcagttctttggggttttggggggaagaggaagactgacggtcctcccaggagttcaggtgctgggcaccgtgggcatgggggaggtgtgtcacaagatttgggctctgggcaccgtgggcatgggggagtgtgtcacaagatttgggctcgtgggcaccctggtccacccgtctcctcagcttccaccaaagggcccatccggtcttcccctggccnccctgctccaggacgcacctcgtggggcacgagcgccctggctgcctgcaaggctaactccccatacctcgtactgacgccgggctggacaacgggcacgatacgannnnnnnnnnnnnnnnnnnnnnnnnnnnnnnnnn

SEQ ID NO: 240885 - DNA, 697 bp, Homo sapiens
  misc_feature: GYAE6OF01E1S3I.18.39.D06.1.454.CMB.1.raw
  modified_base (235)..(235): a, c, t, g, unknown or other
  misc_feature (235)..(235): n is a, c, g, or t
tcagtacgagtatgcacgaccggtgctcgatttagtgacatctcgcagttctttggggctgtcctttggttttggagatggttttctcgatgggggctgggagggcttttgttggagaccttgcacttgtactccttgccgttcagccagtcctggtgcaggacggtgaggacgctgaccacacggaacgtgctgttgaactgcctcctcccgcggtctttgtcttggctattancgcaccctccacgtcccgtccacgtaccacttgaactcggacctcggggtcttcgtggctcgacgtccaccaccgacgcacgtcgacctcggacgggtaccggaaatcaagtaagggttactccggtttggggtttaggggaagaggaagacgtcggaccgtcctaccgaggtacgttacgaggtacgaaacggacccggtcggggcctcgaggtcgaacggtcctcgtgtacacgtacctagttcggtaccctttcccgtacaagtttaactttgactttactcgtaggttcggtgaccgacgtacggccgtagggtacggaacgtaacggggtctacgggtaggtagggtacgtgggggtaattacggggaaattaacggggaaaaccggttaaaactcccgggaaaccaaacgtaccggaacgggtacctaacggtaggaccgtaacgggaggtaccgg

SEQ ID NO: 240886 - DNA, 856 bp, Homo sapiens
  misc_feature: GYAE6OF01BEPJ6.18.39.D06.1.454.CMB.1.raw
  modified_base (297)..(297): a, c, t, g, unknown or other
  misc_feature (297)..(297): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatagaacggtaaaactgaccaacacaggctatgcagaggcattccgagggcagacgtcaccagtcggaacccgggaacccctccgaccggcacgagccctacagtcggagctaggngccgagtctcggaacaccgtagaaccgaccgaccgggcccgttactacgttaccgtggtacgcgaacggacgcccggagtaaatgtcggtagggtacgaacgaaagtagtttcggggttcgttttggtttttacgggtttacggggtcccggttaggtaaaccgtttacggggtacgggggtacccgacggggtaccctaacccccggtcgggttacccgaacccggtttcctacccgttaccgaccgttcccttaaccccggaacccggtaacccgggtccctaaccggttccccgggtttccccctttcccccggtaccggggtcccctcccccgttacggtcccgttacccggacgggtacccgtcccctaacccgggttccggggtacccggggggtacccaaaccgggtccccgggggtacccgggttaccccccgggttccgggggtcccgtttaccccggggaccggtttacccgggtaaaccccgggtaacccgggtttaaccccgttttaaccccccgtttaacccccggttaacgtttaccccccgggg

SEQ ID NO: 240887 - DNA, 414 bp, Homo sapiens
  misc_feature: GYAE6OF01BJKT8.18.39.D06.1.454.CMB.1.raw
  modified_base (224)..(224): a, c, t, g, unknown or other
  misc_feature (224)..(224): n is a, c, g, or t
  modified_base (389)..(395): a, c, t, g, unknown or other
  misc_feature (389)..(395): n is a, c, g, or t
  modified_base (397)..(414): a, c, t, g, unknown or other
  misc_feature (397)..(414): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcagtgggggaggtgtgtcacaagatttgggctctgggcaccgtgggcagtgggggagtgtgtcacaagatttgggctcgtgggcacccgtggtccaccgtctcctnagccttccacgaagggccctagtccggtccttcccccgtggcccgccctgcctccgaggacgccacctcgtgggggcacgaggccggccctggggctgcccgttggtaccaaggtacctaccttcccatacctcgtactggagcgggctggcgaaggcgcatagnnnnnnngnnnnnnnnnnnnnnnnnn

SEQ ID NO: 240888 - DNA, 823 bp, Homo sapiens
  misc_feature: GYAE6OF01BQBB4.18.39.D06.1.454.CMB.1.raw
  modified_base (144)..(144): a, c, t, g, unknown or other
  misc_feature (144)..(144): n is a, c, g, or t
tcagtacgagtatgcacgaccggtgctcgatttagtgacatctcgcagttctttgggctgaggtgaagaaccctggggcctcagtgaaggtctcctgtcagacctatggattccccttccagtaattttgatatccattgggtncgacaggccagtggacaagggctcgagtggatgggatggataggaaacggtaaactgaccaaacacgaggctatgcagagctatccgaggcagactcaccatcggaacccggaacccctccgaccggacaccacgtccctaacagtcgggaactcgtaggaacgcctaagttccgtaggaaacccctaccggtacgaaccggaccgtaacccgggtccgtttacgttaaactttaaccgtgggtacggaccggtaacgacggtaccccgaaggtaaattcgtgggttacggtaacgaacgtaaaagtcggtttcgggtttacgtttttgggtttttagggtttaccggacccggtttaggtaaaccgttccggggttacgggggacccgtaacggggtaccctaaccccggtttcgggtacccctaaacccgtttccgtacccgtaccaaccggttccccttaacccggaacccgtacgggcccccttacgggttccccgttcccttccccggcggacccctcccgttacggacccgtccggtaacggaccttacccgtaccggttccgggtacgggaccctaacggccgggtcccggtaccggtacgggtccctccggacccggttaggtaacccggtaaacgttccctttaaccccgttcccgtaccggttaaccgg

SEQ ID NO: 240889 - DNA, 803 bp, Homo sapiens
  misc_feature: GYAE6OF01ETEUL.18.39.D06.1.454.CMB.1.raw
  modified_base (437)..(437): a, c, t, g, unknown or other
  misc_feature (437)..(437): n is a, c, g, or t
  modified_base (723)..(723): a, c, t, g, unknown or other
  misc_feature (723)..(723): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagtaattttgatatccattgggtgcgacaggcagtggacaagggctcgagtggatgggatggatagaacggtaaaactgaccaaacacgaggtactagtgaccaggaggcacttccgagggcagagtccaaccagtacggaccccggggtaaacccctccgaacccggacaaccgaacgccgtaacagttgggaagtccttaggaagccgtaagttccgtacgactacccgtaggaaccgaaccgtccggcccgtactttaagttaccgtgtacggaccgtagacggacccgtagaaacgttaggtgtacgggttaanaacgaaaaggtcgtttttcgggtaggtttttggttttacggtttttcggggaccgttagaaaccggttacggtacgggggtaccaacgggtccgtaaccccgtttggaacccgacccggtttcctcccgtacgaccgttacccgttaccccgaaccgtaaccgggccccttaaggttccccggttaccctccccgtacggggtcccctccccgtagtccttaccggacgggcctacctaccggttccgggccggtaaccgaacgtcccggggcccgttaccccggngggtaccccttacgggtccccgttaacgggtaacccgaaacggttacccttaaacccggtttccccaacggtttaacccg

SEQ ID NO: 240890 - DNA, 780 bp, Homo sapiens
  misc_feature: GYAE6OF01BKFFJ.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggacttccccttccagtaattttgatatccattgggtgcgacaggccagtggacaagggctcgagtggatgggatggatagaaacggtaaaactgccaaacacaggctatgcagaggctagttccgagggacagacgtccaccagtcggaacccgggaaccccctccgaccggcaaccacgaccctacagtcggacgtcgtagacgcacggtctacgaccaccgtgaccgaccgacggtcctacttaacttacgtcggtcgacggaacgtaaccggccgaccgtaaattacgtggtacgggtacgacgaaaaggttgttcggtttcggtttggtttttggttttacgggtccggtaagtaaccgttacgggtcggggaccgtacggggccctaacccgttggtacccaccgttcctacctacgacggtcccttaaccgaacccgtaaccgggccctaggttccccgttaccccttcccgtcggtcccctaccgtcggtccccgtaacggacggtaccgtacccggtacccggttccggggacgggggtacccctaaccgggcccgggtccccggggtacccccgggtcgggtccgttcccgggttacccggtaaccggggttaccgaaacccgggtttacccttaccccgttccccgtaaaccggtttccccgg

SEQ ID NO: 240891 - DNA, 436 bp, Homo sapiens
  misc_feature: GYAE6OF01EKUY6.18.39.D06.1.454.CMB.1.raw
  modified_base (289)..(289): a, c, t, g, unknown or other
  misc_feature (289)..(289): n is a, c, g, or t
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (390)..(436): a, c, t, g, unknown or other
  misc_feature (390)..(436): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcagtgggggagtgtgtcacaagatttgggctcgtgggcaccgtgggcagtgggggagtgtgtcacaagtatttgggctcgtgggccacctggtccaccgtctcctcagccttccaccgaagggcccctagtccggtccttccccccgtggccgtccctgcctccgaggacnccacctcgtggggcaacngcggccctggggctgcctggtcaaggctacgttcccattaccgcgtaccngacgcgggtctggcaaggcgacatacgncntcnnnnnnnnnnnnnnnnnnnnnnnnnnnnnnnnnnnnnnnnnnnnnnn

SEQ ID NO: 240892 - DNA, 667 bp, Homo sapiens
  misc_feature: GYAE6OF01DN0AV.18.39.D06.1.454.CMB.1.raw
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagtaattttgatatccattgggtgcgacaggccagtggacaagggctcgagtggatgggatgggatgaaacggtaaaactgaccaacacaggctatgcagaggctattccgagggcagagtcaccagtcgacccggacccctcgaccggcaacacgcctacgatcgganctgagcagtcncgacactgacacncggcctntattcngtgcagcncgcgtaatgtgtggtanaacgtaaagngttacgggttcgtttagtttttcggttcggccggttagaaccgtacgtcggggaccgagggtaccctaccgttcgggtaccctaccgtccttccctacgaccgtaccgttacccgaacccggaaccgggtcccctaacgttcccggttccctacccccggtcgccccgtacccttcgaccttacggacggaccgtcctaacccgcgggttacgggacctaccggacggccccggtacccggtcggtccgtccgtcccgtacgggtaccctaacgggaccctttaacccgttcccgtaacgttacccg

SEQ ID NO: 240893 - DNA, 459 bp, Homo sapiens
  misc_feature: GYAE6OF01C8QKK.18.39.D06.1.454.CMB.1.raw
  modified_base (432)..(434): a, c, t, g, unknown or other
  misc_feature (432)..(434): n is a, c, g, or t
  modified_base (436)..(459): a, c, t, g, unknown or other
  misc_feature (436)..(459): n is a, c, g, or t
tcagtacgagtatgcacgaccggtgctcgatttagtgacatctcgcagttctttgggggggaagaggaagactgacggtccccccaggagttcaggtgctgggcaccgtgggcagtggggggaggtgtgtcacaagatttgggctctgggcgaccgtgggcagtggggggaggtgtgtcacaagattgggccaggcacctggtcaccgtctcctcagctccaccaacgggcccagtccggtccttccccctggccgccctcgctccgagggacgccaccgtcggtgggggccacgacggccggcccgtcgggcctcggccgtgggtaccgaaacggtacctaccttaccccaagttaccgttaccggttaccgttacgggaacggggtccgggggcgtacggggaccggaaacgggtccgaacgaacgtagnnncnnnnnnnnnnnnnnnnnnnnnnnn

SEQ ID NO: 240894 - DNA, 669 bp, Homo sapiens
  misc_feature: GYAE6OF01BOYWI.18.39.D06.1.454.CMB.1.raw
  modified_base (182)..(182): a, c, t, g, unknown or other
  misc_feature (182)..(182): n is a, c, g, or t
  modified_base (445)..(445): a, c, t, g, unknown or other
  misc_feature (445)..(445): n is a, c, g, or t
  modified_base (606)..(606): a, c, t, g, unknown or other
  misc_feature (606)..(606): n is a, c, g, or t
  modified_base (640)..(640): a, c, t, g, unknown or other
  misc_feature (640)..(640): n is a, c, g, or t
  modified_base (645)..(669): a, c, t, g, unknown or other
  misc_feature (645)..(669): n is a, c, g, or t
tcagtacgagtatgcacgaccggtgctcgatttagtgacatctcgagtggatggggatggatgaaacggtaaaactgaccaacacaggctatgcagaggcattccgagggcagagtcaccagtcgacccgggaaccccctccgaccggcacacgcctacagtggagctgagcagtctgaccnccgtagaccgacgaccgggtccttactattacgtggcgacggagacgcccgagtaaattgtggtggtacaacgaaaagtgtttcgggtttacggtttttggtttttagggttccgggaccggttaacgaaaccgttacgggtaccggggacccgagggtacccctacccggttggtaccccgtcccgttcctcccttacgacgttccccttaacccgaaccggtaccggcccttcggtttccccgttcccgtttccccccggngggcccctcccgtccgtcctaccggaggtacccgcctacgggtcggggtacgggacccacgggccggcccgggtccgtggggtcctccggtaccgtagggtaaaccgaacggttaccccttcctaacccgtacgttaccgttcgtaccgggtgacccgggnggggtacccgtggaacgggtacggcagtagtcgntgacnnnnnnnnnnnnnnnnnnnnnnnnn

SEQ ID NO: 240895 - DNA, 553 bp, Homo sapiens
  misc_feature: GYAE6OF01A7SAT.18.39.D06.1.454.CMB.1.raw
  modified_base (195)..(195): a, c, t, g, unknown or other
  misc_feature (195)..(195): n is a, c, g, or t
  modified_base (214)..(214): a, c, t, g, unknown or other
  misc_feature (214)..(214): n is a, c, g, or t
  modified_base (229)..(229): a, c, t, g, unknown or other
  misc_feature (229)..(229): n is a, c, g, or t
  modified_base (521)..(521): a, c, t, g, unknown or other
  misc_feature (521)..(521): n is a, c, g, or t
  modified_base (523)..(553): a, c, t, g, unknown or other
  misc_feature (523)..(553): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattacngtgcgagagccgacgaatntggtggtgacaaagntgggttctttggttttgtttggccggtagaactacgtggggccgagggccaccgtggtccaccgtctcctcagtccttccaccgaacgggccctagtccggtccttccccgtggcctccctcgcctaccgacggacgccaccgtcggtcgggggccacgacggccggtcccgtgggtccgtacggtccgttacggtaccgaacggtacccttaccgttaccctacgttaccgttaccgttacgtcggaacgggccgggtacgtacgggaccgaacgggtcgacgtagtacgntnnnnnnnnnnnnnnnnnnnnnnnnnnnnnnn

SEQ ID NO: 240896 - DNA, 1004 bp, Homo sapiens
  misc_feature: GYAE6OF01EAWVU.18.39.D06.1.454.CMB.1.raw
tcagtacgagtatgcacgaccggtgctcgatttagtgacatctcgcagttctggggctgaggtgaagaaccctgggcctcagtgaaggtctcctgtcagacctatggacttccccttcagtatttgatatcctagttgggtgcgacacggccaggtggaacgaagggtctcgagtggagtgggatggatagaaaccggtaaactcgaccaacacgaggtctagcgacagacggtactacgttccgagggactaacggtacgtaccaaccgtacggtacccggaaacccccggaccccctacccggaacccggaccaaccgtaccgtacccgtaagtaacggttcggacgtccgtaggaccgtaccgtacgttcaaccgtacccgtaccgtaccggaaccggaccgtacccggttacctttacgttacgttaccgtgtacggacggtaacggaccgtaccgtaacgtaagttcggtaagggtcggtaaaggaaacgtaaaggttcgggtttttacgggttttcggtttttacgggtttttcggggttacccggtaacggtttaacggtaacccgggttacggggtaccgggggttaccccgtaacccgggttacccccgtaacgggttttccccggtaaacccgtccccgttaccttacccggtaccggtaccctttacccccggtaaccccggtaaacccgggtacccgtcccccggtttccccgttttaaccccgggtttccccccctcccgggggttcccgacccccggtttacccgtcccgggtaaacccgtttcccggggaacccgttacccggttccccgggtaaacccgggttcccgggggtacggtccccccggaacccggggtaccccgggttcccgggttaccccgggtaccggggttccggtaaccggttaccccccgggtttaaagggggtaccccggtaaaaccccttttcccccggtaaacccgttttaaacccccgtacggtttaccggg

SEQ ID NO: 240897 - DNA, 581 bp, Homo sapiens
  misc_feature: GYAE6OF01BS29E.18.39.D06.1.454.CMB.1.raw
  modified_base (158)..(158): a, c, t, g, unknown or other
  misc_feature (158)..(158): n is a, c, g, or t
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
  modified_base (550)..(581): a, c, t, g, unknown or other
  misc_feature (550)..(581): n is a, c, g, or t
tcagtacgagtatgcacgaccggtgctcgatttagtgacatctcgagtggatggggatggatgaacggtaaaaactgccaaacacaggctatgcagaggcattccagggcagagtcaccatgaccgggaacccctccaccggcacagcctacatgganctgagcagtctgacacctgacgacacggccgtntattacngtgcgagagccgagaaatatggtggtgacaaaaagngttgggttcgttttaggtttttggtttcggtccggtagaaacgttacggtggggccacggggcctacccgtggtcctaccggttcctcctcaagtccttacccgaaccgaaacgggccctacgtccggttcccttcccccgtggcccgccctcgcctccgaggcgccaccgtcggtcgggggcacgcggccggcccgtgggcctggtccgtacgggtacgaaacggtacccttaccgtttacccctaagttaccgttccgttacggtaggacggtccggggtacgtcgggaacgaacgggtccgaacacgtagagnnnnnnnnnnnnnnnnnnnnnnnnnnnnnnnn

SEQ ID NO: 240898 - DNA, 1037 bp, Homo sapiens
  misc_feature: GYAE6OF01D36I2.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattcccccttccagtaattttgatatccattgggtgcgacaggccaggtggacaagggctcgagtggatgggatggatagaaacggtaaaactgaccaaacacgaggctatgacagaggcacgttccgagggcagacgtccaccgacgtaccggaaccccggggtaaccccctaccgaacccggccaaccgacgtaccctaaccagtagggaacgccgtaggacgtacgtacggtccgtacggaaccacccgttacggaaccggaaccgtacccgggtacccggtttctttaactttaccgtgggtacggtacggaacggacggcccggtaagaacgtttagtggtagggtacgaacgtaaaggtacggtttcgggttttacggttttgggtttttacgggtttttcggggtacccggtttaaggtaaacccggtttcggggttaccggggtaccccgggtacggggtaccccgttaacccccggtttccggggttacccccgttaacccggtttccccgtttaacccggttaccccgaacccgtttacccccgttaacccccgggtaaaaccccgaaaccccggggggttaccccccttaacccgggtttttcccccgggtttacccccccgttttacccccccgggtccggggttacccccccggttcccccggtttaacccgggtcccccggttaaacccccggggacggggttaaaccccgtaccccggttaccccggggtttcccgggggtaaccgggggggtaccccctaaaccgggggaccccgggtcccccggggttcccgggggttacccggggttccccgttaaccgggggtccccgttttaacccggggtaaacccggtaaacgggttttaccccctttaacccccggtttacccgttaacccggtttaaccccgggg

SEQ ID NO: 240899 - DNA, 1031 bp, Homo sapiens
  misc_feature: GYAE6OF01EHGUB.18.39.D06.1.454.CMB.1.raw
  modified_base (149)..(149): a, c, t, g, unknown or other
  misc_feature (149)..(149): n is a, c, g, or t
  modified_base (157)..(157): a, c, t, g, unknown or other
  misc_feature (157)..(157): n is a, c, g, or t
tcagtacgagtatgcacgaccggtgctcgatttagtgacatctcgcagtttctttgggctgaggtgaagaaccctggggcctcagtgaaggtctcctgtcagacctatcggacttccccttcgagtaattttgatactccagttgggtnaccaacgnggccaggtcggaacgaagggtctcgaggtggatgggatggaatacggaaaacggtaaactcgaccaaacgacgtaggtactagcgagaaggacggtactacgttaccggaaggggacaggtaccgtccaaccggtacggtacccgggaaccccccggggaacccctaccggaccccggaccaacgaccggtccctaagtaggtcgggaacgtccgtaggaccgtaccgaagttccgaaccgacgtacccggtaacgacccggtaccggaccgggtttacccttaacgtttaacgtttaccggtacgggttcgaaacccgggtaccggtaaaccgggcccgttaaaggttaaaacggtttcggtttaggggtaacccggttaaggaaaacggtttaaacgggttgggttttccggggttttttagggtttttttacggggtttcccggggtttttaaccgggggacccggttaaaacggggtttaccgggtttaaccgggggtacccgggtaacccggggtaaccggttaccccgggttacccggttacccgggtacccggttaccccgtttacccgttacccgtacccggttaacccgttaccccgttaacccgggtaacccggtacccgggttaaccccgttcccgggtttacccgtttccccccggttcccggtcccggtaccccgtcccggttaccggtaccccgttaccgtaacccggtacccggtaccgtacccgggtttaccgggacgggtacccgaccgggacccgggtcccgggtacccgggtccggtaccggtcccgggttacccgttaacgggtaacccttaacccgggttaccctacccggtttacccgtaacgttaccccgg

SEQ ID NO: 240900 - DNA, 854 bp, Homo sapiens
  misc_feature: GYAE6OF01A4IAR.18.39.D06.1.454.CMB.1.raw
  modified_base (295)..(295): a, c, t, g, unknown or other
  misc_feature (295)..(295): n is a, c, g, or t
  modified_base (349)..(349): a, c, t, g, unknown or other
  misc_feature (349)..(349): n is a, c, g, or t
tcagtacgagtatgcacgaccggtgctcgatttagtgacatctcgcagttctggggctgaggtgagaaccctggggcctcagtgaaggtctcctgtcagacctatggattccccttccagtaattttgatatccattgggtgcgacaggccagtggacaagggctcgagtggatgggatggataggaaacggtaaactgaccaaacacgaggtactagtcgacaaggaggactacttccgagggcagacgtcacagtcgacccggacccctcgaccgcacagcctacagtcgganctacgacgcagtcgtagacctaccgtgaccgacgccggtcctacttattaccgngtcgacggtagacgcccgagtaatggtgtggacgaacgaaagtcggtttacggttcgttttaggttttgggtttaccgggacgggttactaacgggtttccgggtacggggggtaccctacgggggtcccctaccgggtttacggtacccccggtaacccggtttcccgtaccccggttacgtaaccccggtcccgtttaaccccccgaaccgggtaaaccccgggtccccttacccgggttcccggtacccccccgttcccccggtaccgggtccccccgttcccggtcccggtacccgtacccgggtaaccggtcccggtaccccgttaacccgggttccggggtaaccgggggtacccacccggggtacccggggtcccccgggtttaaccccgggccggggttccccggtacccgggtaccccgggttaccggtaaccccgggttaacccgggttaaccccttttaaccccggttccccgttaaccgggtttaacccccgg

SEQ ID NO: 240901 - DNA, 230 bp, Homo sapiens
  misc_feature: GYAE6OF01BLVH1.18.39.D06.1.454.CMB.1.raw
  modified_base (176)..(176): a, c, t, g, unknown or other
  misc_feature (176)..(176): n is a, c, g, or t
  modified_base (183)..(184): a, c, t, g, unknown or other
  misc_feature (183)..(184): n is a, c, g, or t
  modified_base (186)..(186): a, c, t, g, unknown or other
  misc_feature (186)..(186): n is a, c, g, or t
  modified_base (189)..(190): a, c, t, g, unknown or other
  misc_feature (189)..(190): n is a, c, g, or t
  modified_base (192)..(194): a, c, t, g, unknown or other
  misc_feature (192)..(194): n is a, c, g, or t
  modified_base (196)..(230): a, c, t, g, unknown or other
  misc_feature (196)..(230): n is a, c, g, or t
tcagtacgagtatgcacgaccggtgctcgatttagtgacatctcgcaggttctttggggtttgggggaagaggaagactgacggtcctcccaggagttcaggtgctgggcacagcggccctgggctgcctggtcaaggctacttcccatactcgtactgagcgggctggcaaggcncaagtgnnangcnncnnncnnnnnnnnnnnnnnnnnnnnnnnnnnnnnnnnnnn

SEQ ID NO: 240902 - DNA, 509 bp, Homo sapiens
  misc_feature: GYAE6OF01DCY6G.18.39.D06.1.454.CMB.1.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (326)..(326): a, c, t, g, unknown or other
  misc_feature (326)..(326): n is a, c, g, or t
  modified_base (348)..(348): a, c, t, g, unknown or other
  misc_feature (348)..(348): n is a, c, g, or t
  modified_base (476)..(476): a, c, t, g, unknown or other
  misc_feature (476)..(476): n is a, c, g, or t
  modified_base (478)..(509): a, c, t, g, unknown or other
  misc_feature (478)..(509): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagcccgngaatatgtggtgcaaagntggtcgttgttttgttgcggtgaactacgtgggccagggccaccgttggtccaccgtctccttcagtccttcaccaacggcccatccggtccttccccncggcgccctgcctccgaggacncacctgtcggggcagacgccggcccgtgggccttcgccgtggtacgaacggtaccttaccttacccattaccgtccgttaacgtggaacgcggggtactcgggactaaagggccgaccgaagtacggngnnnnnnnnnnnnnnnnnnnnnnnnnnnnnnnn

SEQ ID NO: 240903 - DNA, 871 bp, Homo sapiens
  misc_feature: GYAE6OF01ARU6A.18.39.D06.1.454.CMB.1.raw
  modified_base (823)..(823): a, c, t, g, unknown or other
  misc_feature (823)..(823): n is a, c, g, or t
tcagtacgagtatgcacgaccggtgctcgatttagtgacatctcgcagttcgtggggctgaggtgaagaacccgtggggcctcagtgaaggtctcctgtcagacctatggtacttccccttcagtaattttgatactcctagttgggtgcgacgaggccaggtggacgaagggctcggagtggagtgggatggataggaaacggtaaactcgaccaacacgaggctagtgacgaaggacggctacgttaccggacgggacaacggacgtaccaaccgtacggtaccggaacccccggggtaaccccctaccggaacccggaccgtaaccgaaccggtaccctaacgtacggtacgggaacgtcgtacggaacgtcgtacggtacgtacgaaccgtaccgtaccggaaccggaaccggtacccggtaccgttaccgttaacgttaccggtcgtacgggacgacggtaccgtacccggaacgtaaacgtacggttaggtacgggtaacgtaaacgtaaaggttcggtttacggttttcgggtttttcggttttacgggttttccggggtaaccggttaacgtaaccgggttacggggtacccggggtaccgaccggggttacccctaccgggttccggttaccccgtacccggttcctaccgtacgtaccgtttccccgtaaaccggacccgggtaaccggtccccgtttacggtttccccgttcccccgttcccgcggtacccctcccgtacgtccccgtacggacggtccctaccgtacggtccgggtacggcctaccgggcggtcccgtccggtacggtccnccgggtaccgtacggtaacacccgtttactcctaccgtacggtcccgg

SEQ ID NO: 240904 - DNA, 185 bp, Homo sapiens
  misc_feature: GYAE6OF01BJRI0.18.39.D06.1.454.CMB.1.raw
  modified_base (175)..(175): a, c, t, g, unknown or other
  misc_feature (175)..(175): n is a, c, g, or t
  modified_base (181)..(185): a, c, t, g, unknown or other
  misc_feature (181)..(185): n is a, c, g, or t
tcagtacgagtatgcacgaccggtgctcgatttagtgacatctcgcagttctttgggtttgggggaagaggaagactgacggtcctccaggagttcaggtgctggcacagcggccctgggctgcctggtcaaggacttacttcccatactcgtactgagcgggctggacaaggcncatagnnnnn

SEQ ID NO: 240905 - DNA, 526 bp, Homo sapiens
  misc_feature: GYAE6OF01A02XD.18.39.D06.1.454.CMB.1.raw
  modified_base (231)..(231): a, c, t, g, unknown or other
  misc_feature (231)..(231): n is a, c, g, or t
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
  modified_base (496)..(500): a, c, t, g, unknown or other
  misc_feature (496)..(500): n is a, c, g, or t
  modified_base (502)..(511): a, c, t, g, unknown or other
  misc_feature (502)..(511): n is a, c, g, or t
  modified_base (513)..(526): a, c, t, g, unknown or other
  misc_feature (513)..(526): n is a, c, g, or t
tcagtacgagtatgcacgaccggtgctcgatttagtgacatctcgagtggatgggatggatgaacggtaaaactgccaacacaggctatgcagaggcattccagggcagagtcaccatcgaccggggaacccctcaccggcacagcctacatggagctgagcagtctgacacctgacgacacggccgtctattactgtgcgagagcccgagaatatggtggtgacaaaagnttgggtcgttttgttttggttttggcggttgaactacgtgggccaggcaccgtgtcaccgtctctcagctccgacacggccagtccggtcccttcccccggcnccctgcctccgaggacnccgacctcggngggggaccacgcggccggtccgtgggcctcggccgttcggacgaaacggtcttaccgttaccctaattaaccgtccgtactacgggacggccgggacgttcgggacctaagggccgacgtagtacggcngcngnnnnngnnnnnnnnnngnnnnnnnnnnnnnn

SEQ ID NO: 240906 - DNA, 569 bp, Homo sapiens
  misc_feature: GYAE6OF01CYNHK.18.39.D06.1.454.CMB.1.raw
  modified_base (552)..(569): a, c, t, g, unknown or other
  misc_feature (552)..(569): n is a, c, g, or t
tcagtacgagtatgcacgaccggtgctcgatttagtgacatctcgagtggatgggatggatgaaacggtaaaactgccaacacaggctatgcagaggcattccagggcagagtcaccatgaccgggaaccccctccaccggcacagcctacatggagctgagcagtctgacacctgacgacacggccgtctattactgtgcgagacgccgacgtaatagttggtggtacgaacgaaaaggtagttgggttcgttttggtttttgggttttcgggcccggttgaaaccgttacggtcgggggaccaggggccctacccgtggtcccacccggttcctcccgtcgacgtcccttacccaaccggaacgggccccacgttcccggttccctttcccccgtggcccgtcccgtcgtccgtaccgaggcgccgtaccgttcggtcgggggaccacgcggccggtcccgtgggctcggccgtcggtacgaacggtacttaccgttcccattaccgttcgtacgtggacggcgggtctcggacgacggtcgacagtcgnnnnnnnnnnnnnnnnnn

SEQ ID NO: 240907 - DNA, 1038 bp, Homo sapiens
  misc_feature: GYAE6OF01ERTTH.18.39.D06.1.454.CMB.1.raw
tcagtacgagtatgcacgaccggtgctcgatttagtgacatctcgcagttcgtggggctgaggtgaacgaacccgtggggcctcagtgaaggtctcctgtcagacctagtggtactttccccttaccaagttaatttttgattactccgtagtttggggtcgcgacgacggccaggtggaacgaagggctcggaggtggagtgggatggagtaggaaacggtaaacgtcgaccaacgacgaggtactagtcgacgaggacggactacgttccggagggacgacgtacgaccaccgacgtacccgggaaccccggaacccctcccggaccggacaccgacgacctaacgtacgtcggacgcgtagacgcgtaggttaccgacgaaccgtaccgtacggacccgtaacggtacccggtcctttacgttaacgtttacggtcggtacgggacggaacggtaccggaccggtaacgtaaaggttcggttcgggtaaggtacggaaacggttaaagggtttcgggttttcgggtttttcggttttttacgggtttttaccggggtttaccgggtaaccgggtttaaaccggttaaccgggttaccgggggtccggggtaacccggttaacggtcccccgtttaccgggttccggttaaccccctttaccggttcccgtttaccgtacccggttaacccgttacccccggttaaacccgggaaacccgggttcccgtaccccgttttccgggttttcccccccgggttaccccctttaccccggggcccggtttcccccgtaaccccggtttcgggtaaccccgtttaaccggggcggtttaaccccggaccccgtttacgggggttccccgggggacccggggtaaaccccacccgggggttcccggggttacccccgggttccggggtaacccgggtttcccggttacccgggttaacggggtttaaccccggtaaaaccgggtttaacccctttaacccccggttttaacccgtttccccggaaagggtttttcccccggg

SEQ ID NO: 240908 - DNA, 942 bp, Homo sapiens
  misc_feature: GYAE6OF01DAREW.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggacttccccttccagtaattttgatatccattgggtgcgacaggccaggtggacaagggctcgagtggatgggatggatggaaacggtaaaactgaccaaacacgaggctatcgacaaggaggctacgttccgagggcaggtacgtccaaccgtagtaccggaaccccgggaaccccctaccgaacccggccaaccgacgaccctaacgagtcgggacgcgtacggacgccgtagtccgtacgaacctaccgtacggaaccgtaccgaccggtacccttattaactttacgtggtacggaccggaacggacggacccggtaagtaacgttaggttgggttacgggaacgtaacgtaaaaggttcgggtttcggttttaccgggtttttgggtttttttacgggttttaccggggtaccgggtttaacggtaaacccgggtttccggggttacggggggaccccgaacggggtaccccgtacccgggtttcggtacccccgttacccgttacccttccgtacccgtaccgttcccttaacccccggaaaccgggtacccgggtaccccttaccggtttcccccgggtttacccccttcccccgggtaccgggtcccccgttaccccgtcgggtacccccgttaccggaacccgggtaccctaccccgggtacccgggttccggggtaccgggggacccctacgggtccccggggtccccgggttacccccggggttcggggcccgtttacccggggtccccggtttaacgggtaacccggttaaaccccggttcccgttttaaacccccgtccccgttaaccggtttaaaccccgg

SEQ ID NO: 240909 - DNA, 488 bp, Homo sapiens
  misc_feature: GYAE6OF01D366O.18.39.D06.1.454.CMB.1.raw
  modified_base (267)..(267): a, c, t, g, unknown or other
  misc_feature (267)..(267): n is a, c, g, or t
  modified_base (328)..(328): a, c, t, g, unknown or other
  misc_feature (328)..(328): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (434)..(435): a, c, t, g, unknown or other
  misc_feature (434)..(435): n is a, c, g, or t
  modified_base (439)..(488): a, c, t, g, unknown or other
  misc_feature (439)..(488): n is a, c, g, or t
tcagtacgagtatgcacgaccggtgctcgatttagtgacatctcgcagttctttggggggaagaggaagactgacggtcctcccaggagttcaggtgctgggcaccgtgggcagtggggggagtgtgtcacaagatttgggctcgtgggcaccgtgggcagtggggggagtgtgtcaacaagtagtttgggccgagggccaccccgtggtccaccgtctcctcagtccttccaaccgaacgggcccacgttccggtcccttccccgnggcccgccctcgcctccgaggacgccaccgtcggtcgggacacgcggccgccgtgggtccncgacgtggacgaacgtaccttacctaccacttctacggtaccgtggaccgggcggccgtggaacgaggccgagtaccgtagcganagcacngcgntcgacgnancnngcannnnnnnnnnnnnnnnnnnnnnnnnnnnnnnnnnnnnnnnnnnnnnnnnn

SEQ ID NO: 240910 - DNA, 869 bp, Homo sapiens
  misc_feature: GYAE6OF01BI45H.18.39.D06.1.454.CMB.1.raw
  modified_base (306)..(306): a, c, t, g, unknown or other
  misc_feature (306)..(306): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatcgaccgggaacccctccaccggcacacgcctacatggagctgagcagtctgaccacctgaccgacncggccgtctattactgtgcgagacgcccgacgaatacgtggtggtagacgtaaaaggtagttcgggtttaccggttttgggtttttacgggtttttcggggacccgggtttaggtaaacccgtttaccggggttcggggggtacccggtaacgggggtcccctaacccccggttcggggttaccccgtaaccccgggtttcccttaccccgttaccgtaccgggtccccttttaacccccggaaccccggtaaaccggggggtacccccctaacggtttacccccggggtttcccccttttcccccccccgggttcggggtcccccgggtccccccgttacgggtcccccgttaccccggaacgggttacccggaccccgtaacccccggttccggggttaccgggggggtaccccaacccgggtaacccggggtcccccggggtcccccggttcggggggtcccgttacccggggtcccccgggttacggggttaaccccggtaaacggggttaacccccttttaaccccggtttaccccccgaacggttttaaacccccgg

SEQ ID NO: 240911 - DNA, 486 bp, Homo sapiens
  misc_feature: GYAE6OF01B4TQ0.18.39.D06.1.454.CMB.1.raw
  modified_base (264)..(264): a, c, t, g, unknown or other
  misc_feature (264)..(264): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (430)..(430): a, c, t, g, unknown or other
  misc_feature (430)..(430): n is a, c, g, or t
  modified_base (433)..(435): a, c, t, g, unknown or other
  misc_feature (433)..(435): n is a, c, g, or t
  modified_base (437)..(437): a, c, t, g, unknown or other
  misc_feature (437)..(437): n is a, c, g, or t
  modified_base (439)..(486): a, c, t, g, unknown or other
  misc_feature (439)..(486): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcagtgggggaggtgtgtcacaagatttgggctctgggcaccgtgggcagtggggggagtgtgtcacaagatttgggctcgtgggcacccgtggtccaccgtctcctcagccttccaccgaacgggcccatccggttccttcccccnggccgccctgcctccaggcnccacctcgnggggggtccacgacggccgggcccttggggcctcgcccgtgggttaccaaggtacctaccgttccccaattccgtacggtaactggaaggtcggggctgggacctaagggccgactagtacggctgctgcgctgatnagnnngngnnnnnnnnnnnnnnnnnnnnnnnnnnnnnnnnnnnnnnnnnnnnnnnn

SEQ ID NO: 240912 - DNA, 694 bp, Homo sapiens
  misc_feature: GYAE6OF01ARO80.18.39.D06.1.454.CMB.1.raw
  modified_base (111)..(111): a, c, t, g, unknown or other
  misc_feature (111)..(111): n is a, c, g, or t
  modified_base (664)..(678): a, c, t, g, unknown or other
  misc_feature (664)..(678): n is a, c, g, or t
  modified_base (680)..(694): a, c, t, g, unknown or other
  misc_feature (680)..(694): n is a, c, g, or t
tcagtacgagtatgcacgaccggtgctcgatttagtgacatctcgagtggatgggatggatgaaacggtaaaactgccaacacaggctatgcagaggcattccaggacagngtcaccatcgacccgggaaccccctccgaccggcacacgcctacagtggagctggagctagtctagaaccacctaggaccgaccgaccgggcccgttacttattactggtggaccggagtacggcccgacgaaattagtggtcggtagaacgaaaagtgttcgggttacgttttggttttggtttcggccggtagaacgttacggtgggaccgagggtcccaccggtcgtaccgaccgttcctcctacgacgtcccttacccgaccgaaccgggtcccacgtttccggtccccttccccgtggccctcccgtcgccgtaccgagggccgacccgtaccggtcgggtaccggggggacctaacccgggtaccgggcccgggtaccccgggtacccggggccgtttccgggtaacccccggttagggtaaacccggaaaccggttaccccctttaaccccttaccccgttaacgtacccgtttaccggtaacggtacgggtacgggtacccggggtacgtcgggtaaccgaacgggtacctacgaagtgctacgnnnnnnnnnnnnnnngnnnnnnnnnnnnnnn

SEQ ID NO: 240913 - DNA, 824 bp, Homo sapiens
  misc_feature: GYAE6OF01BO7BG.18.39.D06.1.454.CMB.1.raw
  modified_base (204)..(204): a, c, t, g, unknown or other
  misc_feature (204)..(204): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatagaacggtaaaactgaccaanacaggctagtgcagaggcattccgaggcagagtcaccagtcgacccggaccctccgaccggcacacgcctacataggactctagagcagtctacgacacctcgacgacgacggtccgtacttattaccgtgtcgacgtacggacgcccgacggtaaatagttcggtaggtacgtaaccgaaaggtaggttcggtttcgttttaggttttggttttaccggggccggttacgtaaaccggttaccgggtcgggggcccaacggggtccctaacccccgggtttggttaaccccgtaccccgtttccgttacccgtacccgtaccgttacccgtttaccccggaaaccccgtaacggggccccctaaacggttccccggttttaccccccgttacccccggtcggggttaccccccgccccgttaacgggtccccccttaaccgggacggggttacccgaccccgttaaccccggtttcgggggacgggggaccccctaacgggacccgggtccccgggttacccccgggtaggggttccccgtaccgggtacccgttaacggggtaacccccaaagggtttaccccctccccccggtttaactaacccggttttaccccgg

SEQ ID NO: 240914 - DNA, 661 bp, Homo sapiens
  misc_feature: GYAE6OF01EGZ6L.18.39.D06.1.454.CMB.1.raw
  modified_base (161)..(161): a, c, t, g, unknown or other
  misc_feature (161)..(161): n is a, c, g, or t
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
  modified_base (639)..(661): a, c, t, g, unknown or other
  misc_feature (639)..(661): n is a, c, g, or t
tcagtacgagtatgcacgaccggtgctcgatttagtgacatctcgagtggatgggatggatgaacggtaaaactgccaacacaggctatgcagaggcattccgagggcagagtcaccatcggacccgggaaccccctccgaccggcacagcctacatgganctgagcagtctgaccacgtgacgacacggcctntattcgtgtgacgagacgccgagtaatgtggtggtanacgaaaggtgttgggtttcgttttggtttttggtttcgggccggttagtaaaccgttcgggtcgggggcccgacggggcccttaacccggtcggtacccctaccccggttccgttccccgtccgtacgtaccccgtttacccgaaacccgggtaaaccggggtccccctacggtttccccggttcccccttcccccggtcgggcccctccccgttaggtcccctaccggacggtaccgtaccccgtaccggttccggggtacgggggacccaacgggtccggccccgggtccgtcggggccgtcggtccggtacgggtaaccaacggttaccctttacccgtacccgtaacgttaccgttcggtaccgtgggaacgggccgggtgcgggtaccgaggtccactagcgnnnnnnnnnnnnnnnnnnnnnnn

SEQ ID NO: 240915 - DNA, 831 bp, Homo sapiens
  misc_feature: GYAE6OF01C9BAJ.18.39.D06.1.454.CMB.1.raw
  modified_base (688)..(688): a, c, t, g, unknown or other
  misc_feature (688)..(688): n is a, c, g, or t
tcagtacgagtatgcacgaccggtgctcgatttagtgacatctcgcagttctggggctgaggtgaagaaccctggggcctcagtgaaggtctcctgtcagacctatggacttccccttcagtaattttgatatcagttgggtgcgacaggccagtggacagggctcgagtggatgggatggataggaaacggtaaaactggaccaaacgacgtaaggctaagtgacgaggaggactagttcccggaagggacaggtacgtaccaacctaggtacccggaaccccgggtaaccccctccggaaccccggacaaccgacgccctaacgagtagggactcgtagacgtccgaaggttccacggaccaccggttacgaaccgtacgtaaccgggtccttacttaacgttacgtggtacggacgaaggaccgacgtaacgtaaagttggtggttaggaaccgaacgtaaaaggtcggtttcgggttttacgggtttaggtttttacgggtttcggggaccggtttaagaaccggtttccgggtacgggacccgggtaacgggtccccgtaacccggttcggggtaaccccttacccggttcttacccggtaccgtaccgttaccccgttacccgaacccggtaaccgtcccgtacggttcccgtccccgtcccggtaacggcccttaccccgngtacccgtacgacggtaccctccgacggttcgggaccgggtcgaccgtaccgggcccggtccggtacgggtcctcggtaaccggttaccggtaaccccgtaaggttacccccctttaccgttccccggaagttttaccccggg

SEQ ID NO: 240916 - DNA, 181 bp, Homo sapiens
  misc_feature: GYAE6OF01ELPWH.18.39.D06.1.454.CMB.1.raw
  modified_base (179)..(181): a, c, t, g, unknown or other
  misc_feature (179)..(181): n is a, c, g, or t
tcagtacgagtatgcacgaccggtgctcgatttagtgacatctcgcagttctttgggtttggggggaagaggaagactgacggtcctcccaggagttcaggtgctggcacagcggcctgggctgcctggtcaaggactacttccatactcgtactgagcgggctggcaaggcgcatagnnn

SEQ ID NO: 240917 - DNA, 585 bp, Homo sapiens
  misc_feature: GYAE6OF01EKTXS.18.39.D06.1.454.CMB.1.raw
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (552)..(552): a, c, t, g, unknown or other
  misc_feature (552)..(552): n is a, c, g, or t
  modified_base (555)..(585): a, c, t, g, unknown or other
  misc_feature (555)..(585): n is a, c, g, or t
tcagtacgagtatgcacgaccggtgctcgatttagtgacatctcgagtggatgggatggatgaacggtaaaactgccaacacaggctatgcagaggcattccagggcagagtcaccatcgacccggggaaccccctccaccggcacagcctacatggagctgagcagtctgacacctgacgacacggccgtctattactgtgcgagagccgngaaatntgtggtgacaaagngtgggttcgtttgttttggttttcggccggtagaacgttacgtggggccgaggggccacccgtggtccaccgtctcctcacgtcttcccaccgacgggcccacgtccggttcccttccccctggcccgcccctcgtcctccgaggactccgaccgtcggtcgggggcacgcggccggtcccgtgggtcctcggcccgttcggtaccgaaacggttacccttaccttacccctacgttaacccgttccggttaaccgttcgggaacgggtccggggtaccggttaccgggaccggtaaaccgggtccgaccgtagtacggncgnnnnnnnnnnnnnnnnnnnnnnnnnnnnnnn

SEQ ID NO: 240918 - DNA, 192 bp, Homo sapiens
  misc_feature: GYAE6OF01CLTN9.18.39.D06.1.454.CMB.1.raw
  modified_base (177)..(177): a, c, t, g, unknown or other
  misc_feature (177)..(177): n is a, c, g, or t
  modified_base (183)..(192): a, c, t, g, unknown or other
  misc_feature (183)..(192): n is a, c, g, or t
tcagtacgagtatgcacgaccggtgctcgatttagtgacatctcgcagttctttggggttttggggggaagaggaagactgacggtccccccaggagttcaggtgctggcacagcggccctgggctgcctggtcaaggcctacttcccatactcgtactgagcgggctggcaaggcncatagnnnnnnnnnn

SEQ ID NO: 240919 - DNA, 655 bp, Homo sapiens
  misc_feature: GYAE6OF01AVAH4.18.39.D06.1.454.CMB.1.raw
  modified_base (614)..(614): a, c, t, g, unknown or other
  misc_feature (614)..(614): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
  modified_base (624)..(624): a, c, t, g, unknown or other
  misc_feature (624)..(624): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (637)..(640): a, c, t, g, unknown or other
  misc_feature (637)..(640): n is a, c, g, or t
  modified_base (643)..(655): a, c, t, g, unknown or other
  misc_feature (643)..(655): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaaccccctccaccggcacagcctacagtggagctgagcagtctgacacctgacgacgacggccgtctattactgtgcgagagccgagaatagtggtggtgacaaaagtgttgggttcgtttgtttttggtttcgggccggttagaacgttacggtcggggccgacgggcctacccgttggtacccaccgttcctccctacgacgtcccttacccgaaccgaaccgggtcccctacgttcccgggttcccctttcccccggtgggtccccgtccccgtcggtcctaccggacgggcgccctaccgttcgggtacgggggcctacgaccggcccgggtcccggtcggggaccctcgggtcccgttacgggtaaccgtaacgggtaccctttacccgttcccgaacgttaccgttccggttaacgtggtaaaccggggcggggtaccgttcggggaacccgtaacgggcccgggtactaacgggtcgcgtcngtcncgncgncgngncncngngnnnngcnnnnnnnnnnnnn

SEQ ID NO: 240920 - DNA, 239 bp, Homo sapiens
  misc_feature: GYAE6OF01DXOHL.18.39.D06.1.454.CMB.1.raw
  modified_base (226)..(239): a, c, t, g, unknown or other
  misc_feature (226)..(239): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcagtggggaggtgtgtcacaagatttgggctcgtggcacagcggccctgggctgcctggtcaaggactacttcccatctcgtactgagcggctggcaaggcgcatagnnnnnnnnnnnnnn

SEQ ID NO: 240921 - DNA, 879 bp, Homo sapiens
  misc_feature: GYAE6OF01DNNTZ.18.39.D06.1.454.CMB.1.raw
  modified_base (315)..(315): a, c, t, g, unknown or other
  misc_feature (315)..(315): n is a, c, g, or t
tcagtacgagtatgcacgaccggtgctcgatttagtgacatctcgcagttctggggctgaggtgaagaaccctggggcctcagtgaaggtctcctgtcagacctatggacttccccttccagtaatttttgatatcctagttggggtgcgacgacggccagtggacaagggctcgagtggatgggatggatagaaacggtaaaactgaccaacacgaggctatgcaggaggcattccgagggcagagtaccaccagtacggacccggacccctccgaccggcaccacgccctaacgagtggacgtcgtaggaacnctacgttccgtacgtaacccgacccgtaggaacccggaccgtaaccgggtccgtttacttaactttaccggtggtaccggcggaaccggtacggaccgtaacggttaagtttacggtggggttaggtaaccggtaacgtaaaaaggttcggtttcggggttttacgtttttcgggttttttacgggttttaccggggaccccgggttttaagtaaccggttttacccgggggacgggggtaccccgtaaccggggggtcccctaccccgggtttcgggttaaccccgtacccgttcccgttacccctaccggtaacccggtcccctttaaaccccggaacccccggtaaaccggggtccccttaaccggtttccccggtccccctttaccccgcgggtacccctcccggtacgtccgtacccggacgtccgaccgttacccgtcgggtacggggccctaacggccgggtcccgggtacccggtcgggtaccttcccgggtaccgttaaccggggtacccaaacgggtttaccccttaacccgttccccgtaggtttaacccccg

SEQ ID NO: 240922 - DNA, 637 bp, Homo sapiens
  misc_feature: GYAE6OF01DXO9Y.18.39.D06.1.454.CMB.1.raw
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (548)..(550): a, c, t, g, unknown or other
  misc_feature (548)..(550): n is a, c, g, or t
  modified_base (552)..(552): a, c, t, g, unknown or other
  misc_feature (552)..(552): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(575): a, c, t, g, unknown or other
  misc_feature (574)..(575): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(587): a, c, t, g, unknown or other
  misc_feature (585)..(587): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (596)..(596): a, c, t, g, unknown or other
  misc_feature (596)..(596): n is a, c, g, or t
  modified_base (598)..(599): a, c, t, g, unknown or other
  misc_feature (598)..(599): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (605)..(607): a, c, t, g, unknown or other
  misc_feature (605)..(607): n is a, c, g, or t
  modified_base (609)..(609): a, c, t, g, unknown or other
  misc_feature (609)..(609): n is a, c, g, or t
  modified_base (611)..(613): a, c, t, g, unknown or other
  misc_feature (611)..(613): n is a, c, g, or t
  modified_base (615)..(616): a, c, t, g, unknown or other
  misc_feature (615)..(616): n is a, c, g, or t
  modified_base (619)..(619): a, c, t, g, unknown or other
  misc_feature (619)..(619): n is a, c, g, or t
  modified_base (621)..(623): a, c, t, g, unknown or other
  misc_feature (621)..(623): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (635)..(636): a, c, t, g, unknown or other
  misc_feature (635)..(636): n is a, c, g, or t
tcagtacgagtatgcacgaccggtgctcgatttagtgacatctcgcagtttctttgggttttggggggaagaggaagactgacggtcctcccaggagttcaggtgctgggcaccggtgggcagtgggggagtgtgtacacaagtagttttggggcttcgtggggaccaccggtgggcagtggggggagtgtgtacaacgaaggtatttggggccttcgtcggggaccacccgtggtccaccgttctcctacagccttaccacgaacgggccctagttccggttaccctttcccccagggccccgtacccctgggtaccctaccggaaagggctacccgtaaaccgttccggtagggggggacccaaccggacggcccgggtaccccgttaggggaccgtacggtaccggttacgggttaaccgaaaacgggttaccctttaccccgttaccccctaagtttaacccttaccggttaaccgtacggaacggccgggtacgtacggacggttaaacggcgacttaagacgncganacgctagcgancntnnnanganacncancacananananannanagananannnanananganannananannnanannnannagnannnananancnancnna

SEQ ID NO: 240923 - DNA, 304 bp, Homo sapiens
  misc_feature: GYAE6OF01EPAD6.18.39.D06.1.454.CMB.1.raw
  modified_base (143)..(143): a, c, t, g, unknown or other
  misc_feature (143)..(143): n is a, c, g, or t
  modified_base (274)..(274): a, c, t, g, unknown or other
  misc_feature (274)..(274): n is a, c, g, or t
  modified_base (277)..(304): a, c, t, g, unknown or other
  misc_feature (277)..(304): n is a, c, g, or t
tcagtacgagtatgcacgaccggtgctcgatttagtgacatctcgcagtttctttggggtttggggggaagaggaagactgacggtcctccaggagttcgaggtcgcgtgggcaccggtgggcaggtgggggagtgtgtcaanaaagtgtttgggctcggtggcacacggccggcccgtgggcctgccgttagggtacaaacgggtacttacccttccctaagtaccgttacgtactacggacggtcgggtccgtgggacgaacgggcaactanagnnnnnnnnnnnnnnnnnnnnnnnnnnnn

SEQ ID NO: 240924 - DNA, 735 bp, Homo sapiens
  misc_feature: GYAE6OF01A97AI.18.39.D06.1.454.CMB.1.raw
  modified_base (162)..(162): a, c, t, g, unknown or other
  misc_feature (162)..(162): n is a, c, g, or t
  modified_base (211)..(211): a, c, t, g, unknown or other
  misc_feature (211)..(211): n is a, c, g, or t
  modified_base (243)..(243): a, c, t, g, unknown or other
  misc_feature (243)..(243): n is a, c, g, or t
  modified_base (669)..(669): a, c, t, g, unknown or other
  misc_feature (669)..(669): n is a, c, g, or t
  modified_base (672)..(672): a, c, t, g, unknown or other
  misc_feature (672)..(672): n is a, c, g, or t
  modified_base (675)..(675): a, c, t, g, unknown or other
  misc_feature (675)..(675): n is a, c, g, or t
  modified_base (679)..(679): a, c, t, g, unknown or other
  misc_feature (679)..(679): n is a, c, g, or t
  modified_base (706)..(706): a, c, t, g, unknown or other
  misc_feature (706)..(706): n is a, c, g, or t
  modified_base (712)..(712): a, c, t, g, unknown or other
  misc_feature (712)..(712): n is a, c, g, or t
tcagtacgagtatgcacgaccggtgctcgatttagtgacatctcgagtggatgggatggatgaacggtaaaactgccaacacaggctatgcagaggcattccgagggcagagtcaccatcggacccgggaacccctcaccggcacacgcctacatggacgcngagcagttctagaaccaccgtgaaccgacgaccggtcctacttattacnggtacgcgagacgaccggataatagttacggnggtcgaagaaaagtgtttcgggttcggtttttaggtttttggtttcggaccggttacgtaacgttacggccggggtaccgacgggtaccctaccggttcgtaccacccgttccgtcctaccgtacggtcccttacccgaccggaaaccggtccccttaacggtccgggttcccctttcccccggcggtcccgtcccgtcggtaccgttacccggaaggccgttaccaccggttccggggtacgggggacctaaccggtccgggaccggtccccggtggggtaccgtccgggtaccgtttagggaacccgttaaaccgggttaacccgttaccctttaaccgaaccgtttaccggttaccgacggttacggacgggttacgggcgtaacggacggaaacggcgttaccgaacgttagatacgctcgnganganacanatcgcgcagacgcgtagacgacgacancgacanacgtacgtcgagacgtgcgtacg

SEQ ID NO: 240925 - DNA, 754 bp, Homo sapiens
  misc_feature: GYAE6OF01BDEE1.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagtaattttgatatccattgggtgcgacaggccagtggacaagggctcgagtggatgggatggataggaaacggtaaactgaccaacacaggctatgcagaggcattccgagggcaagacgtccacagtcggaaccccggaaccccctccgacccggcctaaccgacgaccctaacgagtcgggaagccgtagacggactagtcctagacctaccgtgaaccgtaaccgccggtcctacttaactacgtgtcgacgacgcgaccgacgtaatgtggtcggtagagaaagttgtggtttagttttcgtttggtttcgggaccggttacgtaacggttacgggtcggggaccggtacgggccctaccggttacggtcccgtacccgtaccttcccgtaccgtaccgttccccttaccccgaaacccggtacccggtacccgtccgtttaccccggttcccccgttccccgtccgggacccgtccccgtcgtccctacccggacgtaccggtacccgacccgttcgggtacggggtaccacccggtccgggcccggtacccgggtcggtcccgttcggaccccgggttacgggtaacccgaacggttaccctaccccgtttccgtaacccgtttaccg

SEQ ID NO: 240926 - DNA, 600 bp, Homo sapiens
  misc_feature: GYAE6OF01CPQCA.18.39.D06.1.454.CMB.1.raw
  modified_base (134)..(134): a, c, t, g, unknown or other
  misc_feature (134)..(134): n is a, c, g, or t
  modified_base (255)..(255): a, c, t, g, unknown or other
  misc_feature (255)..(255): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (429)..(429): a, c, t, g, unknown or other
  misc_feature (429)..(429): n is a, c, g, or t
  modified_base (504)..(504): a, c, t, g, unknown or other
  misc_feature (504)..(504): n is a, c, g, or t
tcagtacgagtatgcacgaccggtgctcgatttagtgacatctcgcagttctggggctgaggtgaagaaccctgggcctcagtgaaggtctcctgtcagacctatggatcccttcagatttgatatcattggtncgacaggccagtggacaagggctcgagtggatgggatggatggaacggtaaaactgcaacaccaggctatgcagtaggcagttccagggcaaggagtcaccatcgacggaacctcaccggnactgctacatcggatccngancganctgacactgacgtacacggccgtctattacctggtcncganacggccctggaaatctgtacgggtcgacaaaaggcggttgtttacgttttgttgggttcggacgacttacgcgggtacggcggacgccgttacgtcgacctcgttacnccgtgaccttcccgacccgaacgggacccatacccgttcgtccccgtccgtcggccctaccgcctaccgaccggngtccaccgtcgttacggggcaccacgggtccgacccgggtcggtacgtgcccggttcgacgtaccggaactacccgttcctaacgtcgttaacccg

SEQ ID NO: 240927 - DNA, 552 bp, Homo sapiens
  misc_feature: GYAE6OF01B21ED.18.39.D06.1.454.CMB.1.raw
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (320)..(320): a, c, t, g, unknown or other
  misc_feature (320)..(320): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (485)..(485): a, c, t, g, unknown or other
  misc_feature (485)..(485): n is a, c, g, or t
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (533)..(533): a, c, t, g, unknown or other
  misc_feature (533)..(533): n is a, c, g, or t
tcagtacgagtatgcacgaccggtgctcgatttagtgacatctcgcagttctggggctgaggtgaagaaccctggggcctcagtgaaggtctcctgtcagacctatggattccccttcagaattttgatatccattgggtgcgacaggccagtggacaagggctcgagtggatgggatggatgaacggtaaactgccaacacaggtctatggcagaggcattccgagggcagagtcaccagtcgaccggaccctcgacgcacagtcctacagtcganctgngcagtctagacacctgaccgacacggccgtactattacngtgccgagacgccgacgaattgnggttggngaaccgtaaagtgttcggtactttttggtttcgttttggacccggttagaaccgttcggttgggcccgagggtccaccgtggtaccaccgtctaccgtcgagtcctacgaccgacggcctagtccggtctcccgngccgaccctgctcgagtcncgcgcgcggcncgcgccggtcnggcngcngtacacgtactctcagtcg

SEQ ID NO: 240928 - DNA, 187 bp, Homo sapiens
  misc_feature: GYAE6OF01AJ817.18.39.D06.1.454.CMB.1.raw
  modified_base (182)..(187): a, c, t, g, unknown or other
  misc_feature (182)..(187): n is a, c, g, or t
tcagtacgagtatgcacgaccggtgctcgatttagtgacatctcgcagttctttgggttttgggggaagaggaagactgacggtcctcccaggagttcaggtgctgggcacagcggccctgggctgcctggtcaaggactacttcccatactcgtactgagcgggctggcaaggcgcatagnnnnnn

SEQ ID NO: 240929 - DNA, 653 bp, Homo sapiens
  misc_feature: GYAE6OF01EU4KC.18.39.D06.1.454.CMB.1.raw
  modified_base (166)..(166): a, c, t, g, unknown or other
  misc_feature (166)..(166): n is a, c, g, or t
  modified_base (186)..(186): a, c, t, g, unknown or other
  misc_feature (186)..(186): n is a, c, g, or t
  modified_base (260)..(260): a, c, t, g, unknown or other
  misc_feature (260)..(260): n is a, c, g, or t
  modified_base (433)..(433): a, c, t, g, unknown or other
  misc_feature (433)..(433): n is a, c, g, or t
  modified_base (460)..(460): a, c, t, g, unknown or other
  misc_feature (460)..(460): n is a, c, g, or t
  modified_base (491)..(491): a, c, t, g, unknown or other
  misc_feature (491)..(491): n is a, c, g, or t
  modified_base (609)..(611): a, c, t, g, unknown or other
  misc_feature (609)..(611): n is a, c, g, or t
  modified_base (613)..(614): a, c, t, g, unknown or other
  misc_feature (613)..(614): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (623)..(624): a, c, t, g, unknown or other
  misc_feature (623)..(624): n is a, c, g, or t
  modified_base (627)..(628): a, c, t, g, unknown or other
  misc_feature (627)..(628): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (639)..(640): a, c, t, g, unknown or other
  misc_feature (639)..(640): n is a, c, g, or t
  modified_base (642)..(645): a, c, t, g, unknown or other
  misc_feature (642)..(645): n is a, c, g, or t
  modified_base (647)..(647): a, c, t, g, unknown or other
  misc_feature (647)..(647): n is a, c, g, or t
  modified_base (649)..(653): a, c, t, g, unknown or other
  misc_feature (649)..(653): n is a, c, g, or t
tcagtacgagtatgcacgaccggtgctcgatttagtgacatctcggagtgggatgggatggatgaaacggtaaaactgccaacacaggctatgcagaggcattccagggcagagtcaccatcggaacccgggtaaccccctccgaccggcacacgcctacatgganctaggagcagttctagaccncctaggaccgaccgacgggtcctactaattcgtgcgcgagacgccgacgtaatagtggtggtacgacaaaggtntgggtttccgttttggttttggttttcggcggtagaaccgttacggcggggccagggccctaccggtgtacctaccgtctccgtacgcgtaccttacccgaaccggaccggcccttacgtccgttcccccgttaccccggggcccctccgtatacccgtacgaacgggtaccnccctacccgggttggggcgggtacccncggaccgggtcccgggttccgtgggttcccnccgggtaacccggtttagtaaaccggaaccgtttaacccgttacccgttaacccccgtacgttaccggacgggttaacggtccggccggtacgtacggaaccggcgtcgaatagccgnnngnncgcgnangnngtnncncngcngngnngnnnngncnnnnn

SEQ ID NO: 240930 - DNA, 858 bp, Homo sapiens
  misc_feature: GYAE6OF01B4HO8.18.39.D06.1.454.CMB.1.raw
  modified_base (236)..(236): a, c, t, g, unknown or other
  misc_feature (236)..(236): n is a, c, g, or t
  modified_base (293)..(293): a, c, t, g, unknown or other
  misc_feature (293)..(293): n is a, c, g, or t
  modified_base (722)..(722): a, c, t, g, unknown or other
  misc_feature (722)..(722): n is a, c, g, or t
tcagtacgagtatgcacgaccggtgctcgatttagtgacatctcgcagttctggggctgaggtgaagaacccgtggggcctcagtgaaggtctcctgtcagacctagtcggtacttccccttccagtaattttgatatccgagttggggtgacgacgacggccaggtggaacgaagggctcggaggtggagtgggagtggataggaaacgtaaaactcgaccaacacgaggactangacgaggagctagtccgaggacagacgtaccacgacgtaccggaacccggtaccccnccgaccggaccaacgaccgacctaacgagtacgggacgtctaggacgtcgtacgtccgtacgaaccgtaccgtacgaacccgaaccgtacccggtaccgttacttaacgttacgtcgtacggaccggaagccggacgacgtaagtcgtgggtagtacgaagtaagttcggttcgggtttgttttacgggttttggttaccggggtaccggttaacggtaacgggttccgggtaccgggggaccctacgggtcccccgtaaccgggttcggttaccccgtaccctttacccgtacccgttacgacccgtttaccccggtaaaccgacccggggtaaccccggttccctaccgggtttcccccggttccccccttaccccggggtcgaccccccgtttccgacccgtacccggaaccggcggttaaccccnccgaacccgggtttggggaacccgggccctaacccgggccgggccccggttaccgggtcggtccgtacccgggaccggtttaacgggtaaccccggtactttaccccggttacccccttggttaacccgttcccgg

SEQ ID NO: 240931 - DNA, 720 bp, Homo sapiens
  misc_feature: GYAE6OF01AF40T.18.39.D06.1.454.CMB.1.raw
  modified_base (160)..(160): a, c, t, g, unknown or other
  misc_feature (160)..(160): n is a, c, g, or t
  modified_base (467)..(467): a, c, t, g, unknown or other
  misc_feature (467)..(467): n is a, c, g, or t
  modified_base (654)..(654): a, c, t, g, unknown or other
  misc_feature (654)..(654): n is a, c, g, or t
  modified_base (681)..(681): a, c, t, g, unknown or other
  misc_feature (681)..(681): n is a, c, g, or t
  modified_base (685)..(685): a, c, t, g, unknown or other
  misc_feature (685)..(685): n is a, c, g, or t
  modified_base (690)..(691): a, c, t, g, unknown or other
  misc_feature (690)..(691): n is a, c, g, or t
  modified_base (693)..(693): a, c, t, g, unknown or other
  misc_feature (693)..(693): n is a, c, g, or t
  modified_base (696)..(718): a, c, t, g, unknown or other
  misc_feature (696)..(718): n is a, c, g, or t
  modified_base (720)..(720): a, c, t, g, unknown or other
  misc_feature (720)..(720): n is a, c, g, or t
tcagtacgagtatgcacgaccggtgctcgatttagtgacatctcgagtggatggggatggatgaacggtaaaactgccaacacaggctatgcagaggcattccagggcagagtcacatcggaacccgggacccctccgaccggcacacgcctacatgganctagagcagtctacgaccaccgtagaccgaccgaccgggtcccgttattattaccgtggtcggcgaggacgccgaagaattgtggtggtgaacaaaaggtgtttcgggtttcggttttggttttttcgggttttcggggacccggttaagaacccgttaggggtccggggggaccctaacgggggtcccctacccgggtttcgggtccctaacccccggtttcctacccttacggaccgtttcccctaaccccggaaccgggaacccgggttcccctagggtttccccgtttcccccgttccccggngggcccccgtacccgttcgccccggttacggaacgggtcctccccgtacgggtccgggggtcggggaccccaaccgggtccgggcccgggtcccggtcggggcccttccgggttccggtaacgggtaaccgaccggttaccctttccgtaaccgacgttttaccgacggttccgagggcggtccggngacgggaccgacgggtcctaagtcgancttnatcgnntncannnnnnnnnnnnnnnnnnnnnnngn

SEQ ID NO: 240932 - DNA, 219 bp, Homo sapiens
  misc_feature: GYAE6OF01EOF61.18.39.D06.1.454.CMB.1.raw
  modified_base (192)..(219): a, c, t, g, unknown or other
  misc_feature (192)..(219): n is a, c, g, or t
tcagtacgagtatgcacgaccggtgctcgatttagtgacatctcgcagttctttgggctctgggcaccgtgggcatgggggagtgtgtcacaagatttgggctcgtgggcacagccggccctgggctgcctggtacaaaggtacctaccttcccattactcgtactgagcgggctggcaaggcgctaatagnnnnnnnnnnnnnnnnnnnnnnnnnnnn

SEQ ID NO: 240933 - DNA, 609 bp, Homo sapiens
  misc_feature: GYAE6OF01BH2OW.18.39.D06.1.454.CMB.1.raw
  modified_base (252)..(252): a, c, t, g, unknown or other
  misc_feature (252)..(252): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
  modified_base (445)..(445): a, c, t, g, unknown or other
  misc_feature (445)..(445): n is a, c, g, or t
  modified_base (538)..(538): a, c, t, g, unknown or other
  misc_feature (538)..(538): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(555): a, c, t, g, unknown or other
  misc_feature (554)..(555): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (576)..(576): a, c, t, g, unknown or other
  misc_feature (576)..(576): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (592)..(592): a, c, t, g, unknown or other
  misc_feature (592)..(592): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
tcagtacgagtatgcacgaccggtgctcgatttagtgacatctcgagtgggatgggatggatgaacggtaaaacctgccaacacaggctatgcagaggcattccagggcagatcaccatcgaccggacccctcaccggcacagcctacgatggagctgagcagtctgacacctgacgacagtcggccctattacgttaccgtgttgccgaaggacgtcccggagaaagttatcggtggtacggcaaaaaggngttgggtcgttttgtttggttttcggccggtagtaactcggtcggggtccagggcacccgtggttccaccggttcctccctcgacgtccctttaccaacccgaaagggcccctaatttcccgggttacccctttccccccngggtacccnccccttggcccttaccgagggacnctacccgtggtcggggccnccggacggccgccgtcgggctcggccgcggttacaacggtacctaccgttcctaatccgttacgtacagggtcgcgggtgaggccgacgggancgaagtcggacngncnncngngcgngngctcgtcgcgngcgngcgtncncnganactcgtcgntntgngng

SEQ ID NO: 240934 - DNA, 641 bp, Homo sapiens
  misc_feature: GYAE6OF01BNYXG.18.39.D06.1.454.CMB.1.raw
  modified_base (161)..(161): a, c, t, g, unknown or other
  misc_feature (161)..(161): n is a, c, g, or t
  modified_base (384)..(384): a, c, t, g, unknown or other
  misc_feature (384)..(384): n is a, c, g, or t
  modified_base (587)..(587): a, c, t, g, unknown or other
  misc_feature (587)..(587): n is a, c, g, or t
  modified_base (593)..(593): a, c, t, g, unknown or other
  misc_feature (593)..(593): n is a, c, g, or t
  modified_base (598)..(598): a, c, t, g, unknown or other
  misc_feature (598)..(598): n is a, c, g, or t
  modified_base (602)..(602): a, c, t, g, unknown or other
  misc_feature (602)..(602): n is a, c, g, or t
  modified_base (611)..(612): a, c, t, g, unknown or other
  misc_feature (611)..(612): n is a, c, g, or t
  modified_base (614)..(614): a, c, t, g, unknown or other
  misc_feature (614)..(614): n is a, c, g, or t
  modified_base (616)..(617): a, c, t, g, unknown or other
  misc_feature (616)..(617): n is a, c, g, or t
  modified_base (619)..(619): a, c, t, g, unknown or other
  misc_feature (619)..(619): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
  modified_base (639)..(639): a, c, t, g, unknown or other
  misc_feature (639)..(639): n is a, c, g, or t
tcagtacgagtatgcacgaccggtgctcgatttagtgacatctcgagtggatgggatggatgaaacggtaaaactgccaacacaggctatgcagaggcattccagggcagagtcaccatcggacccgggaaccccctccaccggcacagcctacagtgganctgagctagtctcgaccacctgaccgacaccggtcctctattactggtgacgagacgccgacgaatgtgtggtagaacgaagtgttgggttcgttttgttttcggttttcggcggttagtaaacgtcggtcggggaccagggccctaccggtggtacctacccggttctcctacgtacgtccttacccaccggaacgggccctagttcccggtccttccccgnggcccctcccgtgccgtaccgaggaccgccgtaccggttcgggcggggaccacggcgggtcccggtccgttggggccttcggaccggttaggtaaccgtaacggttacccttcccgttaaccctacgttaccttaccgggtaacgtgggaaccgggtcggacgtaacgggaccgaacggtcctaaccgtagtacgctagcgancgactnacgtnacgncgtgcagcnngncnncncgacgtctctcgcgncncgntc

SEQ ID NO: 240935 - DNA, 865 bp, Homo sapiens
  misc_feature: GYAE6OF01BS9KB.18.39.D06.1.454.CMB.1.raw
  modified_base (814)..(814): a, c, t, g, unknown or other
  misc_feature (814)..(814): n is a, c, g, or t
  modified_base (820)..(820): a, c, t, g, unknown or other
  misc_feature (820)..(820): n is a, c, g, or t
  modified_base (823)..(823): a, c, t, g, unknown or other
  misc_feature (823)..(823): n is a, c, g, or t
  modified_base (826)..(827): a, c, t, g, unknown or other
  misc_feature (826)..(827): n is a, c, g, or t
  modified_base (829)..(829): a, c, t, g, unknown or other
  misc_feature (829)..(829): n is a, c, g, or t
  modified_base (834)..(834): a, c, t, g, unknown or other
  misc_feature (834)..(834): n is a, c, g, or t
  modified_base (836)..(836): a, c, t, g, unknown or other
  misc_feature (836)..(836): n is a, c, g, or t
  modified_base (841)..(841): a, c, t, g, unknown or other
  misc_feature (841)..(841): n is a, c, g, or t
  modified_base (843)..(846): a, c, t, g, unknown or other
  misc_feature (843)..(846): n is a, c, g, or t
  modified_base (849)..(849): a, c, t, g, unknown or other
  misc_feature (849)..(849): n is a, c, g, or t
  modified_base (852)..(852): a, c, t, g, unknown or other
  misc_feature (852)..(852): n is a, c, g, or t
  modified_base (854)..(857): a, c, t, g, unknown or other
  misc_feature (854)..(857): n is a, c, g, or t
  modified_base (859)..(862): a, c, t, g, unknown or other
  misc_feature (859)..(862): n is a, c, g, or t
  modified_base (864)..(864): a, c, t, g, unknown or other
  misc_feature (864)..(864): n is a, c, g, or t
tcagtacgagtatgcacgaccggtgctcgatttagtgacatctcgagtggatgggatggatgaacggtaaaactgccaacacaggctatgcagaggcattccgagggcagagtcaccatcggacccgggaaccccctccgaccggcacgacgcctacagtgggagcgtgagcagtctcgacaccgtgacgacacggccgtctattcgtgtgcgagacgccgagaatgtggtggtagacgtaaagtgttcggttggttttggtttttgggttacgggtccggttagaaccgttacgggtacggggaccgtacggggtaccctacccggtttacgggtacccctacccggtttccttccccgttaccgtaaccggttccccgttttaaacccccggaaacccgggtaaaaccccgggtaccccgtttaccggtttcccccgggttttccccccgtttccccccggttcggggtacccccgttccccggttccggtaccccggtaccccggacgggtaccgtaccccgttaacccggggtttcccgggggacggggggtaccccaaacccggggttcccccgggggcccccgggggtttacccccgggttccgggggtccctttaccccggggtaacccgggtttacccggggttaaaacccgttaaaacccggggtttaaccccctttaaccccggttttaacccccggttaacccgttttaaaccccgttacccggggtttaccgttccggggtaaaccggggtcccgggggacggtttaccggggaacgtaaccgggtacggtaacccgttaanacgggntcncgnncncgcgngncgcgncnnnngcnctncnnnntnnnngnc

SEQ ID NO: 240936 - DNA, 698 bp, Homo sapiens
  misc_feature: GYAE6OF01E0UJF.18.39.D06.1.454.CMB.1.raw
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
  modified_base (415)..(415): a, c, t, g, unknown or other
  misc_feature (415)..(415): n is a, c, g, or t
  modified_base (496)..(496): a, c, t, g, unknown or other
  misc_feature (496)..(496): n is a, c, g, or t
tcagtacgagtatgcacgaccggtgctcgatttagtgacatctcgcagttctggggctgaggtgaagaaccctggggcctcagtgaaggtctcctgtcagacctatgtacttccccttcagtattttgatatccagttgggtgcgacaggccaggtggaacgaagggctacggagtggagtgggatggataggaaaacggtaaactcgaccaacacgaaggctatgacagacggctacgtccgaggacagacgtccacagtacggaaccccggaaccctccgaccggtcacncgccctagagtaggacncgtagacgcagtcgtacgacacccgtagaaccgacgtaccgggtccttactaatttacgtaggtcggacgacggacgtaccgactaaagtcgtggttaggacgaanaaacggtgttcggtttgttttacgggtttcggtttacggaccgttaggtaaccgtacggggtcgggaccgtacgggtaccncccggttagggtacccctaccgtcctacctaccgaacgttcctaacccgaccgtaccggcccttacggtcccgttccctccccgtcgggccctccctcgacccgttacgaacggtcaccgtccggcggtcgggccaacggcggtcccgtcgggtcgccgtcgtacccgtgtaccgaacgttcccttaccgtccacgttaccg

SEQ ID NO: 240937 - DNA, 685 bp, Homo sapiens
  misc_feature: GYAE6OF01ETD0W.18.39.D06.1.454.CMB.1.raw
  modified_base (141)..(141): a, c, t, g, unknown or other
  misc_feature (141)..(141): n is a, c, g, or t
  modified_base (178)..(178): a, c, t, g, unknown or other
  misc_feature (178)..(178): n is a, c, g, or t
  modified_base (195)..(195): a, c, t, g, unknown or other
  misc_feature (195)..(195): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
tcagtacgagtatgcacgaccggtgctcgatttagtgacatctcgcagttctggggctgaggtgaagaaccctggggcctcagtgaaggtctcctgtcagacctagtggacttccccttcagtatttgatatccattgggngacgacaggcagtggaacaaggctgagtggagtgggntggatagaacgtaaacngaccaanacgagctagngacagagctagtacgaggcaagtcgaccaacgacgtacggaacccccggaaccctccgacgacactacgaccctanatggancgtagacgcagtcagaccacgtaggaccgacgtccgacgttctaacttgtcgtggacgagaccgaccgagtaaatcgttggaacgtaggaacctaaaaggtgttcggtttcggtttttaggtttacggttttcgggaccggttaaagtaccgtacgggtgggaccgtacggccgtaccgtcggtacctaaccggtcacgtacgacgttcctaaccgaaccgacggtaccctacgttcccggtacccctacccgcggaccctcccgttacgacccgtacggtaacggaccgtacccgtacggttcgggaccggggacctaaccggccgggtacccgcgtcgggcctcgggaccgtacgtacggtaactaacccgttctaccgtaagtacccg

SEQ ID NO: 240938 - DNA, 826 bp, Homo sapiens
  misc_feature: GYAE6OF01A396N.18.39.D06.1.454.CMB.1.raw
  modified_base (569)..(569): a, c, t, g, unknown or other
  misc_feature (569)..(569): n is a, c, g, or t
tcagtacgagtatgcacgaccggtgctcgatttagtgacatctcgcagttctggggctgaggtgaagaaccctggggcctcagtgaaggtctcctgtcagacctatggacttccccttccagtaattttgatatccattgggtgcgacaggccagtggacaagggctcgagtggatgggatggataggaaacggtaaaactgaccaaacacgacggccatgacaggacggctattccgagggacaggacgtacaccgagtaccggaaccccggaacccctccgaccggaccaccacgacctacgagtcggagcgtggacgcgtacgtccgtacgaaccaccgtacggaaccgaccggtaccggtccgttacttaacttacgtggtacggaccgagaaccggtcccggacgtaaattcggttaggttaggtacgtaaacgtaaaggttggttacgggtttcggtttttagggtttttcggtttccggggtaaccggttagtaacccggttacgggggtccggggtaccgtacgggtccctacccggttccgggttaccctacccggttcncccgtacgaccgttccctaacccgaaccggtacccggtcccttacggttccccgggtttacccctcccccgggtggaccccttcccgtacggcccgttaaccggaacggtccgtacccgtacccgggttcggggtaccggaccctacgggaccccgggtccgggcccgggttcgggtacccgttcccgggtacccgggttaagggttaaacccgaccgtttacccctttacccgttaccccgtaagggttacccccg

SEQ ID NO: 240939 - DNA, 203 bp, Homo sapiens
  misc_feature: GYAE6OF01DML2I.18.39.D06.1.454.CMB.1.raw
  modified_base (184)..(203): a, c, t, g, unknown or other
  misc_feature (184)..(203): n is a, c, g, or t
tcagtacgagtatgcacgaccggtgctcgatttagtgacatctcgcagttctttgggctctgggcaccgtgggcagtgggggagtgtgtcacaagatttgggctctgggcacagccggcctgggctgcctggtcaaggctacttcccatactcgtactgacgcgggctggcaaggcgcagtagnnnnnnnnnnnnnnnnnnnn

SEQ ID NO: 240940 - DNA, 614 bp, Homo sapiens
  misc_feature: GYAE6OF01CKU5D.18.39.D06.1.454.CMB.1.raw
  modified_base (585)..(614): a, c, t, g, unknown or other
  misc_feature (585)..(614): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagacgccgacgaattatggtggtgacgaaaagtagttgggttcgtttggtttttggttttggccggttagaacttacggtcggggccagggccacccgtggtcctaccgttctcctcgacgtccttacccgaccgaacgggtcccctagttccgggttcccttcccccgtcgggcccgtccccgtcgcctcccgaggaccgccgtacccgtcgggtcgggggaccacggacggcccgggtcccgtggggcctcggtcccgtacgggtaccgaaacgggtacccttaaccctttaccccaacgttacccgttcggttaaccgtcgggtaacgggtccggggtccgtacggggaccgaaacggggtccgacgtacgttaagctagcnnnnnnnnnnnnnnnnnnnnnnnnnnnnnn

SEQ ID NO: 240941 - DNA, 182 bp, Homo sapiens
  misc_feature: GYAE6OF01DSBKR.18.39.D06.1.454.CMB.1.raw
  modified_base (182)..(182): a, c, t, g, unknown or other
  misc_feature (182)..(182): n is a, c, g, or t
tcagtacgagtatgcacgaccggtgctcgatttagtgacatctcgcagttctttgggttttgggggaagaggaagactgacggtccccccaggagttcaggtgctgggcacagcggccctgggctgcctggtcaaggactacttcccatactcgtactgagcgggctggcaaggcgcatagn

SEQ ID NO: 240942 - DNA, 502 bp, Homo sapiens
  misc_feature: GYAE6OF01C3W33.18.39.D06.1.454.CMB.1.raw
  modified_base (223)..(223): a, c, t, g, unknown or other
  misc_feature (223)..(223): n is a, c, g, or t
  modified_base (264)..(264): a, c, t, g, unknown or other
  misc_feature (264)..(264): n is a, c, g, or t
  modified_base (471)..(471): a, c, t, g, unknown or other
  misc_feature (471)..(471): n is a, c, g, or t
  modified_base (486)..(502): a, c, t, g, unknown or other
  misc_feature (486)..(502): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgaacgacacggccgtcttatactgtgacgagacgccgagaatagtgtggtnacaaagtgttggtcgtttgttttgttggccggtgaactcgnggggccagggtcctacccgtggtccaccggtcctcctcgacgtccttaccgacccgaacgggccctacgtcccggttccttcccccgtggtcccgccctcgcctaccgaggacgcctaccgtcggtcggggcacgcggccggcccgtgggcctcgccgtggtaccacggtacctaccttcccattaccgtctcgtggaggcggtcgnggcgtaaggcatagnnnnnnnnnnnnnnnnn

SEQ ID NO: 240943 - DNA, 755 bp, Homo sapiens
  misc_feature: GYAE6OF01AHG15.18.39.D06.1.454.CMB.1.raw
  modified_base (245)..(245): a, c, t, g, unknown or other
  misc_feature (245)..(245): n is a, c, g, or t
tcagtacgagtatgcacgaccggtgctcgatttagtgacatctcgctagtttcgtttggggctgttcctttggttttggagattggttttctcgagtgggggctgggagggtctttgttggagaccttgctacttgtactccttgccgttcagccagtcctggtgcagggacggtgaggacgctgaaccacgacggaacgtgctggttagaactgcctccgtcgaggcgtctttgtctgctattngaccacctccgaccgcctccacgtaccacttgaacctcggaccgtcggggttcttcggtggctccgaccgtcccaccaccacgcacgtcgaccgtcggacggggtacgaatcgaagttaaggtacgttcgggtttaggggttaggggaagagggaacgtcgtacggtaccgtccgaccgagggtacgttacgaggtaacgaaccggtaacccggtcgggtacctacgaggtacggtacgtccgtacgtacggtaccaacggtaccttagttacccggtaccttttcccctaagttaagtttactttacgaacttaccgttcgtaaggtttcggggacacccggtaaggtcggaccggtaaaggtcgggtaaaccgggtacgggtcgttagggacgggttagggtaggtaggggtaaactaggggtaaacggtaaacgggtaaaacccgggtaaactccggtaaaccgaaacggtacggtacggtacgttagagaccgggaaggtacccgg

SEQ ID NO: 240944 - DNA, 864 bp, Homo sapiens
  misc_feature: GYAE6OF01B188X.18.39.D06.1.454.CMB.1.raw
  modified_base (270)..(270): a, c, t, g, unknown or other
  misc_feature (270)..(270): n is a, c, g, or t
tcagtacgagtatgcacgaccggtgctcgatttagtgacatctcgcagttctggggctgaggtgaagaaccctgggcctcagtgaaggtctcctgtcagacctatggacttccccttcagtaattttgatatccattgggtgcgacaggccaggtggacgaagggctgagtggagtgggatggataggaaacggtaaactcgaccaacacgaggctagtgcaggagtctactccggaggacagactaccacagtacggacccggaccccnccgaccgcaacacgcctacgagtggactcgagcgacgtagtctacgaccgtaccgacgaccgaccgaccggtaccgttacgtaacgttacgtggttaccgacggacgtacccgcccggtaagttaacgttagtacgggttagggaacgtaaagtaaacggttacggttttcgggttttacggtttttgggtttttacccggggttttcggtacccgggtttaaacgttaaacccgggttccgggggtacccgggacccggttaaccggggtccccttaaccgggttcccggttaacccccgtacccggtttcccgttcccggtaccgtacccgttacccgttaaccccgaaccggggtaacccggtccccgttaccggtttcccccggttacccccgttccccggtccggtcccccgtcccgttaccggtacccgttacccgggacggtacccgcccgttaccccggtaggggtcccggaacgacccgggtaccggtcccggggtcccggttaaccgggcccggttcggttacccggttcgggtaaaacccgtaccggttacctttaccccggttaaccgtaccggtttacccg

SEQ ID NO: 240945 - DNA, 187 bp, Homo sapiens
  misc_feature: GYAE6OF02IPLD1.18.39.D06.1.454.CMB.1.raw
  modified_base (179)..(187): a, c, t, g, unknown or other
  misc_feature (179)..(187): n is a, c, g, or t
tcagtacgagtatgcacgaccggtgctcgatttagtgacatctcgcagttctttgggtttgggaagaggaagactgacggtcctcccaggagttcaggtgctgggcacagcggccctgggctgcctggtcaaggactacttcccatactcgtactgagcgggctggcaaggcgcatagnnnnnnnnn

SEQ ID NO: 240946 - DNA, 182 bp, Homo sapiens
  misc_feature: GYAE6OF02HHDDM.18.39.D06.1.454.CMB.1.raw
  modified_base (180)..(182): a, c, t, g, unknown or other
  misc_feature (180)..(182): n is a, c, g, or t
tcagtacgagtatgcacgaccggtgctcgatttagtgacatctcgcagttctttgggtttggggaagaggaagactgacggtcctcccaggagttcaggtgctgggcacagcggccctgggctgcctggtcaaggactacttcccatactcgtactgagcgggctggcaaggcgcatagnnn

SEQ ID NO: 240947 - DNA, 202 bp, Homo sapiens
  misc_feature: GYAE6OF02GL3IA.18.39.D06.1.454.CMB.1.raw
  modified_base (181)..(202): a, c, t, g, unknown or other
  misc_feature (181)..(202): n is a, c, g, or t
tcagtacgagtatgcacgaccggtgctcgatttagtgacatctcgcgagttctttgggtttggggaagaggaagactgacggtcctcccaggagttcaggtgctgggcacagcggccctgggctgcctggtcaaggactacttcccatactcgtactgagcgggctggcaaggcgcatagnnnnnnnnnnnnnnnnnnnnnn

SEQ ID NO: 240948 - DNA, 354 bp, Homo sapiens
  misc_feature: GYAE6OF02HWY72.18.39.D06.1.454.CMB.1.raw
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (299)..(300): a, c, t, g, unknown or other
  misc_feature (299)..(300): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (312)..(313): a, c, t, g, unknown or other
  misc_feature (312)..(313): n is a, c, g, or t
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (345)..(345): a, c, t, g, unknown or other
  misc_feature (345)..(345): n is a, c, g, or t
  modified_base (349)..(354): a, c, t, g, unknown or other
  misc_feature (349)..(354): n is a, c, g, or t
tcagtacgagtatgcacgaccggtgctcgatttagtgacatctcgtcgtaggttctttgggttttggggaagacggaagaactcgacggtcctacccacggacgtttccacggtgtctagggccaccggtggggccactgggggaggtggtcgtctactaagtatttgggctctgggcacagtccggccctggggctgccgtgggtcaaggcctttacttcccatacctcgggtacctaggagacgggctggccaaggcgtccactacgcaggcatgntcccngcacctcncagncncnnggncngcgcngnngctgnagcactcacatctntcngngcgngngngagnnnnnn

SEQ ID NO: 240949 - DNA, 183 bp, Homo sapiens
  misc_feature: GYAE6OF02GA9JF.18.39.D06.1.454.CMB.1.raw
  modified_base (181)..(183): a, c, t, g, unknown or other
  misc_feature (181)..(183): n is a, c, g, or t
tcagtacgagtatgcacgaccggtgctcgatttagtgacatctcgcagttctttgggtttgggggaagaggaagactgacggtcctcccaggagttcaggtgctgggcacagcggccctgggctgcctggtcaaggactacttcccatactcgtactgagcgggctggcaaggcgcatagnnn

SEQ ID NO: 240950 - DNA, 176 bp, Homo sapiens; identical to SEQ ID NO: 240806
  misc_feature: GYAE6OF02H2RAW.18.39.D06.1.454.CMB.1.raw
  modified_base (175)..(176): a, c, t, g, unknown or other
  misc_feature (175)..(176): n is a, c, g, or t

SEQ ID NO: 240951 - DNA, 183 bp, Homo sapiens; identical to SEQ ID NO: 240949
  misc_feature: GYAE6OF02ISIWQ.18.39.D06.1.454.CMB.1.raw
  modified_base (181)..(183): a, c, t, g, unknown or other
  misc_feature (181)..(183): n is a, c, g, or t

SEQ ID NO: 240952 - DNA, 247 bp, Homo sapiens
  misc_feature: GYAE6OF02IBJJA.18.39.D06.1.454.CMB.1.raw
  modified_base (226)..(247): a, c, t, g, unknown or other
  misc_feature (226)..(247): n is a, c, g, or t
tcagtacgagtatgcacgaccggtgctcgatttagtgacatctcgcaggttctttgggtttgggggaagaggaagactgacggtcctcccaggagttcaggtgctgggcaccgtgggcagtggggaggtgtgtcacaagagtttgggctctgggcacagcggcctgggctgcctggtcaaggctacttccagtactcgtactgagcgggctggcaaggcgcatagnnnnnnnnnnnnnnnnnnnnnn

SEQ ID NO: 240953 - DNA, 186 bp, Homo sapiens
  misc_feature: GYAE6OF02J0UDF.18.39.D06.1.454.CMB.1.raw
  modified_base (174)..(186): a, c, t, g, unknown or other
  misc_feature (174)..(186): n is a, c, g, or t
tcagtacgagtatgcacgaccggtgctcgatttagtgacatctcgcagttctttggggaagaggaagactgacggtcctcccaggagttcaggtgctgggcacagcggccctgggctgcctggtcaaggactacttcccatactcgtactgagcgggctggcaaggcgcatagnnnnnnnnnnnnn

SEQ ID NO: 240954 - DNA, 254 bp, Homo sapiens
  misc_feature: GYAE6OF02IR9D7.18.39.D06.1.454.CMB.1.raw
  modified_base (226)..(254): a, c, t, g, unknown or other
  misc_feature (226)..(254): n is a, c, g, or t
tcagtacgagtatgcacgaccggtgctcgatttagtgacatctcgcgagttctttgggttttgggggaagaggaagactgacggtcctcccaggagttaccaggtgctgggcaccgtgggcatggggagtgtgtcacaagatttgggctctgggcacagcggcctgggctgcctggtcaaggctacttccatactcgtactggagcgggctggcaaggcgcatagnnnnnnnnnnnnnnnnnnnnnnnnnnnnn

SEQ ID NO: 240955 - DNA, 427 bp, Homo sapiens
  misc_feature: GYAE6OF02IKGFV.18.39.D06.1.454.CMB.1.raw
  modified_base (421)..(427): a, c, t, g, unknown or other
  misc_feature (421)..(427): n is a, c, g, or t
tcagtacgagtatgcacgaccggtgctcgatttagtgacatctcgagtggatgggatggatgaacggtaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaaagatggtcgttgtttgtttggccggtgaactactggggccagggcaccctggtcaccgtctcctcagcttccaccaagggcccatcggtcttcccctgcgccctgctccaggagcacctctggggcacagcggccctgggctgcctggtcaaggactactcccatactcgtactgagcgggctggcaaggcgcatagnnnnnnn

SEQ ID NO: 240956 - DNA, 364 bp, Homo sapiens
  misc_feature: GYAE6OF02H7RSW.18.39.D06.1.454.CMB.1.raw
  modified_base (360)..(364): a, c, t, g, unknown or other
  misc_feature (360)..(364): n is a, c, g, or t
tcagtacgagtatgcacgaccggtgctcgatttagtgacatctcgcgtaggttctttagggttttgggggaagaggaagaactgacggtcctccaggagttcaggtgctgggcaccgtcgggcatggggaggtgtgtcacaagatttgggctcgtgggcaccgtgggcatgggggaggtgtgtcacaagatttgggctctgggcaccctggtcaccgtctcctcagcttccaccaagggcccatcggtcttccccctggcgccctgctccaggagcacctctgggggcacagcggccctgggctgcctggtcaaggctacttcccatactcgtactgagcgggctggcaaggcgcatagnnnnn

SEQ ID NO: 240957 - DNA, 365 bp, Homo sapiens
  misc_feature: GYAE6OF02HUJXR.18.39.D06.1.454.CMB.1.raw
  modified_base (353)..(365): a, c, t, g, unknown or other
  misc_feature (353)..(365): n is a, c, g, or t
tcagtacgagtatgcacgaccggtgctcgatttagtgacatctcgcagttctttgggtttgggggaagaggaagactgacggtcctcccaggagttcaggtgctgggcaccgtgggcatggggaggtgtgtcacaagatttgggctctgggcaccgtgggcatgggggaggtgtgtcacaagatttgggctctgggcaccctggtcaccgtctcctcagcttccaccaagggcccatcggtcttgcccctggcgccctgctccaggagcacctctggggcacagcggccctgggctgcctggtcaaggactacttcccatactcgtactgagcgggctggcaaggcgcatagnnnnnnnnnnnnn

SEQ ID NO: 240958 - DNA, 431 bp, Homo sapiens
  misc_feature: GYAE6OF02GH56N.18.39.D06.1.454.CMB.1.raw
  modified_base (424)..(431): a, c, t, g, unknown or other
  misc_feature (424)..(431): n is a, c, g, or t
tcagtacgagtatgcacgaccggtgctcgatttagtgacatctcgagtggatgggatggatgaacggtaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttccccctggcgccctgctccaggagcacctctgggggcacagcggccctgggctgcctggtcaaggactacttcccatactcgtactgagcgggctggcaaggcgcatagnnnnnnnn

SEQ ID NO: 240959 - DNA, 184 bp, Homo sapiens; identical to SEQ ID NO: 240734
  misc_feature: GYAE6OF02FJNTY.18.39.D06.1.454.CMB.1.raw
  modified_base (182)..(184): a, c, t, g, unknown or other
  misc_feature (182)..(184): n is a, c, g, or t

SEQ ID NO: 240960 - DNA, 222 bp, Homo sapiens
  misc_feature: GYAE6OF02HMX90.18.39.D06.1.454.CMB.1.raw
  modified_base (220)..(222): a, c, t, g, unknown or other
  misc_feature (220)..(222): n is a, c, g, or t
tcagtacgagtatgcacgaccggtgctcgatttagtgacatctcgcagttctttgggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnnn

SEQ ID NO: 240961 - DNA, 186 bp, Homo sapiens; identical to SEQ ID NO: 240716
  misc_feature: GYAE6OF02GRQFF.18.39.D06.1.454.CMB.1.raw
  modified_base (183)..(186): a, c, t, g, unknown or other
  misc_feature (183)..(186): n is a, c, g, or t

SEQ ID NO: 240962 - DNA, 184 bp, Homo sapiens
  misc_feature: GYAE6OF02GL2BN.18.39.D06.1.454.CMB.1.raw
  modified_base (182)..(184): a, c, t, g, unknown or other
  misc_feature (182)..(184): n is a, c, g, or t
tcagtacgagtatgcacgaccggtgctcgatttagtgacatctcgcagttctttgggctctgggcaccgtgggcatgggggaggtgtgtcacaagatttgggctctgggcacagcggccctgggctgcctggtcaggactacttcccatactcgtactgagcgggctggcaaggcgcatagnnn

SEQ ID NO: 240963 - DNA, 184 bp, Homo sapiens; identical to SEQ ID NO: 240734
  misc_feature: GYAE6OF02GBMPW.18.39.D06.1.454.CMB.1.raw
  modified_base (182)..(184): a, c, t, g, unknown or other
  misc_feature (182)..(184): n is a, c, g, or t

SEQ ID NO: 240964 - DNA, 349 bp, Homo sapiens
  misc_feature: GYAE6OF02GO6PD.18.39.D06.1.454.CMB.1.raw
  modified_base (345)..(349): a, c, t, g, unknown or other
  misc_feature (345)..(349): n is a, c, g, or t
tcagtacgagtatgcacgaccggtgctcgatttagtgacatctcgcagttctttgggggaagaggaagactgacggtcctcccaggagttcaggtgctgggcaccgtgggcatggggaggtgtgtcacaagatttgggctctgggcaccgtgggcatgggggaggtgtgtcacaagatttgggccagggcaccctggtcaccgtctcctcagcttccaccaagggcccatcggtcttccccctggcgccctgctccaggagcacctctggggcacagcggccctgggctgcctggtcaaggactacttcccatactcgtactgagcggctggcaaggcgcatagnnnnn

SEQ ID NO: 240965 - DNA, 183 bp, Homo sapiens; identical to SEQ ID NO: 240729
  misc_feature: GYAE6OF02GMIJR.18.39.D06.1.454.CMB.1.raw
  modified_base (182)..(183): a, c, t, g, unknown or other
  misc_feature (182)..(183): n is a, c, g, or t

SEQ ID NO: 240966 - DNA, 379 bp, Homo sapiens
  misc_feature: GYAE6OF02IZACF.18.39.D06.1.454.CMB.1.raw
  modified_base (354)..(379): a, c, t, g, unknown or other
  misc_feature (354)..(379): n is a, c, g, or t
tcagtacgagtatgcacgaccggtgctcgatttagtgacatctcgcagttctttgggttttgggggaagaggaagactgacggtcctcccaaggagttcaggtgctgggcaccgtgggcatggggaggtgtgtcacaagatttgggctctgggcaccgtgggcatgggggagtgtgtcacaagatttgggctctgggcaccctggtcaccgtctcctcagcttccaccaagggcccatcggtcttccccctggcgccctgctccaggagcacctctggggcacagcggccctggctgcctggtcaaggactacttcccatacctcgtactgagcgggctggcaaggcgcatagnnnnnnnnnnnnnnnnnnnnnnnnnn

SEQ ID NO: 240967 - DNA, 352 bp, Homo sapiens
  misc_feature: GYAE6OF02GSVGX.18.39.D06.1.454.CMB.1.raw
  modified_base (347)..(352): a, c, t, g, unknown or other
  misc_feature (347)..(352): n is a, c, g, or t
tcagtacgagtatgcacgaccggtgctcgatttagtgacatctcgcagttctttggggggaagaggaagactgacggtcctcccaggagttcaggtgctgggcaccgtgggcatggggaggtgtgtcacaagatttgggctctgggcaccgtgggcatgggggaggtgtgtcacaagatttgggccagggcaccctggtcaccgtctcctcagcctccaccaagggcccatcggtcttccccctggcaccctcctccaagagcacctctgggggcacagcggccctgggctgcctggtcaaggactacttcccatactcgtactgagcggctggcaaggcgcatagnnnnnn

SEQ ID NO: 240968 - DNA, 183 bp, Homo sapiens; identical to SEQ ID NO: 240729
  misc_feature: GYAE6OF02G0C4T.18.39.D06.1.454.CMB.1.raw
  modified_base (182)..(183): a, c, t, g, unknown or other
  misc_feature (182)..(183): n is a, c, g, or t

SEQ ID NO: 240969 - DNA, 440 bp, Homo sapiens
  misc_feature: GYAE6OF02GQXAA.18.39.D06.1.454.CMB.1.raw
  modified_base (226)..(226): a, c, t, g, unknown or other
  misc_feature (226)..(226): n is a, c, g, or t
  modified_base (424)..(440): a, c, t, g, unknown or other
  misc_feature (424)..(440): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagntggtcgttgtttgtttggccgtgaactactggggccagggcaccctggtcaccgtctcctcagcttccaccaagggcccatcggtcttcccctggcgccctgctccaggagcacctctgggggcacgagcggcctgggctgcctggtcaaggactacttcccatactcgtactgagcgggctggcaaggcgcatacgnnnnnnnnnnnnnnnnn

SEQ ID NO: 240970 - DNA, 176 bp, Homo sapiens; identical to SEQ ID NO: 240806
  misc_feature: GYAE6OF02ICQXJ.18.39.D06.1.454.CMB.1.raw
  modified_base (175)..(176): a, c, t, g, unknown or other
  misc_feature (175)..(176): n is a, c, g, or t

SEQ ID NO: 240971 - DNA, 175 bp, Homo sapiens; identical to SEQ ID NO: 240714
  misc_feature: GYAE6OF02GELFW.18.39.D06.1.454.CMB.1.raw
  modified_base (175)..(175): a, c, t, g, unknown or other
  misc_feature (175)..(175): n is a, c, g, or t

SEQ ID NO: 240972 - DNA, 351 bp, Homo sapiens
  misc_feature: GYAE6OF02G8XV2.18.39.D06.1.454.CMB.1.raw
  modified_base (346)..(351): a, c, t, g, unknown or other
  misc_feature (346)..(351): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggaggtgtgtcacaagatttgggctctgggcaccgtgggcatgggggaggtgtgtcacaagatttgggccagggcaccctggtcaccgtctcctcagcttccaccaagggcccatcggtcttcccctggcgccctgctccaggagcacctctggggcacagcggccctgggctgcctggtcaaggctacttcccatactcgtactgagcgggctggcaaggcgcatagnnnnnn

SEQ ID NO: 240973 - DNA, 351 bp, Homo sapiens
  misc_feature: GYAE6OF02HB47X.18.39.D06.1.454.CMB.1.raw
  modified_base (346)..(351): a, c, t, g, unknown or other
  misc_feature (346)..(351): n is a, c, g, or t
tcagtacgagtatgcacgaccggtgctcgatttagtgacatctcgcagttctttgggggaagaggaagactgacggtcctcccaggagttcaggtgctgggcaccgtgggcatggggaggtgtgtcacaagatttgggctctgggcaccgtgggcatgggggaggtgtgtcacaatatttgggccagggcaccctggtcaccgtctcctcagcttccaccaagggcccatcggtcttcccctggcgccctgctccaggagcacctccgagagcacagcggccctgggctgcctggtcaaggactacttcccatactcgtactgagcgggctggcaaggcgcatagnnnnnn

SEQ ID NO: 240974 - DNA, 186 bp, Homo sapiens
  misc_feature: GYAE6OF02IP4A4.18.39.D06.1.454.CMB.1.raw
  modified_base (181)..(186): a, c, t, g, unknown or other
  misc_feature (181)..(186): n is a, c, g, or t
tcagtacgagtatgcacgaccggtgctcgatttagtgacatctcgcagttctttgggtttgggggaagaggaagactgacggtcctcccaggagttcaggtgctgggcacagcggccctgggctgcctggtcaaggactacttcccatactcgtactgagcgggctggcaaggcgcatagnnnnnn

SEQ ID NO: 240975 - DNA, 361 bp, Homo sapiens
  misc_feature: GYAE6OF02I8O6G.18.39.D06.1.454.CMB.1.raw
  modified_base (355)..(361): a, c, t, g, unknown or other
  misc_feature (355)..(361): n is a, c, g, or t
tcagtacgagtatgcacgaccggtgctcgatttagtgacatctcgcagttctttgggttttgggggaagaggaagactgacggtcctcccaggagttcaggtgctgggcaccgtgggcatggggaggtgtgtcacaagatttgggctctgggcaccgtgggcatgggggaggtgtgtcacaagatttgggctctgggcaccctggtcaccgtctcctcagcttccaccaagggcccatcggtcttccccctggcgccctgctccaggagcacctctgggggcacagcggccctgggctgcctggtcaaggactacttcccatactcgtactgagcgggctggcaaggcgcatagnnnnnnn

SEQ ID NO: 240976 - DNA, 216 bp, Homo sapiens
  misc_feature: GYAE6OF02GIPUI.18.39.D06.1.454.CMB.1.raw
  modified_base (186)..(216): a, c, t, g, unknown or other
  misc_feature (186)..(216): n is a, c, g, or t
tcagtacgagtatgcacgaccggtgctcgatttagtgacatctcgcgagttctttagggtttcgggggaacgaggaacgactggacggtcctcccaggagttcaggtgctgggcacagcggcccgtggctgcctggtcaaggctacttcccatactcgtactgagcgggctggcaaggcgcatagnnnnnnnnnnnnnnnnnnnnnnnnnnnnnnn

SEQ ID NO: 240977 - DNA, 239 bp, Homo sapiens
  misc_feature: GYAE6OF02IEJB1.18.39.D06.1.454.CMB.1.raw
  modified_base (225)..(239): a, c, t, g, unknown or other
  misc_feature (225)..(239): n is a, c, g, or t
tcagtacgagtatgcacgaccggtgctcgatttagtgacatctcgcagttctttgggtttgggggaagaggaagactgacggtcctcccaggagttcaggtgctgggcaccgtgggcatggggaggtgtgtcacaagatttgggctctgggcacagcggccctgggctgcctggtcaaggactacttcccatactcgtactgagcgggctggcaaggcgcatagnnnnnnnnnnnnnnn

SEQ ID NO: 240978 - DNA, 186 bp, Homo sapiens; identical to SEQ ID NO: 240716
  misc_feature: GYAE6OF02I2WXL.18.39.D06.1.454.CMB.1.raw
  modified_base (183)..(186): a, c, t, g, unknown or other
  misc_feature (183)..(186): n is a, c, g, or t

SEQ ID NO: 240979 - DNA, 552 bp, Homo sapiens
  misc_feature: GYAE6OF02HYBT1.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgcgaatatgtggtgacaaagatggtcgtttgtttgttttggccggttgaacttacgtgggccagggccacccgtggtcaccgtctcctcagccttccaccaaggcccatccggtccttccccgtggccgccctcgcctccgaggcgccaccgtcgtcggggccacgcggccggcccgtgggccttcggcccgtcggtccgaacggtacctaccttcccattaccg

SEQ ID NO: 240980 - DNA, 572 bp, Homo sapiens
  misc_feature: GYAE6OF02IUFYD.18.39.D06.1.454.CMB.1.raw
  modified_base (317)..(317): a, c, t, g, unknown or other
  misc_feature (317)..(317): n is a, c, g, or t
  modified_base (351)..(351): a, c, t, g, unknown or other
  misc_feature (351)..(351): n is a, c, g, or t
  modified_base (426)..(426): a, c, t, g, unknown or other
  misc_feature (426)..(426): n is a, c, g, or t
tcagtacgagtatgcacgaccggtgctcgatttagtgacatctcgcagttctttgggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattacngtgcgagagccgcgaaatatggtggtgcaaaagngtggtacgttgttttggtttggccggttgaaccgttacgtgggccgaggggcacccgtggtcaccggtctcctcncgcttccaccgaacgggcccagtccggtccttccccgtggcccgcccgtcgcctccgacggacgccaccgtcgtcggggcaccgacgccggcccgtgggcctcggtccgtcggtaccgaacggtacctaccgttcccgagtacccg

SEQ ID NO: 240981 - DNA, 186 bp, Homo sapiens; identical to SEQ ID NO: 240716
  misc_feature: GYAE6OF02JDV8C.18.39.D06.1.454.CMB.1.raw
  modified_base (183)..(186): a, c, t, g, unknown or other
  misc_feature (183)..(186): n is a, c, g, or t

SEQ ID NO: 240982 - DNA, 185 bp, Homo sapiens
  misc_feature: GYAE6OF02F5VV3.18.39.D06.1.454.CMB.1.raw
  modified_base (176)..(185): a, c, t, g, unknown or other
  misc_feature (176)..(185): n is a, c, g, or t
tcagtacgagtatgcacgaccggtgctcgatttagtgacatctcgcgagttctttgggggaagaggaagactgacggtcctcccaggagttcaggtgctgggcacagcggccctgggctgcctggtcaaggactacttcccatactcgtactgagcgggctggcaaggcgcatagnnnnnnnnnn

SEQ ID NO: 240983 - DNA, 554 bp, Homo sapiens
  misc_feature: GYAE6OF02GFDYN.18.39.D06.1.454.CMB.1.raw
  modified_base (411)..(411): a, c, t, g, unknown or other
  misc_feature (411)..(411): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactcgtgggccagggcaccctggtcaccgtctcctcngcttccaccacggcccagtcggtccttcccctcggccgccctcgcctccacggcgccacctcgtcggggccacgacggccgggcccgtcggggcctcggcccgtcgggtccgaacgggtaccttaccgtttccccattacccg

SEQ ID NO: 240984 - DNA, 183 bp, Homo sapiens
  misc_feature: GYAE6OF02IJKUF.18.39.D06.1.454.CMB.1.raw
  modified_base (181)..(183): a, c, t, g, unknown or other
  misc_feature (181)..(183): n is a, c, g, or t
tcagtacgagtatgcacgaccggtgctcgatttagtgacatctcgcagttctttgggttttgggggaagaggaagactgacggtcctcccaggagttcaggtgctgggcacagcggccctgggctgcctggtcaaggactacttcccatactcgtactgagcggctggcaaggcgcatagnnn

SEQ ID NO: 240985 - DNA, 348 bp, Homo sapiens
  misc_feature: GYAE6OF02IP5HA.18.39.D06.1.454.CMB.1.raw
  modified_base (343)..(348): a, c, t, g, unknown or other
  misc_feature (343)..(348): n is a, c, g, or t
tcagtacgagtatgcacgaccggtgctcgatttagtgacatctcgcagttctttgggggaagaggaagactgacggtcctcccaggagttcaggtgctgggcaccgtgggcatggggaggtgtgtcacaagatttgggctctgggcaccgtgggcatgggggaggtgtgtcacaagatttgggccagggcaccctggtcaccgtctcctcagcttccaccaagggcccatcggtcttccccctggcgccctgctccaggagcacctctggggcacagcggccctggctgcctggtcaaggctacttcccatactcgtactgagcggctggcaaggcgcatagnnnnnn

SEQ ID NO: 240986 - DNA, 354 bp, Homo sapiens
  misc_feature: GYAE6OF02G7ITH.18.39.D06.1.454.CMB.1.raw
  modified_base (349)..(354): a, c, t, g, unknown or other
  misc_feature (349)..(354): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggaggtgtgtcacaagatttgggctctgggcaccgtgggcatgggggaggtgtgtcacaagatttgggccagggcaccctggtcaccgtctcctcagcttccaccaagggcccatcggtcttccccctggcgccctgctccaggagcacctctgggggcacagcggccctgggctgcctggtcaaggactacttcccatactcgtactgagcgggctggcaaggcgcatagnnnnnn

SEQ ID NO: 240987 - DNA, 433 bp, Homo sapiens
  misc_feature: GYAE6OF02IIYQ8.18.39.D06.1.454.CMB.1.raw
  modified_base (227)..(227): a, c, t, g, unknown or other
  misc_feature (227)..(227): n is a, c, g, or t
  modified_base (429)..(433): a, c, t, g, unknown or other
  misc_feature (429)..(433): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaaagntggtcgttgtttgttttggccggtgaactactggggccagggcaccctggtcaccgtctcctcagcttccaccaagggcccatcggtcttccccctggccgccctgcctccaggagcacctctgggggcacagcggccctgggctgcctggtcaaggactacttcccatactcgtactgagcgggctggcaaggcgcatagnnnnn

SEQ ID NO: 240988 - DNA, 430 bp, Homo sapiens
  misc_feature: GYAE6OF02FXOTL.18.39.D06.1.454.CMB.1.raw
  modified_base (227)..(227): a, c, t, g, unknown or other
  misc_feature (227)..(227): n is a, c, g, or t
  modified_base (427)..(430): a, c, t, g, unknown or other
  misc_feature (427)..(430): n is a, c, g, or t
tcagtacgagtatgcacgaccggtgctcgatttagtgacatctcgagtggatgggatggatgaacggtaaactgccaacacaggctatgcagaggcattccagggcagagtcaccatgaccgggaacccctccaccggcacagcctacatggagctgagcagtctgacacctgacgacacggccgtctattactgtgcgagagcccgcgaatatgtggtgcaaaagntgggtcgttgtttgttttggccggtgaactactggggccagggcacccctggtcaccgtctcctcagcttccaccaagggcccatcggtcttccccctggcgccctgctccaggagcacctccgagagcacagcggccctgggctgcctggtcaggactactcccatactcgtactgagcgggctggcaaggcgcatagnnnn

SEQ ID NO: 240989 - DNA, 521 bp, Homo sapiens
  misc_feature: GYAE6OF02IIM41.18.39.D06.1.454.CMB.1.raw
  modified_base (330)..(330): a, c, t, g, unknown or other
  misc_feature (330)..(330): n is a, c, g, or t
  modified_base (348)..(348): a, c, t, g, unknown or other
  misc_feature (348)..(348): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgngaatatgtggtgcaaagntggtcgttgtttgttttggccggtgaactctggggccagggcaccctggtcacgtctcctcagcttccaccaacgggcccatccggtcttcccctggccgccctgcctccaggcgcacctcgtggggcacgagcggccctgggcctgcctggcaaggcctacttcccataccg

SEQ ID NO: 240990 - DNA, 183 bp, Homo sapiens; identical to SEQ ID NO: 240949
  misc_feature: GYAE6OF02IZK8G.18.39.D06.1.454.CMB.1.raw
  modified_base (181)..(183): a, c, t, g, unknown or other
  misc_feature (181)..(183): n is a, c, g, or t

SEQ ID NO: 240991 - DNA, 558 bp, Homo sapiens
  misc_feature: GYAE6OF02G7C6Z.18.39.D06.1.454.CMB.1.raw
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattacngtgcgagagccgcgaatatgtggtgacaaagntggtctttgtttgttttggccggttgaacgttcgtggggccagggcacccgtggtcaccgtctcctcagcttccaccgaacggcccactccggtccttccccgtcggccgtccctcgcctccgacggacgccaccgtcgtcggggcacgacggccggcccgtcgggcctcgccgttcggtacgaacggtacctaccgttcccattaccg

SEQ ID NO: 240992 - DNA, 545 bp, Homo sapiens
  misc_feature: GYAE6OF02HSJUK.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactatgggccagggcaccctggtcaccgtctcctcagcttccaccaaggcccatcggtccttcccctggccgccctgctccaggacgcacctctggggcacgacggccggcccctggggcctcggtcccgtgggttccgaaagggtaccctaccgtttccccattaacccg

SEQ ID NO: 240993 - DNA, 183 bp, Homo sapiens; identical to SEQ ID NO: 240729
  misc_feature: GYAE6OF02HLVZF.18.39.D06.1.454.CMB.1.raw
  modified_base (182)..(183): a, c, t, g, unknown or other
  misc_feature (182)..(183): n is a, c, g, or t

SEQ ID NO: 240994 - DNA, 433 bp, Homo sapiens
  misc_feature: GYAE6OF02FF6HF.18.39.D06.1.454.CMB.1.raw
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (425)..(433): a, c, t, g, unknown or other
  misc_feature (425)..(433): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctatactgtgcgagagcccgngaatatgtggtgcaaaagntggtcgttgtttgtttggccggtgaactactggggccagggcaccctggtcaccgtctcctcagcttccaccaagggcccatcggtcttccccctggcgccctgctccaggagcacctctgggggcacgagcggcctgggctgcctggtcaaggactacttcccatactcgtactgagcgggctggcaaggcgcatagnnnnnnnnn

SEQ ID NO: 240995 - DNA, 223 bp, Homo sapiens
  misc_feature: GYAE6OF02HTUOT.18.39.D06.1.454.CMB.1.raw
  modified_base (221)..(223): a, c, t, g, unknown or other
  misc_feature (221)..(223): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnnn

SEQ ID NO: 240996 - DNA, 549 bp, Homo sapiens
  misc_feature: GYAE6OF02GDKOC.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggcagggcaccctggtcaccgtctcctcagcttccaccaagggcccatcggtcttcccctggccgccctgcctccacggacgcacctccgtcgggggccacgacgccggcccctcggggcctcggcccgttcgggtccgaacgggacctaccgttccccattaacccg

SEQ ID NO: 240997 - DNA, 568 bp, Homo sapiens
  misc_feature: GYAE6OF02HLBCZ.18.39.D06.1.454.CMB.1.raw
  modified_base (361)..(361): a, c, t, g, unknown or other
  misc_feature (361)..(361): n is a, c, g, or t
  modified_base (390)..(390): a, c, t, g, unknown or other
  misc_feature (390)..(390): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
  modified_base (537)..(537): a, c, t, g, unknown or other
  misc_feature (537)..(537): n is a, c, g, or t
  modified_base (543)..(543): a, c, t, g, unknown or other
  misc_feature (543)..(543): n is a, c, g, or t
  modified_base (546)..(549): a, c, t, g, unknown or other
  misc_feature (546)..(549): n is a, c, g, or t
  modified_base (551)..(552): a, c, t, g, unknown or other
  misc_feature (551)..(552): n is a, c, g, or t
  modified_base (554)..(560): a, c, t, g, unknown or other
  misc_feature (554)..(560): n is a, c, g, or t
  modified_base (562)..(562): a, c, t, g, unknown or other
  misc_feature (562)..(562): n is a, c, g, or t
  modified_base (564)..(568): a, c, t, g, unknown or other
  misc_feature (564)..(568): n is a, c, g, or t
tcagtacgagtatgcacgaccggtgctcgatttagtgacatctcgaggtggatgggatggagtgaacggtaaactgccaacacaggctatgcagaggcagttccaggctagagtcgaccatcgaccggggaaccctcaccggcacacgccgtacatggagctgagcagtctggacaccctgacgacacggtccgtctagttactgtcgacgagtagccgcgaatatcgtaggtgacaaaagtattgggttgttgtttgttttggaccggtagaaactacgtggggccagggccacctggtcaccggtctaccgtcagtccttccaaccgaacgggccacgttcggtaccttttcccccggnggcccgccgtcgccgtaccggacgggacnccgtaccgtcggtcggggacacgacggccggtccggtgggcgtcgccggttcggtacgaacggtaccttaccgtaccgtattcgtcgtacgtaggtcggcgggtcgtggaccgaagggtcgtacgtaatgtacncntcgcnacgatnacagcncgnnnngnngnnnnnnncncnnnnn

SEQ ID NO: 240998 - DNA, 453 bp, Homo sapiens
  misc_feature: GYAE6OF02IY11O.18.39.D06.1.454.CMB.1.raw
  modified_base (231)..(231): a, c, t, g, unknown or other
  misc_feature (231)..(231): n is a, c, g, or t
  modified_base (431)..(453): a, c, t, g, unknown or other
  misc_feature (431)..(453): n is a, c, g, or t
tcagtacgagtatgcacgaccggtgctcgatttagtgacatctcgagtgggatgggatggatgaacggtaaaactgccaacacaggctatgcagaggcattccaggggcagagtcaccatgaccggggaacccctccaccggcacagcctacatggagctgagcagtctgacacctgacgacacggccgtctattacctgtgcgagagccgcgaatatgtggtgcaaaagntggtcttgtttgtttggccggtgaactactggggccagggcaccctggtcaccgtctcctcagcttccaccaagggcccatcggtctccccctggcgccctgctccaggacgcacctctgggggcacagcggccctgggctgccctggcaaggactaccttcccatactcgtactgagcgggctggcaaggcgcatagcnnnnnnnnnnnnnnnnnnnnnnn

SEQ ID NO: 240999 - DNA, 432 bp, Homo sapiens
  misc_feature: GYAE6OF02I2V6C.18.39.D06.1.454.CMB.1.raw
  modified_base (226)..(226): a, c, t, g, unknown or other
  misc_feature (226)..(226): n is a, c, g, or t
  modified_base (417)..(417): a, c, t, g, unknown or other
  misc_feature (417)..(417): n is a, c, g, or t
  modified_base (422)..(432): a, c, t, g, unknown or other
  misc_feature (422)..(432): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagntggtcgttgtttgtttggccggtgaactactggggccagggcaccctggtcaccgtctcctcagcttccaccaagggcccatcggtctcccctggcgccctgctccaggagcacctctgggggcacagcggccctgggctgcctggtcaaggactacgttcccatactcgtactgagcgggctggcaggcnatagnnnnnnnnnnn

SEQ ID NO: 241000 - DNA, 184 bp, Homo sapiens; identical to SEQ ID NO: 240742
  misc_feature: GYAE6OF02GM7H6.18.39.D06.1.454.CMB.1.raw
  modified_base (182)..(184): a, c, t, g, unknown or other
  misc_feature (182)..(184): n is a, c, g, or t

SEQ ID NO: 241001 - DNA, 186 bp, Homo sapiens; identical to SEQ ID NO: 240716
  misc_feature: GYAE6OF02HLNDN.18.39.D06.1.454.CMB.1.raw
  modified_base (183)..(186): a, c, t, g, unknown or other
  misc_feature (183)..(186): n is a, c, g, or t

SEQ ID NO: 241002 - DNA, 432 bp, Homo sapiens
  misc_feature: GYAE6OF02GAFCB.18.39.D06.1.454.CMB.1.raw
  modified_base (228)..(228): a, c, t, g, unknown or other
  misc_feature (228)..(228): n is a, c, g, or t
  modified_base (425)..(432): a, c, t, g, unknown or other
  misc_feature (425)..(432): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagcccgcgaatatgtggtgcaaaagntggtcgttgtttgtttggccggtgaactactggggccagggcaccctggtcaccgtctcctcagcttccaccaaggcccatcggtcttcccctggcgccctgctccaggagcacctctgggggcacagcggccctgggctgcctggtcaaggactacttcccatactcgtactgagcgggctggcaaggcgcatagnnnnnnnn

SEQ ID NO: 241003 - DNA, 430 bp, Homo sapiens
  misc_feature: GYAE6OF02HNL9D.18.39.D06.1.454.CMB.1.raw
  modified_base (227)..(227): a, c, t, g, unknown or other
  misc_feature (227)..(227): n is a, c, g, or t
  modified_base (339)..(339): a, c, t, g, unknown or other
  misc_feature (339)..(339): n is a, c, g, or t
  modified_base (425)..(430): a, c, t, g, unknown or other
  misc_feature (425)..(430): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaaagntggtcgtttgtttgtttggccggtgaatactggggccagggcaccctggtcaccgtctcctcagcttccaccaagggcccatcggtcttcccctggcgccctgctccaggancacctctggggcacagcggccctgggctgcctggtcaaggactacgttcccatactcgtactgagcgggctggcaaggcgcatagnnnnnn

SEQ ID NO: 241004 - DNA, 532 bp, Homo sapiens
  misc_feature: GYAE6OF02HHRSG.18.39.D06.1.454.CMB.1.raw
  modified_base (449)..(449): a, c, t, g, unknown or other
  misc_feature (449)..(449): n is a, c, g, or t
  modified_base (470)..(470): a, c, t, g, unknown or other
  misc_feature (470)..(470): n is a, c, g, or t
  modified_base (488)..(488): a, c, t, g, unknown or other
  misc_feature (488)..(488): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactacgtggggccagggcacccgtggtccaccgtctcctcagcttccaccgaacgggcccatccggtcttccccnggccgccctgcctccgaggcncacctccgagacgcacgngccggccctgggcctggcctggtccgaaggccttactccctaac

SEQ ID NO: 241005 - DNA, 431 bp, Homo sapiens
  misc_feature: GYAE6OF02F3VOS.18.39.D06.1.454.CMB.1.raw
  modified_base (207)..(207): a, c, t, g, unknown or other
  misc_feature (207)..(207): n is a, c, g, or t
  modified_base (426)..(431): a, c, t, g, unknown or other
  misc_feature (426)..(431): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggcctctattactgtgcgagagccgngaaatatgtggtgcaaagatggtcgttgtttgtttggccggtgaactactggggccagggcaccctggtcaccgtctcctcagcttccaccaagggcccatcggtcttccccctggcgccctgcctccaggagcacctctgggggcacagcggccctgggctgcctggtcaaggactacttcccatactcgtactgagcgggctggcaaggcgcatagnnnnnn

SEQ ID NO: 241006 - DNA, 185 bp, Homo sapiens
  misc_feature: GYAE6OF02GWQG4.18.39.D06.1.454.CMB.1.raw
  modified_base (181)..(185): a, c, t, g, unknown or other
  misc_feature (181)..(185): n is a, c, g, or t
tcagtacgagtatgcacgaccggtgctcgatttagtgacatctcgcagttctttgggtttgggggaagaggaagactgacggtcctcccaggagttcaggtgctgggcacagcggccctgggctgcctggtcaaggactacttcccatactcgtactgagcgggctggcaaggcgcatagnnnnn

SEQ ID NO: 241007 - DNA, 185 bp, Homo sapiens
  misc_feature: GYAE6OF02JCM6Q.18.39.D06.1.454.CMB.1.raw
  modified_base (182)..(185): a, c, t, g, unknown or other
  misc_feature (182)..(185): n is a, c, g, or t
tcagtacgagtatgcacgaccggtgctcgatttagtgacatctcgcagttctttgggttttgggggaagaggaagactgacggtcctcccaggagttcaggtgctgggcacagcggccctgggctgcctggtcaaggactacttcccatactcgtactgagcgggctggcaaggcgcatagnnnn

SEQ ID NO: 241008 - DNA, 364 bp, Homo sapiens
  misc_feature: GYAE6OF02GU116.18.39.D06.1.454.CMB.1.raw
  modified_base (359)..(364): a, c, t, g, unknown or other
  misc_feature (359)..(364): n is a, c, g, or t
tcagtacgagtatgcacgaccggtgctcgatttagtgacatctcgcgagttctttgggttttgggggaagtaggaagactgacggtcctcccaggagttcaggtgctgggcaccgtgggctatggggaggtgtgtcacaagatttgggctctgggcaccgtgggcatgggggaggtgtgtcacaagaatttgggctctgggcaccctggtcaccgtctcctcagcttccaccaagggcccatcggtcttccccctggcgccctgctccaggagcacctctgggggcacagcggccctggactgcctggtcaaggactacttcccatactcgtactgagcgggctggcaaggcgcatagnnnnnn

SEQ ID NO: 241009 - DNA, 183 bp, Homo sapiens; identical to SEQ ID NO: 240729
  misc_feature: GYAE6OF02FLW7X.18.39.D06.1.454.CMB.1.raw
  modified_base (182)..(183): a, c, t, g, unknown or other
  misc_feature (182)..(183): n is a, c, g, or t

SEQ ID NO: 241010 - DNA, 430 bp, Homo sapiens
  misc_feature: GYAE6OF02HN2F8.18.39.D06.1.454.CMB.1.raw
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (336)..(336): a, c, t, g, unknown or other
  misc_feature (336)..(336): n is a, c, g, or t
  modified_base (423)..(430): a, c, t, g, unknown or other
  misc_feature (423)..(430): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgcgaatatgtggtncaaagntggtcgttgtttgtttggccggtgaactactggggccagggcaccctggtcaccgtctcctcagcttccaccaagggcccatcggtcttcccctggcgccctgctccaggngcacctctgggggcacagcggccctgggctgcctggtcaaggactacttcccatactcgtactgagcgggctggcaaggcgcatagnnnnnnnn

SEQ ID NO: 241011 - DNA, 434 bp, Homo sapiens
  misc_feature: GYAE6OF02H7P8B.18.39.D06.1.454.CMB.1.raw
  modified_base (80)..(80): a, c, t, g, unknown or other
  misc_feature (80)..(80): n is a, c, g, or t
  modified_base (228)..(228): a, c, t, g, unknown or other
  misc_feature (228)..(228): n is a, c, g, or t
  modified_base (334)..(334): a, c, t, g, unknown or other
  misc_feature (334)..(334): n is a, c, g, or t
  modified_base (421)..(434): a, c, t, g, unknown or other
  misc_feature (421)..(434): n is a, c, g, or t
tcagtacgagtatgcacgaccggtgctcgatttagtgacatctcgagtggatgggatggatgaacggtaaaactgccaanacaggctatgcagaggcattccagggcagagtcaccatgaccgggaacccctccgccggcacagcctacatggagctgagcagtctgacacctgacgcacggccgtctatttactgtgcgagagccgcgaaatatgtggtgcaaaagntggtcgttgtttgtttggtcggtgatactggggccagggcacctggtcaccgtctcctcagcttccaccaagggcccatcggtcttcccctggcgccctgctcagngcacctctggggcacagcggccctggggctgcctggtcaaggactacttcccatactcgtactgagcgggctggcaaggcgcatagnnnnnnnnnnnnnn

SEQ ID NO: 241012 - DNA, 187 bp, Homo sapiens; identical to SEQ ID NO: 240763
  misc_feature: GYAE6OF02FX33H.18.39.D06.1.454.CMB.1.raw
  modified_base (183)..(187): a, c, t, g, unknown or other
  misc_feature (183)..(187): n is a, c, g, or t

SEQ ID NO: 241013 - DNA, 192 bp, Homo sapiens
  misc_feature: GYAE6OF02IV870.18.39.D06.1.454.CMB.1.raw
  modified_base (183)..(192): a, c, t, g, unknown or other
  misc_feature (183)..(192): n is a, c, g, or t
tcagtacgagtatgcacgaccggtgctcgatttagtgacatctcgcagttctttgggctctgggcaccgtgggcatgggggaggtgtgtcacaagatttgggctctgggcacagcggccctgggctgcctggtcaaggactacttcccatactcgtactgagcgggctggcaaggcgcatagnnnnnnnnnn

SEQ ID NO: 241014 - DNA, 435 bp, Homo sapiens
  misc_feature: GYAE6OF02IWLZV.18.39.D06.1.454.CMB.1.raw
  modified_base (226)..(226): a, c, t, g, unknown or other
  misc_feature (226)..(226): n is a, c, g, or t
  modified_base (340)..(340): a, c, t, g, unknown or other
  misc_feature (340)..(340): n is a, c, g, or t
  modified_base (421)..(421): a, c, t, g, unknown or other
  misc_feature (421)..(421): n is a, c, g, or t
  modified_base (426)..(435): a, c, t, g, unknown or other
  misc_feature (426)..(435): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagntggtcgttgtttgtttggccggtgaactactggggccaggggcacccctggtcaccgtctcctcagcttccaccaagggcccatcggtcttccccctggcgccctgctccaggngcacctctgggggcacagcggcctgggctgcctggtcaaggctacttccccatacctcgtactgagcgggctggcaggcgnatagnnnnnnnnnn

SEQ ID NO: 241015 - DNA, 504 bp, Homo sapiens
  misc_feature: GYAE6OF02G2SJH.18.39.D06.1.454.CMB.1.raw
  modified_base (208)..(208): a, c, t, g, unknown or other
  misc_feature (208)..(208): n is a, c, g, or t
  modified_base (233)..(233): a, c, t, g, unknown or other
  misc_feature (233)..(233): n is a, c, g, or t
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (471)..(471): a, c, t, g, unknown or other
  misc_feature (471)..(471): n is a, c, g, or t
  modified_base (475)..(504): a, c, t, g, unknown or other
  misc_feature (475)..(504): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgngaattatggtgggtgacaaaaaggnttggggttcttggttttgttttggtccggtgaactacgtggggccagggcaccctggtcaccgtctcctcagcttccaccgaagggcccatccggtccttcccctggccnccctgctccaggacncacctcgngggggcacgacggccggcccgtggggctcgccttcggtcaacgggacctaccttcccattacctccgtactggacgccgggtctgggaccaagggccgcgatagngtcnnnnnnnnnnnnnnnnnnnnnnnnnnnnnn

SEQ ID NO: 241016 - DNA, 428 bp, Homo sapiens
  misc_feature: GYAE6OF02IXHC8.18.39.D06.1.454.CMB.1.raw
  modified_base (420)..(428): a, c, t, g, unknown or other
  misc_feature (420)..(428): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcacccctggtcaccgtctcctcagcttccaccaagggcccatcggtcttcccctggcgccctgctccaggagcactctggggcacagcggcctgggctgcctggtcaagctacttcccatactcgtactgagcgggctggcaaggcgcatagnnnnnnnnn

SEQ ID NO: 241017 - DNA, 148 bp, Homo sapiens
  misc_feature: GYAE6OF02GPJLN.18.39.D06.1.454.CMB.1.raw
  modified_base (147)..(148): a, c, t, g, unknown or other
  misc_feature (147)..(148): n is a, c, g, or t
tcagtacgagtatgcacgaccggtgctcgatttagtgacatctcgcagttctttgggctctgggcaccgtgggcacagcggccctgggctgcctggtcaaggactacttcccatactcgtactgagcgggctggcaaggcgcatagnn

SEQ ID NO: 241018 - DNA, 441 bp, Homo sapiens
  misc_feature: GYAE6OF02G6S6J.18.39.D06.1.454.CMB.1.raw
  modified_base (228)..(228): a, c, t, g, unknown or other
  misc_feature (228)..(228): n is a, c, g, or t
  modified_base (329)..(329): a, c, t, g, unknown or other
  misc_feature (329)..(329): n is a, c, g, or t
  modified_base (422)..(422): a, c, t, g, unknown or other
  misc_feature (422)..(422): n is a, c, g, or t
  modified_base (428)..(441): a, c, t, g, unknown or other
  misc_feature (428)..(441): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaattatgtggtgcaaaagntggtcgttgttttgttttggccggtgaactactggggccagggcaccctggtcaccgtctcctcagcttccaccaagggcccatccggtctccccctggcnccctgcctccaggagcacctcgtggggcacagcggcctgggctgcctggtcaagggctactcccatactcgtactgagcgggctggcaaggcncatagnnnnnnnnnnnnnn

SEQ ID NO: 241019 - DNA, 361 bp, Homo sapiens
  misc_feature: GYAE6OF02F4D58.18.39.D06.1.454.CMB.1.raw
  modified_base (353)..(361): a, c, t, g, unknown or other
  misc_feature (353)..(361): n is a, c, g, or t
tcagtacgagtatgcacgaccggtgctcgatttagtgacatctcgcagttctttgggttttgggggaagaggaagactgacggtcctcccaggagttcaggtgctgggcactgtgggcatggggaggtgtgtcacaagatttgggctctgggcaccgtgggcatgggggaggtgtgtcacaagatttgggctctgggcaccctggtcaccgtctcctcagcttccaccaagggcccatcggtcttccccctggcgccctgctccaggacgcacctctgggggcacagcggccctgggctgcctggtcaggctactcccatactcgtactgagcgggctggcaaggcgcatagnnnnnnnnn

SEQ ID NO: 241020 - DNA, 434 bp, Homo sapiens
  misc_feature: GYAE6OF02JHH2L.18.39.D06.1.454.CMB.1.raw
  modified_base (229)..(229): a, c, t, g, unknown or other
  misc_feature (229)..(229): n is a, c, g, or t
  modified_base (418)..(418): a, c, t, g, unknown or other
  misc_feature (418)..(418): n is a, c, g, or t
  modified_base (424)..(434): a, c, t, g, unknown or other
  misc_feature (424)..(434): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaaatatggtggtgcaaaagntgggtcgttgttttgttttggccggtgaactactggggccagggcaccctggtcaccgtctcctcagcttccacaaggcccatcggtcttcccctggccaccctcctccaagagcacctcgtgggggcacagcggcctgggctgcctggcaaggctactcccatctcgactgagcgggctggcaaggcncatagnnnnnnnnnnn

SEQ ID NO: 241021 - DNA, 184 bp, Homo sapiens
  misc_feature: GYAE6OF02IID9X.18.39.D06.1.454.CMB.1.raw
  modified_base (181)..(184): a, c, t, g, unknown or other
  misc_feature (181)..(184): n is a, c, g, or t
tcagtacgagtatgcacgaccggtgctcgatttagtgacatctcgcagttctttgggtttgggggaagaggaagactgacggtcctcccaggagttcaggtgctgggcacagcggccctgggctgcctggtcaaggactacttcccatactcgtactgagcgggctggcaaggcgcatagnnnn

SEQ ID NO: 241022 - DNA, 541 bp, Homo sapiens
  misc_feature: GYAE6OF02JT6JM.18.39.D06.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (327)..(327): a, c, t, g, unknown or other
  misc_feature (327)..(327): n is a, c, g, or t
  modified_base (508)..(508): a, c, t, g, unknown or other
  misc_feature (508)..(508): n is a, c, g, or t
  modified_base (510)..(541): a, c, t, g, unknown or other
  misc_feature (510)..(541): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattacngtgcgagagccgcgaatatgtggtncaaaagntggtcgttgtttgttttggccgtgaactacgtggggccagggcacccgtggtcaccgtctcctcagcttccaccaagggcccatccggtccttcccccgnggccgccctgcctccaggtacgccacccgtcgtcgggggctacgaggccggcccgtggggccttcgggcccgttcgggtaccgaaacgggtaccttaaccgtttcccccaagttacccgttccggtaacttcggaacggtccgggggcttcggggacccgaagggccgacgaattacgggngnnnnnnnnnnnnnnnnnnnnnnnnnnnnnnnn

SEQ ID NO: 241023 - DNA, 568 bp, Homo sapiens
  misc_feature: GYAE6OF02HC0J5.18.39.D06.1.454.CMB.1.raw
  modified_base (153)..(153): a, c, t, g, unknown or other
  misc_feature (153)..(153): n is a, c, g, or t
  modified_base (193)..(193): a, c, t, g, unknown or other
  misc_feature (193)..(193): n is a, c, g, or t
  modified_base (226)..(226): a, c, t, g, unknown or other
  misc_feature (226)..(226): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
  modified_base (508)..(508): a, c, t, g, unknown or other
  misc_feature (508)..(508): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaaccctcaccggcacagcctacatgganctgagcagtctgacacctgacgacacggccgtctattacngtgcgagagccgcgaatatgtggtgacaaaagntggtcgttgttgtttggccggtgaactatggggccagggcacccgtggtccaccgtctcctcacgcttccaccgaagggccctagtccggtccttcccccgtaggccgcccctggcctaccgaggacgccgaaccgtcgtgggggcctaacgtacggccggccctggggcctcggccctggtccgaaacggtccttaccgttcccaattaccgtcgtaacctggacgcgggtactgggccgaaagggtccgtacgacgttaggcncgtngcngtcncgcacngcgtgacgngtccngtcgngtcgacgtcgacgtcgtacgcgtacgctcgacgtatcgacg

SEQ ID NO: 241024 - DNA, 559 bp, Homo sapiens
  misc_feature: GYAE6OF02FSW8K.18.39.D06.1.454.CMB.1.raw
  modified_base (346)..(346): a, c, t, g, unknown or other
  misc_feature (346)..(346): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatcgaccggaacccctccaccggcacagcctacatggagctgagcagtctgacactgacgacacggccgtctatactgtgcgagagccgcgaatatgtggtgcaaagntggtcgttgtttgttttggccggtgaactcgtgggccagggcacccgtggtcaccgtctcctcagcttccaccaacggcccatccggtccttcccctggccgcccgtgcctccaggacgccaccgtcgtcggggccaccgacggccggcccgtcggggccttcggcccgttcggtccgaaacgggtaccctacccgtttccccgacttacccg

SEQ ID NO: 241025 - DNA, 574 bp, Homo sapiens
  misc_feature: GYAE6OF02HGC1N.18.39.D06.1.454.CMB.1.raw
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaaacggtaaaactgccaacacaggctatgcagaggcattccagggcagagtcaccatcgaccgggaacccctccaccggcacagcctacatggagctgagcagtctgacacctgacgacacggccgtctattactgtgcgagagccgcgaatagtgtggtncgaaaagntgggtcgtttgttttgttttgggccggtgtaacgtacgtggggccagggcacccgtggtccaccgtctcctcacgccttccaccgaacggcccagtccggtccttccccgtggcccgtccctcgcctcccgaggacgccacccgtcgcggggccacgacggccggtcccgtgggcctcggcccgtggtaccaacgggtaccttaccgttcccagttacccg

SEQ ID NO: 241026 - DNA, 589 bp, Homo sapiens
  misc_feature: GYAE6OF02I1KRQ.18.39.D06.1.454.CMB.1.raw
  modified_base (277)..(277): a, c, t, g, unknown or other
  misc_feature (277)..(277): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatgganctgaacagtctgacacctgacgacacggccgtctattacgtgtgcgagacgccgacgaatatgtggtgacaaagagttggttcgtttagtttgttttcggccggttagaacgtcgtggggccagggcacccgtggtccaccgtctcctcacgtccttccaccgacgggccctacgtccggtcccttccccgtggcccgtccctcgcctccgacggcgccaccgtcggtcggggccacgacggccgggtcccgtggggcctcggcccgttacggaccgtaacggtaccttaccgttccccagttacctaccgg

SEQ ID NO: 241027 - DNA, 507 bp, Homo sapiens
  misc_feature: GYAE6OF02IEAW6.18.39.D06.1.454.CMB.1.raw
  modified_base (227)..(227): a, c, t, g, unknown or other
  misc_feature (227)..(227): n is a, c, g, or t
  modified_base (491)..(507): a, c, t, g, unknown or other
  misc_feature (491)..(507): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgacaaagntggtcgtttgtttgttttggccggtgaactactggggccagggcacccgtggtcaccgtctcctcagcttccaccaagggcccatccgtcttccccctgccgccctgcctccgacggcgcacctcgtcgggggcaccgaggccgggcccgtggggcctcggcccgttgggtaccgaacgggtaccttaccgtttacccaacgttaccttccggttaaccgtggaacgggccggggctgggaccgaaagggtccgacagttacgnnnnnnnnnnnnnnnnn

SEQ ID NO: 241028 - DNA, 428 bp, Homo sapiens
  misc_feature: GYAE6OF02FL2PI.18.39.D06.1.454.CMB.1.raw
  modified_base (425)..(428): a, c, t, g, unknown or other
  misc_feature (425)..(428): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttccccctggcgccctgctccaggagcacctctgggggcacagcggccctgggctgcctggtcaaggactacttcccatactcgtactgagcgggctggcaaggcgcatagnnnn

SEQ ID NO: 241029 - DNA, 490 bp, Homo sapiens
  misc_feature: GYAE6OF02IJ51T.18.39.D06.1.454.CMB.1.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (296)..(296): a, c, t, g, unknown or other
  misc_feature (296)..(296): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (438)..(438): a, c, t, g, unknown or other
  misc_feature (438)..(438): n is a, c, g, or t
  modified_base (458)..(490): a, c, t, g, unknown or other
  misc_feature (458)..(490): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggcctctattactgtgcgagagccgngtaatatgtggngacaaaaggntcggtgtttgttttgttttaggccggtgaaactcgtggggccagggccacccgtggttccaccgtcnccgtcagcttccacaggcccatcgcttacccctgcgcctgctcgaggcncacctgnggggcaacngtcggccctgggcttacgccgtggtacgaacgtactaccgtttcccaattacgtctacgtaggcggacgggttccgnggacgacggccgtactagtnnnnnnnnnnnnnnnnnnnnnnnnnnnnnnnnn

SEQ ID NO: 241030 - DNA, 446 bp, Homo sapiens
  misc_feature: GYAE6OF02HFBDE.18.39.D06.1.454.CMB.1.raw
  modified_base (228)..(228): a, c, t, g, unknown or other
  misc_feature (228)..(228): n is a, c, g, or t
  modified_base (437)..(446): a, c, t, g, unknown or other
  misc_feature (437)..(446): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaaatatgtggtgcaaaagntggtcgttgtttgttttggccggtgaactactggggccagggcaccctggtcaccgtctcctcagcttccaccaagggcccatcggtcttcccctggcgccctgctccaggagcacctcgtgggggcacagcggccctggggctgcctggtcaacggactaccttcccataacctcgtacctggagcgggctgggcaagggcgcatagnnnnnnnnnn

SEQ ID NO: 241031 - DNA, 562 bp, Homo sapiens
  misc_feature: GYAE6OF02JC588.18.39.D06.1.454.CMB.1.raw
  modified_base (229)..(229): a, c, t, g, unknown or other
  misc_feature (229)..(229): n is a, c, g, or t
  modified_base (341)..(341): a, c, t, g, unknown or other
  misc_feature (341)..(341): n is a, c, g, or t
  modified_base (530)..(531): a, c, t, g, unknown or other
  misc_feature (530)..(531): n is a, c, g, or t
  modified_base (535)..(536): a, c, t, g, unknown or other
  misc_feature (535)..(536): n is a, c, g, or t
  modified_base (538)..(562): a, c, t, g, unknown or other
  misc_feature (538)..(562): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgacgaatatggtggtgacaaaagntggttcgtttgttttgttttggccggtgaactacgtggggccagggcaccccgtggtccaccgtctcctcacgccctccaccgaacgggcccagtccggtcccttcccccgnggcccgtcccctgcctaccgagggacgccacccgtccgaagagccacgacggccggcccgtggggccctcggcccgttgggtaccgaaacgggtacccttacccgtttaccccgaattacccgttacggttaactcgggacgggccggggtcgtacgggaccgtaaagggccgtacgaattaggctagnngacnngnnnnnnnnnnnnnnnnnnnnnnnnn

SEQ ID NO: 241032 - DNA, 502 bp, Homo sapiens
  misc_feature: GYAE6OF02HFBGA.18.39.D06.1.454.CMB.1.raw
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (486)..(502): a, c, t, g, unknown or other
  misc_feature (486)..(502): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccgacacagcctacatggagctgagcagtctgacacctgacgacacggccgtctattactgtgcgagagccgngaatatgtggtgcaaaagntggtcgttgtttgtttggccggtgaactacgtggggccaggcacctggtcaccgtctcctcagccttccaccgaacggcccagtccggtccttcccccgtgggcccgccctcgcctcccgaggacgccaccctcggtcgggggaccacgacggccggcccgtgggcctcggcccgtggtacaacggtaccttaccttccccagttaccgtcgttaacgtggacggccggggtctcgggacaacgggccgacaagtacgnnnnnnnnnnnnnnnnn

SEQ ID NO: 241033 - DNA, 541 bp, Homo sapiens
  misc_feature: GYAE6OF02G8MRO.18.39.D06.1.454.CMB.1.raw
  modified_base (506)..(506): a, c, t, g, unknown or other
  misc_feature (506)..(506): n is a, c, g, or t
  modified_base (513)..(515): a, c, t, g, unknown or other
  misc_feature (513)..(515): n is a, c, g, or t
  modified_base (517)..(541): a, c, t, g, unknown or other
  misc_feature (517)..(541): n is a, c, g, or t
tcagtacgagtatgcacgaccggtgctcgatttagtgacatctcgagtggatgggatggatgaaacggtaaaactgccaacacaggctatgcagaggcattccagggcagagtcaccatgaccgggaacccctcaccggcacagcctacatggagctgagcagtctgacacctgacgacacggccgtctattactgtgcgagagccgcgaatatgtggtgcaaaagtggtcgttgtttgttttggcggtgaactactggggccaggcaccctggtcaccgtctcctcagccttccaccaacgggcccatccggtccttcccccgtggccgcccctcgcctccgaggacgccacccgtcgtcgggggcaccgacgccggcccgtggggcctcggccgtcgggtcgaaacgggtaccttaaccgttccccgaacttaaccgttcggtaaccgttcggacgggtccggggacgttcggggaccgaaagggacccgtcgtaacgtacggntgcagcnnngnnnnnnnnnnnnnnnnnnnnnnnnn

SEQ ID NO: 241034 - DNA, 721 bp, Homo sapiens
  misc_feature: GYAE6OF02IWWBU.18.39.D06.1.454.CMB.1.raw
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (322)..(322): a, c, t, g, unknown or other
  misc_feature (322)..(322): n is a, c, g, or t
  modified_base (360)..(360): a, c, t, g, unknown or other
  misc_feature (360)..(360): n is a, c, g, or t
tcagtacgagtatgcacgaccggtgctcgatttagtgacatctcgcagttctttgggctgaggtgaagaaccctggggcctcagtgaaggtctcctgtcagacctatggattccccttccagaattttgatatccattgggtgcgacaggccagtggacaagggctcgagtggatgggatggatgaacggtaaaaactgccaacacaggctatgcagaggcattccagggcagagtcaccatgaccgggaacccctccaaccggcacagcctacactgganctgagcagtcngacacctgacgacacggccgtctagttacngtgcgagacgtccgcgaaatatcgtggtgacgaaaagnttgggtacgttttgtttcggttttcgggccggttagtaaacgtcgtcgggggtcccaaggggccgtaacccgttcgggttccaacccggttccgttaccgtccgtaaccggtcctttacccgaacccgtaaccggggacccctacggttccggtacccttcccccgtgggtaccccgtcccccgtttgccccgtacccgttaacggggaccgtaccgtaaccccgttccgggttacggggaccctaccgaaccggggtccccggtcccccggtgggggtaacccgttccggtcccgggtttaccggaccggtaaaaccgggtcccggttttaacccttacccccgtaagtttaacccccgg

SEQ ID NO: 241035 - DNA, 602 bp, Homo sapiens
  misc_feature: GYAE6OF02GKB0K.18.39.D06.1.454.CMB.1.raw
  modified_base (320)..(320): a, c, t, g, unknown or other
  misc_feature (320)..(320): n is a, c, g, or t
  modified_base (418)..(418): a, c, t, g, unknown or other
  misc_feature (418)..(418): n is a, c, g, or t
  modified_base (506)..(506): a, c, t, g, unknown or other
  misc_feature (506)..(506): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccgagggcagagtcaccatcggacccggaacccctccaccggcacagcctacatggagctgagcagtctgacacctgacgacacggccgtctattacngtgcgagacgccgcgaatatgtggtgacaaagagtggttcgtttgttttggtttggccggtagaacgtcgtcggggccagggccacccgtggtacccnccgttctcctcgacgtccttacccaccgaacgggccctaacgtccggttcccttccccgtcggcccgtcccctcgcctccgacggacnccgtaccgtcggtcggggaccacgacggtcccggccggtcgggcctcggtccgtcgggtaccaacgggtacccttaccgttaccccgattacccgg

SEQ ID NO: 241036 - DNA, 433 bp, Homo sapiens
  misc_feature: GYAE6OF02FURJE.18.39.D06.1.454.CMB.1.raw
  modified_base (227)..(227): a, c, t, g, unknown or other
  misc_feature (227)..(227): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
  modified_base (424)..(433): a, c, t, g, unknown or other
  misc_feature (424)..(433): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagcccgcgaatatgtggtgcaaaagntggtcgtttgtttgtttggccggtgaactactggggccagggcacctggtcaccgtctcctcagcttccaccaggcccatcggtcttcccctggcnccctgctccaggngcacctcgtgggggcacagcggccctgggctgcctggtcaaggctacttcccatactcgtactgacgcgggctggcaaggcgcatagnnnnnnnnnn

SEQ ID NO: 241037 - DNA, 356 bp, Homo sapiens
  misc_feature: GYAE6OF02HEBG3.18.39.D06.1.454.CMB.1.raw
  modified_base (346)..(356): a, c, t, g, unknown or other
  misc_feature (346)..(356): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggaggtgtgtcacaagatttgggctctgggcaccgtgggcatgggggaggtgtgtcacaagatttgggccagggcaccctggtcaccgtctcctcagcttccaccaagggcccatcggtcttccccctggcgccctgctccaggagcacctctggggcacagcggccctggctgcctggtcaaggactacttcccatactcgtactgagcggctggcaaggcgcatagnnnnnnnnnnn

SEQ ID NO: 241038 - DNA, 534 bp, Homo sapiens
  misc_feature: GYAE6OF02IVMFH.18.39.D06.1.454.CMB.1.raw
  modified_base (202)..(202): a, c, t, g, unknown or other
  misc_feature (202)..(202): n is a, c, g, or t
  modified_base (368)..(368): a, c, t, g, unknown or other
  misc_feature (368)..(368): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (503)..(504): a, c, t, g, unknown or other
  misc_feature (503)..(504): n is a, c, g, or t
  modified_base (508)..(534): a, c, t, g, unknown or other
  misc_feature (508)..(534): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagngccgagaatatggtggtgcaaaagtgtggttcgtttgttttggtttggccggtgaacgtcgtggggccagggcacccgtggtccaccgtcctcctcacgccttccaccgaacgggcccagtccggttcccttccccgtcggcccgccctcgcccgtccgacggacnccgtaccctcgggtcgggggccacgacggccggcccgtcggggctcgtccgtacggtacgaacggtacttacccttacccacgttacctccgttacgtggacggtacggcgtcggacgaaggcgagagtgngnanncgannnnnnnnnnnnnnnnnnnnnnnnnnn

SEQ ID NO: 241039 - DNA, 790 bp, Homo sapiens
  misc_feature: GYAE6OF02GGOLO.18.39.D06.1.454.CMB.1.raw
  modified_base (277)..(277): a, c, t, g, unknown or other
  misc_feature (277)..(277): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatcgaccggaacccctccaccggcacagcctacatgganctgagcagtctgacacctgacgacacggccgtctattactgtgcgagacgcccgacgaaattagtggtggtacgacgtaaaaggtgttgggttcggttttggttttcggtttttcgggacccgggttagtaaaccgtttacggtcgggggacccgtacggggaccctaaccccggttcgggttacccgtaacccggtttcccgttacccgttaccgtaccggttcccgtttaccccgaaacccgtaaaccggggcccctaacgttcccgggttaccccgtttccccccgtccgggtacccctacccccgtttaccccgttaaccccgaaaccggtaccgtaccccgtaaccccggttccgggttaccggggggaccctaccggaaccgggtccccggggtaccccgttcgggggtacccgttacccgggtaccccggttacggggttaacccgaaaccgggttaaccccgtttaaccccgtttaccccgtaaccgttacccgttaaccccggg

SEQ ID NO: 241040 - DNA, 590 bp, Homo sapiens
  misc_feature: GYAE6OF02G3FBO.18.39.D06.1.454.CMB.1.raw
  modified_base (281)..(281): a, c, t, g, unknown or other
  misc_feature (281)..(281): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (355)..(355): a, c, t, g, unknown or other
  misc_feature (355)..(355): n is a, c, g, or t
tcagtacgagtatgcacgaccggtgctcgatttagtgacatctcgcagttctttgggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcaccacgcctacactgganctgagcagtctgacacctgacgacacggccgtctattactgtgcgtagagccgngaatatggtgtnacaaaagngtaggttcgttggtttgttttgggccggttagaacgttacgtcggggcctagggcctacccgtgggtccaccgtctcctacgacgtcttcccgacaacgggcccacgtccggtccttcccccgtggcccgtccctgcctccgacggtacgccctaccgtcgtcgggccacgtacggcggacccgtgggcctcggtcctcgggtccaacgggtaccctttacgtcccgagttaccg

SEQ ID NO: 241041 - DNA, 435 bp, Homo sapiens
  misc_feature: GYAE6OF02FSDWQ.18.39.D06.1.454.CMB.1.raw
  modified_base (227)..(227): a, c, t, g, unknown or other
  misc_feature (227)..(227): n is a, c, g, or t
  modified_base (426)..(435): a, c, t, g, unknown or other
  misc_feature (426)..(435): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaaagntggtcgttgtttgttttggccggtgaactactggggccagggcaccctggtcaccgtctcctcagcttccaccaagggcccatcggtcttccccctggcgccctgctccaggagcacctctgggggcacgagcggccctgggctgcctggtcaaggactacttcccatactcgtactgagcgggctggcaggcgcatgnnnnnnnnnn

SEQ ID NO: 241042 - DNA, 586 bp, Homo sapiens
  misc_feature: GYAE6OF02HUS00.18.39.D06.1.454.CMB.1.raw
  modified_base (231)..(231): a, c, t, g, unknown or other
  misc_feature (231)..(231): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (555)..(556): a, c, t, g, unknown or other
  misc_feature (555)..(556): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (563)..(571): a, c, t, g, unknown or other
  misc_feature (563)..(571): n is a, c, g, or t
  modified_base (573)..(586): a, c, t, g, unknown or other
  misc_feature (573)..(586): n is a, c, g, or t
tcagtacgagtatgcacgaccggtgctcgatttagtgacatctcgagtggatgggatggatgaaacggtaaaactgccaacacaggctatgcagaggcattccagggcagagtcaccatgacccgggaacccctccaccggcacagcctacatggagctgagcagtctgacacctgacgacacggccgtctattactgtgcgagagccgcgaatatggtggtgacaaaagngtggttcgtttggttttggttttggccggtagtaacttacgtcggggccaggggccacccgttggtccacccgtcctccctcacgtccttcccgaccgaacgggcccctagtccggttccttccccccgtggcccgtcccctcgccctccgacggacgccacccgtcggtcggggcacgcgccggtccgtgggtcctcgcccgtgggtaccgaacggtaccttaccgtttcccgattacccgttccggtacgttcgggaccgggtccgggggtaccgttgggacccgtaaggggtcccggacctaagttacggcngngcncgcnncncncgnnnnnnnnngnnnnnnnnnnnnnn

SEQ ID NO: 241043 - DNA, 544 bp, Homo sapiens
  misc_feature: GYAE6OF02F47MI.18.39.D06.1.454.CMB.1.raw
  modified_base (346)..(346): a, c, t, g, unknown or other
  misc_feature (346)..(346): n is a, c, g, or t
tcagtacgagtatgcacgaccggtgctcgatttagtgacatctcgcagttctgggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccggaacccctcaccggcacagcctacatggagctgagcagtctgacacctgacgacacggccgtctattactgtgcgagagccgcgaatatgtggtgacaaagntggtcgtttgtttgttttggccggttgaactacgtggggccagggcacccgtggtcaccgtctcctcagcttccaccacgggcccatccgtccttcccctggccgccctcgcctccgaggacgccacctcgtcggggcacgacgccggcccgtgggcctcggccgttcggtcaacggtacctaccttcccattacccg

SEQ ID NO: 241044 - DNA, 374 bp, Homo sapiens
  misc_feature: GYAE6OF02FSWJV.18.39.D06.1.454.CMB.1.raw
  modified_base (272)..(272): a, c, t, g, unknown or other
  misc_feature (272)..(272): n is a, c, g, or t
  modified_base (358)..(359): a, c, t, g, unknown or other
  misc_feature (358)..(359): n is a, c, g, or t
  modified_base (361)..(374): a, c, t, g, unknown or other
  misc_feature (361)..(374): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcatgggggaggtgtgtcacaagatttgggctctgggcaccgtgggcatgggggaggtgtgtcacaagatttgggctctgggcaccctggtcaccgtctcctcagcttccaccaagggcccatccggtcttccccctggcgccctgctccaggcncacctctgggggcacagcggccctgggctgcctggtcagggactactcccatacctcgtactgagcgggctggcaaggcgcatagnngnnnnnnnnnnnnnn

SEQ ID NO: 241045 - DNA, 487 bp, Homo sapiens
  misc_feature: GYAE6OF02H601I.18.39.D06.1.454.CMB.1.raw
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (229)..(229): a, c, t, g, unknown or other
  misc_feature (229)..(229): n is a, c, g, or t
  modified_base (355)..(355): a, c, t, g, unknown or other
  misc_feature (355)..(355): n is a, c, g, or t
  modified_base (463)..(487): a, c, t, g, unknown or other
  misc_feature (463)..(487): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattacngtgcgagagccgngaaatatgtggtgacaaaagntggtcgttgttttgttttggccggtgaactacgtggggccagggccacccgtggtcaccgtctcctcacgcctccaccgaacgggcccatccggtccttccccctggccgccctgcctccgaggcncacctcgagagcacagccggccctgggctccgcgtcgaacgacgtaccttcctacctactccgtacgtacgtggcgggccggtggtcgaacggacggcactaagtcgnnnnnnnnnnnnnnnnnnnnnnnnn

SEQ ID NO: 241046 - DNA, 364 bp, Homo sapiens
  misc_feature: GYAE6OF02IVDYA.18.39.D06.1.454.CMB.1.raw
  modified_base (269)..(269): a, c, t, g, unknown or other
  misc_feature (269)..(269): n is a, c, g, or t
  modified_base (354)..(364): a, c, t, g, unknown or other
  misc_feature (354)..(364): n is a, c, g, or t
tcagtacgagtatgcacgaccggtgctcgatttagtgacatctcgcagttctttgggttttgggggaagaggaagactgacggtcctcccaggagttcaggtgctgggcaccgtgggcatggggaggtgtgtcacaagatttgggctctgggcaccgtgggcatgggggagtgtgtcacaagatttgggctctgggcaccctggtcaccgtctcctcagcttccaccaagggcccatcggtcttccccctggcgccctgctccaggacncacctctggggcacagcggccctgggctgcctggtcaaggactacttcccatactcgtactgagcgggctggcaaggcgcatagnnnnnnnnnnn

SEQ ID NO: 241047 - DNA, 579 bp, Homo sapiens
  misc_feature: GYAE6OF02H94AB.18.39.D06.1.454.CMB.1.raw
  modified_base (347)..(347): a, c, t, g, unknown or other
  misc_feature (347)..(347): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccggaacccctccaccggcacagcctacatggagctgagcagtctgacacctgacgacacggccgtctattactgtgcgagagccgcgaatatgtggtgcaaagntaggtcgttgtttgttttcggtcggtgtaactacgtggggtccgagggcacccgtcggtcaccgtctcctcagtccttccaccaacgggcccatccggtccttccccgtcggccgtccctcgtccgtcccgaggtacgccgacccgttcgtcgggggccacgacgccggcccgtcgggccgtcgcccgttcgggtaccgtaacggaaccgtttaccgttccccattacccgg

SEQ ID NO: 241048 - DNA, 229 bp, Homo sapiens
  misc_feature: GYAE6OF02H1XP1.18.39.D06.1.454.CMB.1.raw
  modified_base (226)..(229): a, c, t, g, unknown or other
  misc_feature (226)..(229): n is a, c, g, or t
tcagtacgagtatgcacgaccggtgctcgatttagtgacatctcgcagttctttgggttttgggggaagaggaagactgacggtcctcccaggagttcaggtgctgggcaccgtgggcatgggggaggtgtgtcacaagatttgggctctgggcacagcggccctgggctgcctggtcaaggctacttcccatactcgtactgagcgggctggcaaggcgcatagnnnn

SEQ ID NO: 241049 - DNA, 526 bp, Homo sapiens
  misc_feature: GYAE6OF02JZS1D.18.39.D06.1.454.CMB.1.raw
  modified_base (495)..(495): a, c, t, g, unknown or other
  misc_feature (495)..(495): n is a, c, g, or t
  modified_base (498)..(526): a, c, t, g, unknown or other
  misc_feature (498)..(526): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgcgaatatgtggtgacaaagattgggttcgtttgttttggttttcggccggttgaactacgtggggccagggcacccgtggtccaccggtctcctcagcttccaccgaacgggcccagtcggtccttccccctggcctaccctcctccagacgccacctcgtcggggcacacggccggcccgtgggctcgccgtttggcaacggtaccttacgttccccaagttcccgtccgtacgttacgagggtccggggtctgggacccgtagggaccgtcaacgttaggcagtcancgnnnnnnnnnnnnnnnnnnnnnnnnnnnnn

SEQ ID NO: 241050 - DNA, 460 bp, Homo sapiens
  misc_feature: GYAE6OF02IZUTU.18.39.D06.1.454.CMB.1.raw
  modified_base (227)..(227): a, c, t, g, unknown or other
  misc_feature (227)..(227): n is a, c, g, or t
  modified_base (446)..(460): a, c, t, g, unknown or other
  misc_feature (446)..(460): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgacaaagntggtcgtttgtttgtttggccggtgaactactggggccagggcacccctggtcaccgtctcctcagcttccacaacgggccatcggtccttcccctggccgcccgtgctccaggacgcaccgtcgtgggggccacgacgccggtccctgggcctcgccgtggtcaaggactaccttacccgatacgtcgtactgagccgggctggcgaggcgcatacgnnnnnnnnnnnnnnn

SEQ ID NO: 241051 - DNA, 627 bp, Homo sapiens
  misc_feature: GYAE6OF02G3ET6.18.39.D06.1.454.CMB.1.raw
  modified_base (336)..(336): a, c, t, g, unknown or other
  misc_feature (336)..(336): n is a, c, g, or t
tcagtacgagtatgcacgaccggtgctcgatttagtgacatctcgcagttctttgggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccgagggcagagtcaccatgacccgggaacccctccgaccggcacagcctacatggagctgagcagtctgacacctgacgacgacggccgtctattactgtgcgagacgccgngaactgtgtggtcgacgtaaaagagttgggttcgtttgttttggttttcgggccggttgtaaccgttacggtcggggaccacggggtcctaccccgtcggtaccctaccgtccgtccctcgtacgtcttacccgaccgaacgggtcccaacgttccggtcccttccccgtcggcccgtccccgtcgccgtccgacggaccgcctacccgtcgtcggggaccaccgacggcccggcccgtcgggccgttcgccgtcggtaccgaacggtaccctaccgttccctagtacccg

SEQ ID NO: 241052 - DNA, 373 bp, Homo sapiens
  misc_feature: GYAE6OF02IMBOY.18.39.D06.1.454.CMB.1.raw
  modified_base (361)..(373): a, c, t, g, unknown or other
  misc_feature (361)..(373): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcatgggggaggtgtgtcacaagatttgggctctgggcaccgtgggcagtgggggaggtgtgtcacaagatttgggctctgggcaccctggtcaccgtctcctcagcttccaccaagggcccatcggtctcccccctggccgccctgctccaggacgcacctctgggggcacagcggccctgggctgcctgtcaaggactacttcccatacctcgtactgagcgggctggcaacggcgcatagnnnnnnnnnnnnn

SEQ ID NO: 241053 - DNA, 443 bp, Homo sapiens
  misc_feature: GYAE6OF02GA68C.18.39.D06.1.454.CMB.1.raw
  modified_base (227)..(227): a, c, t, g, unknown or other
  misc_feature (227)..(227): n is a, c, g, or t
  modified_base (429)..(429): a, c, t, g, unknown or other
  misc_feature (429)..(429): n is a, c, g, or t
  modified_base (434)..(443): a, c, t, g, unknown or other
  misc_feature (434)..(443): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaaatatgtggtgcaaagntggtcgttgtttgttttggccggtgaactacgtggggccagggcaccctggtcaccgtctcctcagcttccaccaagggcccatcggtcttccccctggccgccctgcctccaggacgcacctcgtgggggcacgagccggccctgggctgccgtggtcaaggactacttcccatactcgtactgagcgggctggcaaggcnatagnnnnnnnnnn

SEQ ID NO: 241054 - DNA, 615 bp, Homo sapiens
  misc_feature: GYAE6OF02FVFVG.18.39.D06.1.454.CMB.1.raw
  modified_base (228)..(228): a, c, t, g, unknown or other
  misc_feature (228)..(228): n is a, c, g, or t
  modified_base (560)..(560): a, c, t, g, unknown or other
  misc_feature (560)..(560): n is a, c, g, or t
  modified_base (568)..(568): a, c, t, g, unknown or other
  misc_feature (568)..(568): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (587)..(587): a, c, t, g, unknown or other
  misc_feature (587)..(587): n is a, c, g, or t
  modified_base (595)..(595): a, c, t, g, unknown or other
  misc_feature (595)..(595): n is a, c, g, or t
  modified_base (607)..(607): a, c, t, g, unknown or other
  misc_feature (607)..(607): n is a, c, g, or t
  modified_base (611)..(612): a, c, t, g, unknown or other
  misc_feature (611)..(612): n is a, c, g, or t
tcagtacgagtatgcacgaccggtgctcgatttagtgacatctcgagtgggatgggatggatgaacggtaaaactgccaacacaggctatgcagaggcattccagggcagagtcaccatgaccgggaacccctccaccggcacagcctacatggagctgagcagtctgacacctgacgacacggccgtctattacctgtgcgagagccgcgaatatgtggtgcaaagntggtcgttgtttgtttggccggtgaactacgtggggccagggcaccctggtcaccgtctcctcagccttccaccgaagggccccacgtcggtccttcccccgtggccgtccccgtgcctcccgagggacgccgacctcgtcggggggtccaacgtacggcccgggtcccgtcggggccgtcggtcccgttgggttaccgaaacgggtaccgtttaccgtttacccctaagtttaccgttaccggttaccgttacgggaacggtccgggggtcttaccggggccgtaaacggggtcccgaccgtaacggttaacggcgtacgtcgacggtcgngcgagcgngagngngcgncncgcgcgngtctctcncgcgtcgtctcncgcnntcg

SEQ ID NO: 241055 - DNA, 738 bp, Homo sapiens
  misc_feature: GYAE6OF02JK1CE.18.39.D06.1.454.CMB.1.raw
  modified_base (149)..(149): a, c, t, g, unknown or other
  misc_feature (149)..(149): n is a, c, g, or t
  modified_base (229)..(229): a, c, t, g, unknown or other
  misc_feature (229)..(229): n is a, c, g, or t
  modified_base (633)..(633): a, c, t, g, unknown or other
  misc_feature (633)..(633): n is a, c, g, or t
tcagtacgagtatgcacgaccggtgctcgatttagtgacatctcgagtgggatgggatggatgaacggtaaaactgccaacacaggctatgcagaggcattccagggcagagtcaccatgaccgggaaccctccaccggcacagcctanatggagctgagcagtctgacacctgacgacacggcgtctattactgtgcgagacgccgacaatatcggtggtgacaaagntcggttcgtttgtttggtttcggcggtgtaacgtacgtcgggtacacggtaccaccgttggtcgaccgtcgtcctacacgtccgttacccgaaccgaacggggtcccctaacgtaccgggttaccgtttcccccccgtgggtcccgtaccccgttcggtcccgttacccgaagggtaccgtaccgtacccgttaccggttaccggggggtacctaaccgtaacgggacccgggcccgtttacggggaccgttccggacccgttggtaaccggtaaacgggtaccttaaccgtttaccccgaacgtttaccttaccgggtaacctacgggtacggtaccgggtaaccgttcgggaccgtaaccgggaccgtaccgtaacgttacggtactaaccgacgacgtacncgtacgtacgtacgtacgtacgtacgtacgtacgtacgtacgtacgtacgtacgtgtacgtacgtacgtacgtacgtacgacgtacgacgtacgtacgtagtacg

SEQ ID NO: 241056 - DNA, 583 bp, Homo sapiens
  misc_feature: GYAE6OF02I811C.18.39.D06.1.454.CMB.1.raw
  modified_base (357)..(357): a, c, t, g, unknown or other
  misc_feature (357)..(357): n is a, c, g, or t
  modified_base (497)..(497): a, c, t, g, unknown or other
  misc_feature (497)..(497): n is a, c, g, or t
tcagtacgagtatgcacgaccggtgctcgatttagtgacatctcggcgagttctggggactgaggtgaagaaccctggggcctcagtgaaggtctcctgtcagaccctatggattccccttccagtaattttgatatccattggggtgcgacaggccagtggacaagggctcgagtggatgggatggatgaacggtaaaactgccaacacaggctatgcagaggcattccagggcagagtcaccatcgaccgggaacccctcaccggcacagcctacatggagctgagcagtctgacacctgacgacgacggccgtctatactgtgcgagacgccgcgaatagtgtggtgacaaagntggtcgtttgtttgttttcgggcgtgaactcgtgggccagggccacccgtggtccaccgtctcctcacgtccttaccaccgacggcccacgtccggtccttacccccgtggcccgtcccgttgaccctccgacgggtacnccgtaccgtcgtcggggccacgtcggccggtcccgtgggcctcgccgttcggaccaacggtacctaccgttccccgtattaacccg

SEQ ID NO: 241057 - DNA, 627 bp, Homo sapiens
  misc_feature: GYAE6OF02FLWMK.18.39.D06.1.454.CMB.1.raw
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
tcagtacgagtatgcacgaccggtgctcgatttagtgacatctcgagtggatgggatggatgaacggtaaaactgcccaacacaggctatgcagaggcattccagggcagagtcaccatcgaccgggaacccctcgaaccggcacagcctacagttcggagctgagtcaggtctgacacctgacgacacggccgtctattactgtggcgagagcccgcgaatatggtggtncaaaagntggtcgttgtttgtttggccggtgaactactggggccagggcacctggtcacgtctctcagcttccacaaggcccagtcggtcttccccgtggccgtccctgcctccgaggacgcaccgtcgtacgggggaccaacgacggccggcccgtggggcctcggcccgttacgggtaccgaaacggtaccttaaccgtttaccccgaacttaaccgtccggttaccgtacggaacggtcccggggacttacggggaccgtaaacggggtccgaccgtaagttaccggatacgacagtacgcgtcgactacgcgacgcgacgacgtacgtacgtacgacgtacgtcgacgacgtacgtacgtacgtacgtacgtacgtcgtcgtacgtacgtcg

SEQ ID NO: 241058 - DNA, 608 bp, Homo sapiens
  misc_feature: GYAE6OF02GIVXQ.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatcgacccgggaacccctccaccggcacacgcctacatggagctgagcagtctgaccacctgacgacacggccgtctattactgtgcgagacgccgacgaatatggtggtgacaaagagtggttcgtttgttttggttttcgggccggttgaacgttacgtcggggccagggcctacccgtggtacctaccgttctccgtcacgtccttccgaaccgacgggccctagttcccggtccttcccccgtggcccgtcccgtcgcctaccggacgacgccgtacccgtcggcggggccacggccgggccggtcccgtcgggtccgtcggtccgttacggtacgaacggtacccttaccgttacccattacccg

SEQ ID NO: 241059 - DNA, 656 bp, Homo sapiens
  misc_feature: GYAE6OF02IPZ8I.18.39.D06.1.454.CMB.1.raw
tcagtacgagtatgcacgaccggtgctcgatttagtgacatctcgcagttctttgggctgaggtgaagaaccctggggcctcagtgaaggtctcctgtcagacctatggattcccccttccagaattttgatatccattgggtgcgacaggccagtggacaagggctcgagtggatgggatggatgaaacggtaaaaactgaccaacacaggctatgcagaggcattccagggcagagtcaccagtcgacccgggaacccctccgaccgcacacgcctacagtggagctgagcagtctcgacacctagaccgacgaccggccgtacttattacgtgtgacgagacgccgagaatagtgtggtgaacgaaagtagttgggttcgtttgttttggttttcgggaccggttagtaaaccgttacggtacggggacccgaacgggcctaacccgtcggtacctaccgttccgtcctaccgacgtccttacccgaacccgaaaccgggtcccctaacgttcccggttcccgttccccgtcgggcccgtcccctcgcctaccgacgacgcctaccgtcgtcgggaccacggaccggcccggtcccggtgggccgtcggccgttcgggtaccgaacggtaccttaccctacccgtagttaccg

SEQ ID NO: 241060 - DNA, 562 bp, Homo sapiens
  misc_feature: GYAE6OF02I67PX.18.39.D06.1.454.CMB.1.raw
  modified_base (156)..(156): a, c, t, g, unknown or other
  misc_feature (156)..(156): n is a, c, g, or t
  modified_base (168)..(168): a, c, t, g, unknown or other
  misc_feature (168)..(168): n is a, c, g, or t
  modified_base (180)..(180): a, c, t, g, unknown or other
  misc_feature (180)..(180): n is a, c, g, or t
  modified_base (196)..(196): a, c, t, g, unknown or other
  misc_feature (196)..(196): n is a, c, g, or t
  modified_base (529)..(534): a, c, t, g, unknown or other
  misc_feature (529)..(534): n is a, c, g, or t
  modified_base (536)..(562): a, c, t, g, unknown or other
  misc_feature (536)..(562): n is a, c, g, or t
tcagtacgagtatgcacgaccggtgctcgatttagtgacatctcgagtgggatgggatggatgaacggtaaaactgccaacacaggctatgcagaggcattccagggcagagtcacatgaccgggaacccctcaccgggcacagcctaacagtggngctgagcagtcngacactgacganacggccgtctattacnggtggcgagacgccgacgaatagtgtggtgacaaaagtcgtggtcgtttgttttcgtttaggccggtagtaacgtacgtcggggacacgggactacccgtgggtaccaccgttccgtaccttcgacgtccgtttacccgaaccgaaacgggtcccaacgttcgggtaccctccccgtcgccgtacccttcaccaaggtacgccaccgtacggagggggaccaacggcgcccggccggtagggtcctcgcctacgggtacaacgggtaaccttacgtcccaattaccgagtacccgtgacggtcgggacgttcggacgtaacggcgacatacgnnnnnnannnnnnnnnnnnnnnnnnnnnnnnnnn

SEQ ID NO: 241061 - DNA, 609 bp, Homo sapiens
  misc_feature: GYAE6OF02F7CID.18.39.D06.1.454.CMB.1.raw
  modified_base (272)..(272): a, c, t, g, unknown or other
  misc_feature (272)..(272): n is a, c, g, or t
  modified_base (343)..(343): a, c, t, g, unknown or other
  misc_feature (343)..(343): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcaccagcctanatggagctgagcagtctgacacctgacgacacggccgtctattactgtgcgagagccgcgaatatgtggtncaaagatggtcgtttgtttgttttggccggttgaacgtacgtggggccagggcaccgtggtcaccgtctccctcacgtccttccaaccacgggtcccagttccggtcctttccccccgtgggtcccgtccccgtacgtccgtcccgacgggaacgccgtaacccgtcgtcgggggccaaccgacggccggtaccccgttggggcccgtacggcccgttcgggtaccgaaaccgggtacccttaacccgtttccccgaattacccgg

SEQ ID NO: 241062 - DNA, 450 bp, Homo sapiens
  misc_feature: GYAE6OF02IP2SQ.18.39.D06.1.454.CMB.1.raw
  modified_base (231)..(231): a, c, t, g, unknown or other
  misc_feature (231)..(231): n is a, c, g, or t
  modified_base (344)..(344): a, c, t, g, unknown or other
  misc_feature (344)..(344): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
  modified_base (430)..(450): a, c, t, g, unknown or other
  misc_feature (430)..(450): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaaatatggtggtgacaaaaagntgggtctttgtttgttttggccggtgaactacgtggggccagggcacccctggtcaccgtctcctcagcttccacaagggcccatcggtcttcccctgcgcctgctccaggcncacctcgtggggcacgagcggccctgggctgccgtgtacaaggctactccatactcgtactgagcgggntggcgaaggcncatagnnnnnnnnnnnnnnnnnnnnn

SEQ ID NO: 241063 - DNA, 449 bp, Homo sapiens
  misc_feature: GYAE6OF02IH7NY.18.39.D06.1.454.CMB.1.raw
  modified_base (228)..(228): a, c, t, g, unknown or other
  misc_feature (228)..(228): n is a, c, g, or t
  modified_base (428)..(428): a, c, t, g, unknown or other
  misc_feature (428)..(428): n is a, c, g, or t
  modified_base (434)..(449): a, c, t, g, unknown or other
  misc_feature (434)..(449): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatggtggtgacaaagntggtcgttgttttgtttggccggtgaactacgtggggccagggcaccctggtcaccgtctcctcagcttccaccacgggccactcggtccttcccctggccgccctgctccgaggcgcaccgtcgtgggggccacgagccggcctgggctgcctggacaaggctacttcccatactcgtactgagcggctcggcaaggcncatcgnnnnnnnnnnnnnnnn

SEQ ID NO: 241064 - DNA, 356 bp, Homo sapiens
  misc_feature: GYAE6OF02G209L.18.39.D06.1.454.CMB.1.raw
  modified_base (251)..(251): a, c, t, g, unknown or other
  misc_feature (251)..(251): n is a, c, g, or t
  modified_base (351)..(356): a, c, t, g, unknown or other
  misc_feature (351)..(356): n is a, c, g, or t
tcagtacgagtatgcacgaccggtgctcgatttagtgacatctcgcagttctttggggggaagaggaagactgacggtcctcccaggagttcaggtgctaggcaccgtgggcatgggggaggtgtgtcacaagatttgggctctgggcaccgtgggcatggggggaggtgtgtcacaagatttgggccagggcaccctggtcaccgtctcctcagcttccaccaagggcccatcggtcttccccctggccnccctgctccaggagcacctctgggggcacagcggccctgggctgcctggtcaaggactacttcccatactcgtactgagcgggctggcaaggcgcatagnnnnnn

SEQ ID NO: 241065 - DNA, 483 bp, Homo sapiens
  misc_feature: GYAE6OF02GIP7X.18.39.D06.1.454.CMB.1.raw
  modified_base (464)..(464): a, c, t, g, unknown or other
  misc_feature (464)..(464): n is a, c, g, or t
  modified_base (470)..(483): a, c, t, g, unknown or other
  misc_feature (470)..(483): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgacaaagatgggtcgttgttttgttttggccggtgaactacgtggggccagggccacccgtggtccaccgtctcctcagcttccaccgaacgggcccagtccggtccttccccctggccgcccctgcctccgaggacgccacccgtcggtcgggggcacgaggccggcccgtggggcctcgccgtggtccaaggtccttaccttacccattacctcgtactggacggtcgggctcggcaagggcncgatgnnnnnnnnnnnnnn

SEQ ID NO: 241066 - DNA, 436 bp, Homo sapiens
  misc_feature: GYAE6OF02HVZ6O.18.39.D06.1.454.CMB.1.raw
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
  modified_base (340)..(340): a, c, t, g, unknown or other
  misc_feature (340)..(340): n is a, c, g, or t
  modified_base (421)..(421): a, c, t, g, unknown or other
  misc_feature (421)..(421): n is a, c, g, or t
  modified_base (426)..(436): a, c, t, g, unknown or other
  misc_feature (426)..(436): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgngaaatatgtggtgacaaagnttggtcgttgtttgtttggccggtgactactggggccagggcacctggtcaccgtctcctcagcttccacaagggcccatcggtcttcccctggccgccctgctccaggacncacctcgtgggggcacaggcggcctgggctgcctggtcaaggctacttcccatctcgtactgagcgggctggcaaggccgnatagnnnnnnnnnnn

SEQ ID NO: 241067 - DNA, 680 bp, Homo sapiens
  misc_feature: GYAE6OF02IMXCQ.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattcccccttccagaattttgatatccattgggtgcgacaggccagtggacaagggctcgagtggatgggatggatgaacggtaaaactgccaacacaggctatgcagaggcattccagggcagagtcaccatcggacccgggaacccctccaccggcacacgcctacatggagctgagcagtctgaccaccgtgacgacgacggccgtctattactgtgcgagacgccgagaatagtgtggtagacgaaagtgttgggttcgttttggttttggtttttcgggccggttagtaacgttcggtcgggggccctaaggggccctacccgtcgggtacctacccggttccgtcccgttccggtcccttacccgaaccgtaaccgggcccctacgttcccggttccccttcccccggtggcccgtcccgtcggccctcccgacggtaccgccgtacccgttcgggtcgggggacctacggaccggtcccgggtcccgttcggggtccttccgggtcccgttacgggtaccctaacgggttacccttacccgttacccctacgttacccgtaccgg

SEQ ID NO: 241068 - DNA, 662 bp, Homo sapiens
  misc_feature: GYAE6OF02FXGE8.18.39.D06.1.454.CMB.1.raw
  modified_base (231)..(231): a, c, t, g, unknown or other
  misc_feature (231)..(231): n is a, c, g, or t
  modified_base (626)..(626): a, c, t, g, unknown or other
  misc_feature (626)..(626): n is a, c, g, or t
  modified_base (632)..(638): a, c, t, g, unknown or other
  misc_feature (632)..(638): n is a, c, g, or t
  modified_base (640)..(646): a, c, t, g, unknown or other
  misc_feature (640)..(646): n is a, c, g, or t
  modified_base (648)..(662): a, c, t, g, unknown or other
  misc_feature (648)..(662): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaaccccctccaccggcacagcctacatggagctgagcagtctgacacctgacgacacggcctctattactgtgcgagacgccgacgaatatggtggtgacaaaagngttggttcgtttgttttggttttcggccggtgaacgtacgtggggccgacgggccacccgtggtccaccgttcctcctcacgtccttcccgaaccgaaccgggccctaacgttccggttccctttcccccgtcgggccccgtccccgttcggccttacccgagggacgtcccgtacccgttccgggtacggggggacctaaccggacgggcccgggtcccggttacgggggccgttccgggtacccggttacgggttaaccggtaaaccgggttaccctttaccccgtttaccccgtaacgttaaccccggttacggtttaaccggtcgggtaaccggggtcccgggggtccgtacggggacccggtaaacggggtccgacgtaacgttaaggcngtcgannnnnnncnnnnnnngnnnnnnnnnnnnnnn

SEQ ID NO: 241069 - DNA, 462 bp, Homo sapiens
  misc_feature: GYAE6OF02I03A2.18.39.D06.1.454.CMB.1.raw
  modified_base (226)..(226): a, c, t, g, unknown or other
  misc_feature (226)..(226): n is a, c, g, or t
  modified_base (445)..(445): a, c, t, g, unknown or other
  misc_feature (445)..(445): n is a, c, g, or t
  modified_base (447)..(462): a, c, t, g, unknown or other
  misc_feature (447)..(462): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagntggtcgttgtttgtttggccggtgaactacgtggggccagggcaccctggtcaccgtctcctcagcttccaccaagggcccatcggtccttccccctggccgccctgctccaggacgcacctcgtgggggccacgagccggccctggggctgccctggtccaagggacctaccttcccatactcgtactgaggcgggctcggcaagggcgaccagtagntnnnnnnnnnnnnnnnn

SEQ ID NO: 241070 - DNA, 722 bp, Homo sapiens
  misc_feature: GYAE6OF02JJR0U.18.39.D06.1.454.CMB.1.raw
  modified_base (232)..(232): a, c, t, g, unknown or other
  misc_feature (232)..(232): n is a, c, g, or t
  modified_base (277)..(277): a, c, t, g, unknown or other
  misc_feature (277)..(277): n is a, c, g, or t
  modified_base (311)..(311): a, c, t, g, unknown or other
  misc_feature (311)..(311): n is a, c, g, or t
tcagtacgagtatgcacgaccggtgctcgatttagtgacatctcgcagttctggggctgaggtgaagaaccctggggcctcagtgaaggtctcctgtcagacatatggattccccttccagaattttgatatccattgggtgcgacaggccagtggacaagggctcgagtggatgggatggatgaacggtaaaactgccaaacacaggctatgcagaggcattccaggcagngtcacatgaccgggaacccctccaccggcacagcctaacatgganctgagcagtctgacacctgacgacaccggccgtntattactgtcgcgagagcccgagaatagtgtgggtacacgaaaagcgttcggttcgtttagttttggttttcgggcccgggttagtaaccgtaacggtcggggtaccgaacggggcctaaccccggttcgggtacccaacccggttccgtaccctccgtacgtccccgttacccgaacccggtaaccgggccccttaacgttcccgggtttcccttcccccccggttgggaccccgtccccgttacggtcccgtacccgtaacgggaccgtacccgtaacccgttcccggaaccggacggacccaaccggaccgggtacccgggtcccccgttagggggtcccttacccgggtcccggttaccgggtaacccggtaaacccgggttaccgttaacccccgtttaaccccgg

SEQ ID NO: 241071 - DNA, 444 bp, Homo sapiens
  misc_feature: GYAE6OF02GAX16.18.39.D06.1.454.CMB.1.raw
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
  modified_base (328)..(328): a, c, t, g, unknown or other
  misc_feature (328)..(328): n is a, c, g, or t
  modified_base (435)..(444): a, c, t, g, unknown or other
  misc_feature (435)..(444): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagcccgngaaatatgtggtgcaaaagntgggtcgtttgttttgttttggccggtgaactactggggccagggcaccctggtcaccgtctcctcagcttccaccaagggcccatcggtcttcccccnggccgccctgctccaggagcacctcgtggggcacagcggccctgggctgcctggtcaaggactaccttcccatactcgtactgacgcgggctggcaaggcgcatagnnnnnnnnnn

SEQ ID NO: 241072 - DNA, 701 bp, Homo sapiens
  misc_feature: GYAE6OF02G16HD.18.39.D06.1.454.CMB.1.raw
  modified_base (217)..(217): a, c, t, g, unknown or other
  misc_feature (217)..(217): n is a, c, g, or t
tcagtacgagtatgcacgaccggtgctcgatttagtgacatctcgcagttctggggctgaggtgaagaaccctggggcctcagtgaaggtctcctgtcagacctatggacttcccccttccagtaattttgatatccattgggtgcgacaggccagtggacaagggctcgagtggatgggatggatagaaacggtaaaactgaccaacacaggctangcagaggcattccgagggcagagtcaccagtacgaccccgggaacccctccgacccggcaccacgtccctaacagtggagcgtagacgcagtctagaccaccgtgaccgacgcggacctactattactgtgcgagacgccgacgtaatagtggtggtcgaacgaaagtgttcggttcgttttaggttttcgtttcgggcggttagaacggttcggtcgggccgtagggtccctacccgtggtacccgaccgtttcctccgtcgtaccgtccttacccgtaacccgacgggtaccctacgttccggtaccccttccccggtcggcccgtcccgtcgacccgtcccgacggtaccgtcccgtacccgtcggtaccggggtacccacggaccgggtcccggtccccgtacggggtccctaccgggtcccggttacgggtaccgtaaacccggttacccttaccccgtttacccgtacgttaacccgg

SEQ ID NO: 241073 - DNA, 359 bp, Homo sapiens
  misc_feature: GYAE6OF02GUVIJ.18.39.D06.1.454.CMB.1.raw
  modified_base (354)..(359): a, c, t, g, unknown or other
  misc_feature (354)..(359): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggaggtgtgtcacaagatttgggctctgggcaccgtgggcatgggggaggtgtgtcacaagatttgggccagggcaccctggtcaccgtctcctcagcttccaccaagggccccatcggtcttccccctggcgccctgctccaggagcacctctgggggcacagcggccctgggctgccctggtcaacggactacttcccatacctcgtacctgagcgggctggcaaggcgcatagnnnnnn

SEQ ID NO: 241074 - DNA, 735 bp, Homo sapiens
  misc_feature: GYAE6OF02I7JJF.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccaggcagatcacatgaccggaccctccaccggcacagcctacatggagctgagcagtctgacacctgacgacacggcgtctattactgtgcgagagccgacgaatagtcgtggtgactaaagattgggttcgttttggttttggtttttcgggaccggttagtaaaccgtacggttcgggggaccctacggggacctaccccggttgggtaccctacccggttccttaccccgttaccgtacgtcccgtttaaccccgaaccccggtaaaccggggtacccccctaaacgtttccccggggtttacccttttcccccccccggttagggtccccggtacccccgttcggtaccccttacccgggaacgggtaccgtaccccgtaacccgttaccgggtccggggggtacccaaccggtacgggcccggggtacccccgtgggggcccttacgggccccgttcgggaccgtaaaccgggtaccctttacccgtttacccccgtaagttacccg

SEQ ID NO: 241075 - DNA, 439 bp, Homo sapiens
  misc_feature: GYAE6OF02FNFRL.18.39.D06.1.454.CMB.1.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (430)..(439): a, c, t, g, unknown or other
  misc_feature (430)..(439): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgngaatatgtggtgcaaagntggtcgtttgtttgttttggccggtgaactactggggccagggcaccctggtcaccgtctcctcagcttccaccaagggcccatccggtcttccccctggccgccctgcctccagggagcacctccgagagcacagcggccctgggctgcctggtcaaggctactcccatactcgtactgacgcgggctggcaaggcgcatagnnnnnnnnnn

SEQ ID NO: 241076 - DNA, 454 bp, Homo sapiens
  misc_feature: GYAE6OF02HWI68.18.39.D06.1.454.CMB.1.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (348)..(348): a, c, t, g, unknown or other
  misc_feature (348)..(348): n is a, c, g, or t
  modified_base (446)..(454): a, c, t, g, unknown or other
  misc_feature (446)..(454): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgngaatatgtggtgcaaagntggtcgtttgttttgtttggccggttgactactggggccagggcaccctggtcaccgtctcctcagcttccaccaagggcccatcggtccttccccctggccgccctgccttccgaggtacnccaccctccgagacgcacacgcggcccgtgggcctgcctggtcaaggtacctacctcccattacctcgtactggacgcgggctggcaagggcacatgnnnnnnnnn

SEQ ID NO: 241077 - DNA, 638 bp, Homo sapiens
  misc_feature: GYAE6OF02GZRZL.18.39.D06.1.454.CMB.1.raw
  modified_base (300)..(300): a, c, t, g, unknown or other
  misc_feature (300)..(300): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatggaacggtaaaactgaccaacacaggctatgcagaggcattccgagggcagagtcaccatcggaacccgggaacccctccgaccggcacacgccctacagtggagctgagcgagtcngaccactgaccgacgcggcctctattactgtgccgagacgccgagtaaatgtggtggtacgaacgaaagtgttgggtttcgttttgggttttggtttcgggaccggttagtaaaccggttcggtcggggaccgagggtcctacccgtcggtacctccgtctcctcgacgtcctacccgaccggtaacggccctacgtccggttcccttccccgtgggccccgtccgtcgccgtaccgacggcctccgtaccgcgggtaccggggcaccggcggtcccgggccgtcggccgtcggtcccgtaggtaccgacggttaccctaccgttaccctagtacccg

SEQ ID NO: 241078 - DNA, 515 bp, Homo sapiens
  misc_feature: GYAE6OF02F8U02.18.39.D06.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (333)..(333): a, c, t, g, unknown or other
  misc_feature (333)..(333): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
  modified_base (490)..(515): a, c, t, g, unknown or other
  misc_feature (490)..(515): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggcctctattactgtgcgagagccgngaatatgtggtgcaaagntggtcgttgttttgttttggccggtgaactacgtggggccagggcacccgtggtccaccgtctcctcagtcttaccaccgaacgggcccagtccggtccttcccccgnggccgtcccctgcctccaggcgccaccgtcggtcgggggccacgacggccggcccgtgggcctgcccgtggtccaaagggtcctaccttacccattaccgtcgtacgttggacgtccgggggactcggggacaaggggcccacgaagtacgntancnnnnnnnnnnnnnnnnnnnnnnnnnn

SEQ ID NO: 241079 - DNA, 608 bp, Homo sapiens
  misc_feature: GYAE6OF02HEC6W.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatcgaccgggaacccctccaccggcacagcctacatggagctgagcagtctgacacctgacgacacggccgtctattactgtgcgagacgccgcgaatatgtggtgacaaagatggtcgtttgttttgttttgggccggttgtaacttacgtcggggtccacggggcctacccgtgggtccaccgttctcccgtcacgtccttccgacccgtacgggcccagttcccggtccctttcccccgcggcccgtcccgtcgccctccgacggcgcctacccgtcgtcggggaccacggacggcccggtcccgttggggcccttcggcccgttcgggtccgtaacgggtacccttaccgttcccacgttacccgg

SEQ ID NO: 241080 - DNA, 373 bp, Homo sapiens
  misc_feature: GYAE6OF02IQEN0.18.39.D06.1.454.CMB.1.raw
  modified_base (286)..(286): a, c, t, g, unknown or other
  misc_feature (286)..(286): n is a, c, g, or t
  modified_base (362)..(363): a, c, t, g, unknown or other
  misc_feature (362)..(363): n is a, c, g, or t
  modified_base (365)..(373): a, c, t, g, unknown or other
  misc_feature (365)..(373): n is a, c, g, or t
tcagtacgagtatgcacgaccggtgctcgatttagtgacatctcgcagttctttgggggaagaggaagactgacggtcctcccaggagttcaggtgctgggcaccgtggcagtggggaagtgtgtcacaagatttgggctctgggcaccgtgggcagtgggggagtgtgtcacaagatttgggccagggcaccctggtcaccgtctcctcagcttccgaccaagggccccagtcgtccttccccctggccgccctgcctaccaggagtccacctcgtggggccacncgccggcctgggctgcctggtcaaggtacctacgttcccatcctcgtactgacgtcggctggctaaggctcaatgnntnnnnnnnnn

SEQ ID NO: 241081 - DNA, 383 bp, Homo sapiens
  misc_feature: GYAE6OF02GJFK9.18.39.D06.1.454.CMB.1.raw
  modified_base (360)..(360): a, c, t, g, unknown or other
  misc_feature (360)..(360): n is a, c, g, or t
  modified_base (366)..(371): a, c, t, g, unknown or other
  misc_feature (366)..(371): n is a, c, g, or t
  modified_base (373)..(383): a, c, t, g, unknown or other
  misc_feature (373)..(383): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcatgggggaggtgtgtcacaagatttgggctctgggcaccgtgggcatgggggaggtgtgtcacaagatttgggctctgggcaccctggtcaccgtctcctcagcttccaccaagggcccatccggtcttccccctggccgccctgcctccaggacgccacctctgggggcacgaggccggccctgggcctgcctggtcaaggactacttcccatacctcgtactgagcgggctggcaggcncatagnnnnnncnnnnnnnnnnn

SEQ ID NO: 241082 - DNA, 587 bp, Homo sapiens
  misc_feature: GYAE6OF02FJ78O.18.39.D06.1.454.CMB.1.raw
  modified_base (267)..(267): a, c, t, g, unknown or other
  misc_feature (267)..(267): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (385)..(385): a, c, t, g, unknown or other
  misc_feature (385)..(385): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaaactgccaacacaggctatgcagaggcattccagggcagagtcaccatcgaccgggaacccctccaccggcacngcctacatggagctgagcagtctgacacctgacacacggcctctatactgtgcgagagccgcgaatatggtggtanacaaaagntgggttcgtttggttttggttttcgggccggttnaaccgttacgtgggggaccgaggggtccacccgtcgggtaccaccgtctcctcacgtccttacccaccgaacgggcccaacgttccggtccctttcccccgtcggacccgtccctcggccttccgaggacgccacctcgtcggggcacgacgccgggccctgggcctcggccgtcggaccacggtacctacctccattaccg

SEQ ID NO: 241083 - DNA, 632 bp, Homo sapiens
  misc_feature: GYAE6OF02INA0L.18.39.D06.1.454.CMB.1.raw
tcagtacgagtatgcacgaccggtgctcgatttagtgacatctcgcagttctggggctgaggtgaagaaccctgggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccgagggcagacgtcaccatcggacccggaacccctccgaccggcacacgcctacatggagctgacgcagtctgacaccgtgacgacgacggccgtctattactgtgcgagacgccgacgaattagtggtggtagacaaaaggtgttggttacgttttggttttggttttcgggcccggttagtaaacgttacggtcggggaccgtacgggcctacccgtcggtacctaccgttcctccgtcgacgtccttacccaaccgtaaccggtccctacgttcccggtcccgttccccgtcggcccgtcccgtcgccgtcgacggcgccgaccgtcgtcggggccacgtacggccggtcccgtgggtccgtcggcccgtggtaccgaaccggtacctacccgttaccacgttaccg

SEQ ID NO: 241084 - DNA, 645 bp, Homo sapiens
  misc_feature: GYAE6OF02FKRAG.18.39.D06.1.454.CMB.1.raw
  modified_base (319)..(319): a, c, t, g, unknown or other
  misc_feature (319)..(319): n is a, c, g, or t
  modified_base (354)..(354): a, c, t, g, unknown or other
  misc_feature (354)..(354): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatcgaccgggaacccctccaccggcacagcctacatggagctgagcagtctgacacctgacgacaccggccgtctattacngtgcgagacgccgcgaatagtgtggtgacaaaagnttggtcgtttggttttggttttcgggccggttgaacttcggtggggcaggggccacccgtggtccaccgtctcctccacgtccttaccgaccgtaacgggccctacgttccggttcccgttcccccgtggcccgtccccgtcgcccgtacccgaacggaccgcctacccgttccggtcgggggtaccaaccggacgggcccgggtccccggtcggggtcccttccgggacccggttcgggtacccgaaacgggttacccgtttaccccgttccccgtaacgttaaccccgg

SEQ ID NO: 241085 - DNA, 468 bp, Homo sapiens
  misc_feature: GYAE6OF02FYD0A.18.39.D06.1.454.CMB.1.raw
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (341)..(341): a, c, t, g, unknown or other
  misc_feature (341)..(341): n is a, c, g, or t
  modified_base (455)..(468): a, c, t, g, unknown or other
  misc_feature (455)..(468): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtncaaaagntggtcgttgtttgttttggccggtgaactacgtggggccagggcaccctggtcaccgtctcctcagcttccacagggcccatcggtccttccccnggcnccctgctccaggacncacctcgtcgggggcacgacgccggcccgtggggcctggccgtcggtaccgaacggacttaccttcccattacctcgttacgtggacggcggggcctgggacaaggcgcatagnnnnnnnnnnnnnn

SEQ ID NO: 241086 - DNA, 475 bp, Homo sapiens
  misc_feature: GYAE6OF02IQVV6.18.39.D06.1.454.CMB.1.raw
  modified_base (229)..(229): a, c, t, g, unknown or other
  misc_feature (229)..(229): n is a, c, g, or t
  modified_base (340)..(340): a, c, t, g, unknown or other
  misc_feature (340)..(340): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (454)..(455): a, c, t, g, unknown or other
  misc_feature (454)..(455): n is a, c, g, or t
  modified_base (457)..(475): a, c, t, g, unknown or other
  misc_feature (457)..(475): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaaatatgtggtgacaaaagntggtcgttgttttgttttggccggtgactacgtggggccagggccacccgtggtcaccgttctcctcagccttccaccgaagggccccagtccggtcccttcccctggccnccctgcctccgaggacncacctcggnggggccagnggccggccgtgggctcgcctggtcaacggtcctactcccaatacgtcgtcgtgaggcgggctggacagggcacagtagnncnnnnnnnnnnnnnnnnnnn

SEQ ID NO: 241087 - DNA, 367 bp, Homo sapiens
  misc_feature: GYAE6OF02GVG17.18.39.D06.1.454.CMB.1.raw
  modified_base (344)..(344): a, c, t, g, unknown or other
  misc_feature (344)..(344): n is a, c, g, or t
  modified_base (350)..(367): a, c, t, g, unknown or other
  misc_feature (350)..(367): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggaggtgtgtcacaagatttgggctctgggcaccgtgggcatgggggaggtgtgtcacaagatttgggccagggcaccctggtcaccgtctcctcagcttccaccaagggcccatcggtcttccccctggcgccctgctccaggagcacctcgtgggggcacagccggcccgtgggctgcctggtcaaggactactcccatactcgtactgagcggctggcaaggcncatagnnnnnnnnnnnnnnnnnn

SEQ ID NO: 241088 - DNA, 377 bp, Homo sapiens
  misc_feature: GYAE6OF02HQTY2.18.39.D06.1.454.CMB.1.raw
  modified_base (262)..(262): a, c, t, g, unknown or other
  misc_feature (262)..(262): n is a, c, g, or t
  modified_base (339)..(339): a, c, t, g, unknown or other
  misc_feature (339)..(339): n is a, c, g, or t
  modified_base (346)..(377): a, c, t, g, unknown or other
  misc_feature (346)..(377): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggaggtgtgtcacaagatttggctctggcaccgtgggcatgggggagtgtgtcacaagatttgggccagggcaccctggtcaccgtctcctcagcttccaccagggcccatcggtccttccccctgccgccctgcctccaggacnccacctcgtggggcacagcggcctgggctgctggtcaaggctacctccatactcgactgagcggctggctaaggcgnagtgatnnnnnnnnnnnnnnnnnnnnnnnnnnnnnnnn

SEQ ID NO: 241089 - DNA, 510 bp, Homo sapiens
  misc_feature: GYAE6OF02HH62X.18.39.D06.1.454.CMB.1.raw
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
  modified_base (477)..(478): a, c, t, g, unknown or other
  misc_feature (477)..(478): n is a, c, g, or t
  modified_base (482)..(483): a, c, t, g, unknown or other
  misc_feature (482)..(483): n is a, c, g, or t
  modified_base (486)..(510): a, c, t, g, unknown or other
  misc_feature (486)..(510): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattacngtgcgagagccgngaatatgtggtgacaaaagntggtcgttgtttgtttggccggtgaactactggggccagggccacccgtggtccaccgtctcctcgacgcttccaccgaagggccccagtccggtccttccccctgggcccgcccctgccttcccgagggacgccaccctcggtacgggggccacgaggccggcccgtggggctcggcctggtacaacggactacttcccatacctcgtacgtgacggcggactgggacaagggtccncgaatagngtnnacgnnacnnnnnnnnnnnnnnnnnnnnnnnnn

SEQ ID NO: 241090 - DNA, 697 bp, Homo sapiens
  misc_feature: GYAE6OF02H9E94.18.39.D06.1.454.CMB.1.raw
  modified_base (142)..(142): a, c, t, g, unknown or other
  misc_feature (142)..(142): n is a, c, g, or t
  modified_base (229)..(229): a, c, t, g, unknown or other
  misc_feature (229)..(229): n is a, c, g, or t
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtncgacaggccagtggacaagggctcgagtggatgggatggatgaacggtaaaactgccaacacaggctatgcagaggcattccagggnagagtcacatgacccggaacccctccaccggcacacgcctacatgganctgancagtcngacacctgaccgacacggccgtactacttacgtgtcgcgaggacgccgacgaatacgtggtggtgacgaaaagtgtagggttcgtttgttttggttttcgggccggttagtaaccgttcggtcggggacccgaggggcccctaaccggtcggtaccgtacccgtccttaccgtcgtacggtccttacccgaacccggtaacggcccctacgtcccggtttcccttccccgtcgggtccccgtacccgtcgcccgttcccggaacggtccgccctaacccgttcgggtccggggacccaccggtaccgggccccgggtacccggtcggggtaccgttccggtcccggtttacgggtacccggtaaacggttaccccctttaaccccgtttacccgtacgtttaacccggg

SEQ ID NO: 241091 - DNA, 757 bp, Homo sapiens
  misc_feature: GYAE6OF02FLLNY.18.39.D06.1.454.CMB.1.raw
  modified_base (344)..(344): a, c, t, g, unknown or other
  misc_feature (344)..(344): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaaacggtaaaactgaccaacacaggctatgcagaggctattccgagggcagagtcaccataccggaccggaacccctccgaccggcacagcctacagtggagctgagcagtctagaccaccgtacggaaccgaccgaccggtccgttacgttacttacgngtcggacgagacgccgaagaatacgtggtaggtacgaacgtaaaggtgtttcggtttcgttttggttttcggttttcgggaccggtacgtaaccgttcggggacgggtacccggtaacgggtccctaacccggtcgggttaccctacccggttcccttccgtaccgtacgttcccgttaacccaaccgggtaacccggtcccctaacgttccccgggtttcccccttacccggccggtcccgtaccccgtcgtaccccgtaccggacggtaccgccccgtaccggtccgggtaccgggcccaaccggcccggggtcccgggtaccccggtccgggtccgttcccgggtaccgttaccggggtaaccgtaaccgttaccccgtttaaccccgttaccgtaacgtttaccccggg

SEQ ID NO: 241092 - DNA, 705 bp, Homo sapiens
  misc_feature: GYAE6OF02GR8L1.18.39.D06.1.454.CMB.1.raw
  modified_base (354)..(354): a, c, t, g, unknown or other
  misc_feature (354)..(354): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatcgaccgggaacccctccaccggcaccagcctacatggagctgagcagtctgacacctgaccgacaccggccgtctattactgtgcgagacgccgcaatactgtggtgacaaagngttgggtcgtttgttttggttttcgggccggttagaaccgttacgtggggtacccgacgggtccacccgtcggtaccgaccgtcctcccgtcgacgtccttaccgacccgtaacgggcccctacgttccggttaccctttcccccgtcggtacccctacccccgttacccgtaccccgaaacggtaccgtacccgtaccccgtccggttaccgggggggaccctacccggaccgggtacccgggtcccccggttacgggggtcccttaccgggtccccgttacggggttacccgtaaaccgggtaaccctttaacccgttacccccgtaacgttaaccccgtttacccggg

SEQ ID NO: 241093 - DNA, 718 bp, Homo sapiens
  misc_feature: GYAE6OF02H4LZJ.18.39.D06.1.454.CMB.1.raw
  modified_base (251)..(251): a, c, t, g, unknown or other
  misc_feature (251)..(251): n is a, c, g, or t
  modified_base (347)..(347): a, c, t, g, unknown or other
  misc_feature (347)..(347): n is a, c, g, or t
tcagtacgagtatgcacgaccggtgctcgatttagtgacatctcggcagttctggggctggaggtgaagaaccctggggcctcagtgaaggtctcctgtcagacctatggacttccccttccagtaattttgatatccagttgggtgcgacacggccagtggacaagggctcgagtggatgggatggatagaacggtaaaactgaccaacacgaggctatgcagagcacttccgaggcagacgtacaccanacgacccggaaccctccgaccggacacacgacctacagtacggacgtcgtgacgcgtagtctacgactacgtacgacgacgaccggctctattcgngtcgacgtagacgcgacgtatacgtgtcggtacgacgaaacgtgttacggttggttttaggttttcggtttcgggtacggtacgtaaacgttacgggtcggggacccggtacgggacccgtacccggtcggtacctcccggtcctctacgtcgtcctaccgtacggaacggtcccttacgttcccggtacccttcccggtagggcccgtcccgtacgggtaccctacggaccggtacgtccgttaccggtccggggtacggggtaccaccggtaccggggtccccgggtaccggttccggggtcggtttacccgccggttacgggtaacggaacccgtttacccgttacccgttaccccgtattaccccgg

SEQ ID NO: 241094 - DNA, 510 bp, Homo sapiens
  misc_feature: GYAE6OF02IQX9Y.18.39.D06.1.454.CMB.1.raw
  modified_base (229)..(229): a, c, t, g, unknown or other
  misc_feature (229)..(229): n is a, c, g, or t
  modified_base (479)..(479): a, c, t, g, unknown or other
  misc_feature (479)..(479): n is a, c, g, or t
  modified_base (481)..(510): a, c, t, g, unknown or other
  misc_feature (481)..(510): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgcgaaatatgtaggtgacaaaagnttggtcgtttgttttgttttggccggttgaactactggggccagggcaccctggtccaccgtctcctcagcttccaccgaagggcccatccggtccttccccctggccgcccctgccttccgaggagccacccgtcgtcgggggccacgacggccgggcccgtggggcctcgcccgttgggtccaacgggaccttaccgttccccattacctcgtactggacgcgggtctgggacaaggcgactagtagngnnnnnnnnnnnnnnnnnnnnnnnnnnnnnn

SEQ ID NO: 241095 - DNA, 744 bp, Homo sapiens
  misc_feature: GYAE6OF02HOI9A.18.39.D06.1.454.CMB.1.raw
  modified_base (274)..(274): a, c, t, g, unknown or other
  misc_feature (274)..(274): n is a, c, g, or t
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
tcagtacgagtatgcacgaccggtgctcgatttagtgacatctcgcagttctggggctgaggtgaagaaccctggggcctcagtgaaggtctcctgtcagacctatggattcccttccagaattttgatatccattgggtgcgacaggccagtggacaagggctcgagtggatgggatggatgaacggtaaaactgaccaacacaggctatgcagaggcattccagggcagagtcacatgaccggaaccctccacggcacagcctacatggacnctgagcagtctgacacctgacgacacggcctctacttacngtgcgagagccgngaaatntggtagtcgagaaaagtgtcgggttacgtttggttttacggttttcgggacccggttagtaaccgttacggttgggggaccccgtaagggggtccctaaccccggttggggttaccctacccgggttccttcccgtacgtaccgtcctttaaccccgaacccggtaaacgggtaccccctaaggtttccccgggtttacccctttccccccggtggggtacccccgtccccgtcggacccttacccgggaggtaacccgccgtaacccgtccgggtacgggggaccctaaccgggaccggtcccggggtaccccgttgggggaccctttccggggaccccgtttggggtaaaccccgtaaaccggggtttacccctttaacccgtttaccccggaacgttttaaccccggg

SEQ ID NO: 241096 - DNA, 489 bp, Homo sapiens
  misc_feature: GYAE6OF02H440X.18.39.D06.1.454.CMB.1.raw
  modified_base (167)..(167): a, c, t, g, unknown or other
  misc_feature (167)..(167): n is a, c, g, or t
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (319)..(319): a, c, t, g, unknown or other
  misc_feature (319)..(319): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (459)..(489): a, c, t, g, unknown or other
  misc_feature (459)..(489): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaaccctccaccggcacagcctacatgagctgagcagtctganacctgacacacgccgtctattactgtgcgaganccgactaatatgtggtgacaaaagtntggtcgtttgttgttttggcggtgactacgtgggcgaggcaccgtgtcacgtctcctcagcttccacgtacggcctatcgtcctacccctgcncctgctcgagacncgaccngtgggcacacgtcggccctgggctcgtaccgtggactaaacggaccttacttaccccgacttacgttcctaacgttggaaaccgcgggtaccgtcggtacgaacggccgacctagatcgannnnnnnnnnnnnnnnnnnnnnnnnnnnnnn

SEQ ID NO: 241097 - DNA, 432 bp, Homo sapiens
  misc_feature: GYAE6OF02JLKL4.18.39.D06.1.454.CMB.1.raw
  modified_base (217)..(217): a, c, t, g, unknown or other
  misc_feature (217)..(217): n is a, c, g, or t
  modified_base (255)..(255): a, c, t, g, unknown or other
  misc_feature (255)..(255): n is a, c, g, or t
  modified_base (385)..(392): a, c, t, g, unknown or other
  misc_feature (385)..(392): n is a, c, g, or t
  modified_base (394)..(432): a, c, t, g, unknown or other
  misc_feature (394)..(432): n is a, c, g, or t
tcagtacgagtatgcacgaccggtgctcgatttagtgacatctcgcagttctttgggggggaagaggaagactgacggtcctcccaggagttcaggtgctgggcaccgtgggcagtgggggaggtgtgtcacaagatttgggctctgggcaccgtgggcagtgggggaggtgtgtcacaagatttgggccagggccaccctggtcaccgtctcctcngcttccaccaagggcccatcggtccttccccctggccnccctgcctccgaggagccacctcggtcgggggcaccgagccggccctgggctgcctggtcaaggaccttactcccgataccgtcgtacgtcgaggccgggctagggacaaggggtccacgtacgtagcgnnnnnnnncnnnnnnnnnnnnnnnnnnnnnnnnnnnnnnnnnnnnnnn

SEQ ID NO: 241098 - DNA, 497 bp, Homo sapiens
  misc_feature: GYAE6OF02GMLFO.18.39.D06.1.454.CMB.1.raw
  modified_base (226)..(226): a, c, t, g, unknown or other
  misc_feature (226)..(226): n is a, c, g, or t
  modified_base (482)..(497): a, c, t, g, unknown or other
  misc_feature (482)..(497): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgcgaatatgtggtgacaaagntggtcgttgtttgttttggcggtgaactacgtgggccagggccacccgtggtccaccgtcctcctcacgtccttccaccgaacgggcccagtccggtccttcccccgtcggccgcccctcggcctccgaggacgccgtaccctcggtcgggggccacgacggccggcccgtgggctcgccgtggtacaaggtacctaccttcccattaccttccgtacgtggacggcgggtcgtcggacgaacggcgtcgagtagnnnnnnnnnnnnnnnn

SEQ ID NO: 241099 - DNA, 368 bp, Homo sapiens
  misc_feature: GYAE6OF02HAXLS.18.39.D06.1.454.CMB.1.raw
  modified_base (351)..(351): a, c, t, g, unknown or other
  misc_feature (351)..(351): n is a, c, g, or t
  modified_base (357)..(358): a, c, t, g, unknown or other
  misc_feature (357)..(358): n is a, c, g, or t
  modified_base (360)..(368): a, c, t, g, unknown or other
  misc_feature (360)..(368): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggaggtgtgtcacaagatttgggctctgggcaccgtgggcatggggggaggtgtgtcacaagatttgggccagggcaccctggtcaccgtctcctcagcttccaccaagggcccatcggtccttcccctggccgccctgcctccaggacgcacctcgtgggggccacaggccggccctgggctcgcctggtcaaggactacttcctatactcgtactgagcgggctggcaggcncatagnngnnnnnnnnn

SEQ ID NO: 241100 - DNA, 397 bp, Homo sapiens
  misc_feature: GYAE6OF02H7K8S.18.39.D06.1.454.CMB.1.raw
  modified_base (385)..(397): a, c, t, g, unknown or other
  misc_feature (385)..(397): n is a, c, g, or t
tcagtacgagtatgcacgaccggtgctcgatttagtgacatctcgcagttctttggggggaagaggaagactgacggtcctcccaggagttcaggtgctgggcaccggtgggcatgggggaggtgtgtcacaagatttgggctctgggcaccgtgggcagtggggggaggtgtgtcacaagatttgggccagggccaccctggtcaccgtctcctcagcttccaccaagggcccatccggtccttccccctggccgccctcgctccaggacgccacctcgtgggggcaccgagccggcccgtgggctcggcctgggtcaacggtacctaccttccccacttacttccgtactggacgccgggcgtcggacgaagggcgacatagnnnnnnnnnnnnn

SEQ ID NO: 241101 - DNA, 808 bp, Homo sapiens
  misc_feature: GYAE6OF02JL755.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaaacggtaaactgaccaacacaggctatgcagaggcagttccgagggcagagtcaccagtcgacccgggaacccctccgaccggcacacgccttacatcggacgcgtgagcagtctacgacacctacgaccgacgacgtccgtactagttaccgtgcgtcgacgacggccgtacgaatagtcggtggtcgaacgtaaagtacggttcggttgttttcgttttgggttttacggggcccgggttactaacggttaccggtgggggaccccgtcggggtaacccgtaaccccggttgggtaccccgtacccggtttaccgttccccgtaccgtaaccggttcccgttaacccggaaccccgaccgggggtacccccttaagggtttcccccgggtttacccccgtttcccccggcgggtaccccgtcccccgtttaccgggacccttacccggggacggacccgtaccctaacccgggtttccggggacccggggtacccaccgggtacccggtaccccgggggtcccgttccggggaccgtttcccgggaccccgggttaccggttaacccgggtaaccggttaacccgggttttccccccttacggtaacccgtttacccccgg

SEQ ID NO: 241102 - DNA, 431 bp, Homo sapiens
  misc_feature: GYAE6OF02F6F6S.18.39.D06.1.454.CMB.1.raw
  modified_base (324)..(324): a, c, t, g, unknown or other
  misc_feature (324)..(324): n is a, c, g, or t
  modified_base (358)..(363): a, c, t, g, unknown or other
  misc_feature (358)..(363): n is a, c, g, or t
  modified_base (367)..(367): a, c, t, g, unknown or other
  misc_feature (367)..(367): n is a, c, g, or t
  modified_base (371)..(372): a, c, t, g, unknown or other
  misc_feature (371)..(372): n is a, c, g, or t
  modified_base (375)..(378): a, c, t, g, unknown or other
  misc_feature (375)..(378): n is a, c, g, or t
  modified_base (380)..(380): a, c, t, g, unknown or other
  misc_feature (380)..(380): n is a, c, g, or t
  modified_base (382)..(389): a, c, t, g, unknown or other
  misc_feature (382)..(389): n is a, c, g, or t
  modified_base (391)..(431): a, c, t, g, unknown or other
  misc_feature (391)..(431): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggagtgtgtcacaagatttgggctctgggcaccgtgggcatgggggaggtgtgtcacaagatttgggccagggcaccctggtcaccctctcctcagcttccaccaagggcccatcggtcttccccctggccgcccctgcctccaggagccacctcgtggggcacagccggccctgggctgccgtggtcaaggctacttcccataccncgtactgagcggcctggcaaggcgactagtagcnnnnnngtcncgcnngannnngngnnnnnnnncnnnnnnnnnnnnnnnnnnnnnnnnnnnnnnnnnnnnnnnnn

SEQ ID NO: 241103 - DNA, 227 bp, Homo sapiens
  misc_feature: GYAE6OF02HZOQU.18.39.D06.1.454.CMB.1.raw
  modified_base (218)..(218): a, c, t, g, unknown or other
  misc_feature (218)..(218): n is a, c, g, or t
  modified_base (223)..(227): a, c, t, g, unknown or other
  misc_feature (223)..(227): n is a, c, g, or t
tcagtacgagtatgcacgaccggtgctcgatttagtgacatctcgcagttctttgggttttgggggaagaggaagactgacggtcctcccaggagttcaggtgctgggcaccgtgggcatgggggagtgtgtcacaagatttgggctctgggcacagcggccctgggctgcctggtcaaggctacttccatactcgtactgagcgggctggcaaggcnatagnnnnn

SEQ ID NO: 241104 - DNA, 484 bp, Homo sapiens
  misc_feature: GYAE6OF02FYKL8.18.39.D06.1.454.CMB.1.raw
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (329)..(329): a, c, t, g, unknown or other
  misc_feature (329)..(329): n is a, c, g, or t
  modified_base (345)..(345): a, c, t, g, unknown or other
  misc_feature (345)..(345): n is a, c, g, or t
  modified_base (452)..(484): a, c, t, g, unknown or other
  misc_feature (452)..(484): n is a, c, g, or t
tcagtacgagtatgcacgaccggtgctcgatttagtgacatctcgagtggatgggatggactgaacggtaaaacctgccaacacaggctatgcagaggcattccagggcagagtcaccatgaccgggaacccctcaccggcacagccttacatggagcttgagcagtctgacacctgacgacacgggccgtctattacgtgtgcgagagccgnggaatntgtggtncaaagntggtcgtttgtttgtttggccggtgaactactggggccagggcaccctggtcaccgtctcctcagcttccaccaaggcccatcgtcttcccctggcnccctgctccaggtacncacctcgtggggcaacgagcggccctcgggcttcggccgttggtacgaacggacttaccttcccatacctccgtacgtcggagcgggctacggcaaggcgcatacgnnnnnnnnnnnnnnnnnnnnnnnnnnnnnnnnn

SEQ ID NO: 241105 - DNA, 400 bp, Homo sapiens
  misc_feature: GYAE6OF02GNFT4.18.39.D06.1.454.CMB.1.raw
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (383)..(400): a, c, t, g, unknown or other
  misc_feature (383)..(400): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcatgggggaggtgtgtcacaagatttgggctctgggcaccgtgggcatgggggaggtgtgtcacaagatttgggctctgggccaccctggtccaccgtctcctcagcttccaccaagggcccatccggtccttcccccgtggccgcccctgcctccaggacnccacctcgtggggcacgngccggccgtgggctcggcctggtcaaggtactcttcccataccgtcgtactggacgccgggactcgggacaacgggcgacatagnnnnnnnnnnnnnnnnnn

SEQ ID NO: 241106 - DNA, 401 bp, Homo sapiens
  misc_feature: GYAE6OF02JKAKD.18.39.D06.1.454.CMB.1.raw
  modified_base (362)..(362): a, c, t, g, unknown or other
  misc_feature (362)..(362): n is a, c, g, or t
  modified_base (373)..(401): a, c, t, g, unknown or other
  misc_feature (373)..(401): n is a, c, g, or t
tcagtacgagtatgcacgaccggtgctcgatttagtgacatctcgcagttctttgggggagaggaagactgacggtcctcccacggagttcaggtgctgggcaccgtgggcatggggaggtgtgtcacaagattgggctctgggcaccgtgggcatgggggaggtgtggtcacaagatttgggccagggcaccctggtcaccgtctccctcagcttccaccaagggcccatcggtcttccccctggccgcccctgctcccaggacgcacctctcgggggcaccagccggcccctggggcctggccctggtcaagggacctacgttccccatacctcgtactgacgcgggctgggcaaggtcnccagtagctgnnnnnnnnnnnnnnnnnnnnnnnnnnnnn

SEQ ID NO: 241107 - DNA, 185 bp, Homo sapiens; identical to SEQ ID NO: 241006
  misc_feature: GYAE6OF02HWOLH.18.39.D06.1.454.CMB.1.raw
  modified_base (181)..(185): a, c, t, g, unknown or other
  misc_feature (181)..(185): n is a, c, g, or t

SEQ ID NO: 241108 - DNA, 596 bp, Homo sapiens
  misc_feature: GYAE6OF02JBPFQ.18.39.D06.1.454.CMB.1.raw
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaactgccaacacaggctatgcagaggcattccgagggcagagtcaccatcgaccgggaacccctccgaccggcacagcctanagtgganctgagcagtctgacacctgacgacacggcctctattactgtgcgagcgccgacgaatgtgtggtnacaaagnttggtcgtttgtttggtttcggccgtagtaacgtcgtcggggaccagggcctacccgtggtccaccgttcctcctcgacgtccttccaccgacggccctacgtccgtcccgttccccgcggcccgtcccgtgtcccgtccgacggcgccctaccgtcggtcggggccacggacggccggtcccggtcgggccgtcgtacccggttggtaccgacggtacccttacccgttacccgtactacccg

SEQ ID NO: 241109 - DNA, 532 bp, Homo sapiens
  misc_feature: GYAE6OF02GL822.18.39.D06.1.454.CMB.1.raw
  modified_base (463)..(463): a, c, t, g, unknown or other
  misc_feature (463)..(463): n is a, c, g, or t
  modified_base (514)..(532): a, c, t, g, unknown or other
  misc_feature (514)..(532): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagacgccgcgaatagtgtggtgacaaagtatgggttcgtttgttttggttttggccggttgaacctacgtcggggaccgaggggccacccgtgggtccaccgtctccctcgacgtccttaccacccgaacggggcccaacgttccgggttccctttccccccgtgggcccgccccttggccctccgaggacgcctacccgtcggcgggggccacgacggccggcccgtgggctcgccgtggacgtaagtaccttacctacccnttacctcgttactggtacgggccgggtcgtacggcaagggcacgataggcnnnnnnnnnnnnnnnnnnn

SEQ ID NO: 241110 - DNA, 478 bp, Homo sapiens
  misc_feature: GYAE6OF02JFJM8.18.39.D06.1.454.CMB.1.raw
  modified_base (229)..(229): a, c, t, g, unknown or other
  misc_feature (229)..(229): n is a, c, g, or t
  modified_base (293)..(293): a, c, t, g, unknown or other
  misc_feature (293)..(293): n is a, c, g, or t
  modified_base (454)..(478): a, c, t, g, unknown or other
  misc_feature (454)..(478): n is a, c, g, or t
tcagtacgagtatgcacgaccggtgctcgatttagtgacatctcgagtgggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgacgaatagtgtggtgacaaagntggtcgttgtttgtttggccggtgaactcgtggggccagggccaccctggtcaccgtctcctcngcttccaccgaacgggcccagtccggtccttcccccgtggccgccctgccctccgaggacgccaccgtcgtcgggggcacgacggccggcccgtgggctcgccgtggacaaggactaccttccatactcgtactgacggcgggtctggacacggcgcatgnnnnnnnnnnnnnnnnnnnnnnnnn

SEQ ID NO: 241111 - DNA, 703 bp, Homo sapiens
  misc_feature: GYAE6OF02FTS27.18.39.D06.1.454.CMB.1.raw
  modified_base (357)..(357): a, c, t, g, unknown or other
  misc_feature (357)..(357): n is a, c, g, or t
tcagtacgagtatgcacgaccggtgctcgatttagtgacatctcgcagttctggggctgaggtgaagaacccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatcgacccggaacccctccaccggcacagcctacatggagctgagcagtctgacacctgacgacacggccgtctattactgtgcgagacgccgacgaatagtggtggtgacgaaaagngttggttcgtttggttttggttttcgggccggttagaacgttacggtcggggacccaggggcctaccccggttggtaccctacccggttcctcccgttccgacgtcccttcccgaacccgtaacgggcccctaacgttcccggtttacccctttcccccgtgggtaccccgtccccgtcggtcccgttacccgacgggacgccctacccgttccgggtccgggggacccaaccggacgggtccccgggtaccccggttcggggacccttccgggtccccggttacgggttacccggtaaaccgggttaccctttaacccggtttaccccgtaacgtttaaccccgg

SEQ ID NO: 241112 - DNA, 234 bp, Homo sapiens
  misc_feature: GYAE6OF02ITZLD.18.39.D06.1.454.CMB.1.raw
  modified_base (228)..(234): a, c, t, g, unknown or other
  misc_feature (228)..(234): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcatgggggaggtgtgtcacaagatttgggctctgggcacagcggccctgggctgcctggtcaaggactacttcccatactcgtactgagcgggctggcaaggcgcatagnnnnnnn

SEQ ID NO: 241113 - DNA, 446 bp, Homo sapiens
  misc_feature: GYAE6OF02GV3VB.18.39.D06.1.454.CMB.1.raw
  modified_base (194)..(194): a, c, t, g, unknown or other
  misc_feature (194)..(194): n is a, c, g, or t
  modified_base (228)..(228): a, c, t, g, unknown or other
  misc_feature (228)..(228): n is a, c, g, or t
  modified_base (338)..(338): a, c, t, g, unknown or other
  misc_feature (338)..(338): n is a, c, g, or t
  modified_base (424)..(424): a, c, t, g, unknown or other
  misc_feature (424)..(424): n is a, c, g, or t
  modified_base (430)..(446): a, c, t, g, unknown or other
  misc_feature (430)..(446): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattacngtgcgagagcccgcgaatatggtggtgacaaagntggtcgttgtttgtttggcggtgaactactggggccagggcacctggtcaccgtctcctcagcttccaccaagggcccatcggtcttccccctggcgccctgctccaggngcacctctgggggccacacggcggccctgggctcgcctggtcaaggtacctacttcccatactcgtactgacgcggctggcaggcncatagnnnnnnnnnnnnnnnnn

SEQ ID NO: 241114 - DNA, 476 bp, Homo sapiens
  misc_feature: GYAE6OF02GUNLJ.18.39.D06.1.454.CMB.1.raw
  modified_base (227)..(227): a, c, t, g, unknown or other
  misc_feature (227)..(227): n is a, c, g, or t
  modified_base (458)..(476): a, c, t, g, unknown or other
  misc_feature (458)..(476): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaaagntggtcgttgtttggttttggccggtgaactacgtggggccagggcacctggtcaccgtctcctcagcttccaccgaacgggcccagtccggtccttcccccgtggccgccctcgcctccgaggacgccaccgtcgtcgggggcacgacgccggccctggtcatcgccgtggtacaacggtactacttcccattactcgtactggacggcgggctggcaaggcgacagtagnnnnnnnnnnnnnnnnnnn

SEQ ID NO: 241115 - DNA, 679 bp, Homo sapiens
  misc_feature: GYAE6OF02JIVDM.18.39.D06.1.454.CMB.1.raw
  modified_base (637)..(637): a, c, t, g, unknown or other
  misc_feature (637)..(637): n is a, c, g, or t
  modified_base (644)..(644): a, c, t, g, unknown or other
  misc_feature (644)..(644): n is a, c, g, or t
  modified_base (648)..(648): a, c, t, g, unknown or other
  misc_feature (648)..(648): n is a, c, g, or t
  modified_base (652)..(652): a, c, t, g, unknown or other
  misc_feature (652)..(652): n is a, c, g, or t
  modified_base (656)..(656): a, c, t, g, unknown or other
  misc_feature (656)..(656): n is a, c, g, or t
  modified_base (659)..(679): a, c, t, g, unknown or other
  misc_feature (659)..(679): n is a, c, g, or t
tcagtacgagtatgcacgaccggtgctcgatttagtgacatctcgagtggatgggatggatgaacggtaaactgccaacacaggctatgcagaggcattccagggcagagtcaccatgaccgggaacccctcaccggcacagcctacatggacgctgacgcagtctgacacctgacacgaccggccttctagttactgtggcgtaggacgtccggacgtaattattggtggtgacgaaaaagtgttgggttaccgttttgtttttggttttcgggacccggttgtaaactcggttcggggtacccgagggtccacccgttcggtccgtacccggtcttcccgtccgaccggtccttacccgacccgaaccgggtccaccgtttccggggttccccctttaccccccggtcgggtcccgtcccccgttaggtccccttcccggaaggtaccgtcccgtacccgttcgggtcgggggaccctaacacccgggcccggtcccggttggggtacccgttcggccccgtttaggggtacccgaacgggttaccccgttacttcccccgaactttaccgttccggttaacggtcgtacggggcccggttcggtggacccggaagcccgggctaacgtcgggtncgcgtcngacngcgncgtnagnnnnnnnnnnnnnnnnnnnnn

SEQ ID NO: 241116 - DNA, 697 bp, Homo sapiens
  misc_feature: GYAE6OF02JI528.18.39.D06.1.454.CMB.1.raw
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
  modified_base (622)..(622): a, c, t, g, unknown or other
  misc_feature (622)..(622): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
  modified_base (673)..(673): a, c, t, g, unknown or other
  misc_feature (673)..(673): n is a, c, g, or t
  modified_base (691)..(691): a, c, t, g, unknown or other
  misc_feature (691)..(691): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacacacggccgtntattactgtgcgagagccgcgaaatntggtggtagacaaaagnttggttcgtttgtttgttttcggccggttgaactacgtggggccagggccaccctggtccaccgtctcccttcagtccttccacgtaacgggccctacgtccggttccctttcccccgtggcccgtccccgtcggtacccttcccgaaggggtaccgacccgtacccgtaccggttggggggacccaaccgacgggtccccggggcccgttagggggcccttcggacccgttcggggttaccgaaacgggttaaccctttacccgtttacccccgtaaagtttacccgttacccggttaaccggttagggaaccggggtcccgggggtaccttaccgggggaacggtaaaacccgggggttccgaaacccgtaacgtttaaccgggcttacngccgaaggtcgcttacgtcgcncngacgacgcgtacgtcgctacgtcgtcncgcgcgcgcgacgcagcncgtgcg

SEQ ID NO: 241117 - DNA, 232 bp, Homo sapiens
  misc_feature: GYAE6OF02HM4E4.18.39.D06.1.454.CMB.1.raw
  modified_base (225)..(232): a, c, t, g, unknown or other
  misc_feature (225)..(232): n is a, c, g, or t
tcagtacgagtatgcacgaccggtgctcgatttagtgacatctcgcgagttctttgggtttgggggaagaggaagactgacggtcctcccaggagttcaggtgctgggcaccgtgggcatggggaggtgtgtcacaagatttgggctctgggcacagcggccctgggctgcctggtcaaggctacttcccatactcgtactgagcgggctggcaaggcgcatagnnnnnnnn

SEQ ID NO: 241118 - DNA, 392 bp, Homo sapiens
  misc_feature: GYAE6OF02ILRNE.18.39.D06.1.454.CMB.1.raw
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (291)..(291): a, c, t, g, unknown or other
  misc_feature (291)..(291): n is a, c, g, or t
  modified_base (351)..(351): a, c, t, g, unknown or other
  misc_feature (351)..(351): n is a, c, g, or t
  modified_base (358)..(359): a, c, t, g, unknown or other
  misc_feature (358)..(359): n is a, c, g, or t
  modified_base (361)..(361): a, c, t, g, unknown or other
  misc_feature (361)..(361): n is a, c, g, or t
  modified_base (367)..(392): a, c, t, g, unknown or other
  misc_feature (367)..(392): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcatgggggaggtgtgtcacaagatttgggctctgggcaccgtgggcatgggggagtgtgtcacaagatttgggctctgggcacccgtggtcaccgtctcctcagcttccaccaagggccccagtcggtccttcccctggccnccctgctcnggacncacctctgggggcacgngcgccctgggctgcctggtcaggctactccatctcgtactgagcgggctggcaagggccncagtagnngnactgcnnnnnnnnnnnnnnnnnnnnnnnnnn

SEQ ID NO: 241119 - DNA, 567 bp, Homo sapiens
  misc_feature: GYAE6OF02F7CNQ.18.39.D06.1.454.CMB.1.raw
  modified_base (488)..(488): a, c, t, g, unknown or other
  misc_feature (488)..(488): n is a, c, g, or t
tcagtacgagtatgcacgaccggtgctcgatttagtgacatctcgcagttctttgggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagccctacatggagctgagcagtctgaccacctgacgacacggccgtctattactgtgcggagacgccgcgaaatatggtggtgacaaaggatggtcgtttgtttgttttgggccggtgaactcgtggggccagggccacccgtggtcaccgtctcctcacgcttccaccgaacgggccccagtccggtcctttcccctcggcctcccctgcctccgaggacncacctcgtcgggccacgacggccggcccgtcggggctcgcccgttggtaccgaacggtacctaccttccccgattaccg

SEQ ID NO: 241120 - DNA, 706 bp, Homo sapiens
  misc_feature: GYAE6OF02INPRW.18.39.D06.1.454.CMB.1.raw
  modified_base (232)..(232): a, c, t, g, unknown or other
  misc_feature (232)..(232): n is a, c, g, or t
  modified_base (634)..(634): a, c, t, g, unknown or other
  misc_feature (634)..(634): n is a, c, g, or t
  modified_base (643)..(643): a, c, t, g, unknown or other
  misc_feature (643)..(643): n is a, c, g, or t
tcagtacgagtatgcacgaccggtgctcgatttagtgacatctcgagtggatgggatggatgaacggtaaaaactgccaacacaggctatgcagaggcattccagggcagagtcaccatcgaccgggaacccctccaccggcacagcctacatggagctgagcagtctgacacctgacacacggccgtctattactgtgcgagagccgcgaaatagtgtggtgacaaaagtntgggttcgtttggttttggttttcggccggttagaaccttacgtgggggccgagggcctaccccgtggtaccaccggtctccctcacgtccttaccgaaccgaacgggtcccacgttccggttcccctttacccccgtcggtcccgtccccgttgaccttccgaagggaccggtctaacccgtccggtcgggggacctaaccggacggccgggtccccgttaggggcccgttacggtcccgttacgggttaaccgaaaaccgggtaacctttaacccgtttaccccgtaaacgtttaacccgttaccggttaaccggttacgggtaccgggtcccgggggtaccgttcgggaacccgtaaacggggtcccgaacgttaacgttacgcgtagactcgtctagngtcgtaccngtcgacgtcgaagtccagcgtactgctcacggtattccgagcacgtacgtacgcacgtacgtg

SEQ ID NO: 241121 - DNA, 662 bp, Homo sapiens
  misc_feature: GYAE6OF02JXWG2.18.39.D06.1.454.CMB.1.raw
  modified_base (143)..(143): a, c, t, g, unknown or other
  misc_feature (143)..(143): n is a, c, g, or t
  modified_base (349)..(349): a, c, t, g, unknown or other
  misc_feature (349)..(349): n is a, c, g, or t
tcagtacgagtatgcacgaccggtgctcgatttagtgacatctcgcagttctttgggctgaggtgaagaaccctggggcctcagtgaaggtctcctgtcagacctatggattccccttccagaattttgatatccattgggtncgacaggccagtggacagggctcgagtggatgggatggatacgaaacggtaaactgaccaacacgaggctatgcgagaggcattccgagggcagacgtcaccagtcggacccgggaacccctcgaccggcacacgcctacagtggagcctagacgccgtagtcgtcgaccaccgtcgaccgacgcccggtacctatacgttaccgngtcgcgagacgcgacgaaatgtcggttgacgagtaaacgtgttggttcgtttagttttggtttcgggcccggtataacgtcggttggggcccgtaggcccctacggtcggtcctaccggttcctaccgtcgtacgtccgttacccgaccgacgggtccctacgttccggtccccttcccggacgtcccgtacctcgtaccgccggtaaggaccgtccctacgttcccgggggtacccacggtccggcccgggtccggtcggacccgttccgaccgttcggtacctacggtacctacccgttaccctacgttcc

SEQ ID NO: 241122 - DNA, 711 bp, Homo sapiens
  misc_feature: GYAE6OF02HNEKJ.18.39.D06.1.454.CMB.1.raw
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
  modified_base (421)..(421): a, c, t, g, unknown or other
  misc_feature (421)..(421): n is a, c, g, or t
tcagtacgagtatgcacgaccggtgctcgatttagtgacatctcgcaggttctggggctgaggtgaagaaccctggggcctcagtgaaggtctcctgtcagacctatggattccccttccagaattttgatatccattgggtgcgacgaggccagtggacaagggctcgagtggatgggatggatgaacggtaaaactgaccaaacacaggctatgcagaggcattccgagggcagacgtcaccatcggacccggtaacccctccgaccggcacacgacctanacgtggagctgancagtctagaccaccgtgacgaccgtaccggtccgtactatttacgtgtcgcgaacgacgccgacgaaattcgtaggtggtacgacaaagtgttggttcgttttgttttggtttcggaccggttanaaccgttcggtcggggcccgtagggtcctacccgtgggcctaccgtctccgtacgacgtcctaccgaaccgaccggtccctacgtcccggttacccttccccgcggtcccgtcccgtagtcccgtaccggtaacgggccgtacccgtaccgggttaccgggtccgggggaccctaaccgggtaccgggtccccgggtcccggttcggggtacccttccgggtacccggtttacgggaaacccgtaacccgggttaacccttaaccccggttacccctaacgttaccccgg

SEQ ID NO: 241123 - DNA, 596 bp, Homo sapiens
  misc_feature: GYAE6OF02HTUDH.18.39.D06.1.454.CMB.1.raw
  modified_base (155)..(155): a, c, t, g, unknown or other
  misc_feature (155)..(155): n is a, c, g, or t
  modified_base (195)..(195): a, c, t, g, unknown or other
  misc_feature (195)..(195): n is a, c, g, or t
  modified_base (229)..(229): a, c, t, g, unknown or other
  misc_feature (229)..(229): n is a, c, g, or t
  modified_base (390)..(390): a, c, t, g, unknown or other
  misc_feature (390)..(390): n is a, c, g, or t
  modified_base (565)..(569): a, c, t, g, unknown or other
  misc_feature (565)..(569): n is a, c, g, or t
  modified_base (571)..(574): a, c, t, g, unknown or other
  misc_feature (571)..(574): n is a, c, g, or t
  modified_base (576)..(596): a, c, t, g, unknown or other
  misc_feature (576)..(596): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatgganctgagcagtctgacacctgacgacacggccgtctattacngtgcgagagccgcgaatatggtggtgacaaaagngttgggttcgttttggttttggtttttcggccggttagtaaaccttacgtggggtccgaggggccacccgtggtccacccgttctcctcacgccttccaccgaacgggccctagtccggttcctttccccccgtggcccgtccctcgccctccgagggacnccgtaccctcggtcgggggccacgacgggtcccggcccgttcggggcctacggtccgttcgggtacgaaacgggtacctttaaccctttaccccgaattacccgttaccggttaacttcgggaacggtccggggtccgtagggtaccgaaagggtccgacgtaacgtaggctgcnnnnngnnnngnnnnnnnnnnnnnnnnnnnnn

SEQ ID NO: 241124 - DNA, 737 bp, Homo sapiens
  misc_feature: GYAE6OF02HSJ4W.18.39.D06.1.454.CMB.1.raw
tcagtacgagtatgcacgaccggtgctcgatttagtgacatctcgcagttctttgggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccgagggcagagtcaccatcgacccgggaacccctcaccggcacgacgcctacagtggagctagagcagtctgacacctggaccgacgaccggcctactattaccgtgtgcgagacgcccgagaatagtgtggcgacaaagtgtggttcgtttgttttggtttcggccggttagtaaccgttcggtcgggggaccctaaggggtccctaaccccggtggtaccctacccggtttcctacccgttacgtacgttacccgttaccccgaacccggtacgggtacccctaaggttccccggtttccccgtttacccccgtgggtccccggtccccgtggtccccttaccggaacggggacccgtcccgtaacccgggtttccgtaccgggggacccttaacggacccgggtcccccggttaaccccgggttcgggggccctttacccggtcccggttacggttacccggtaaacccgggtcccttttaaaccccgttccccgaacttttaccccggg

SEQ ID NO: 241125 - DNA, 839 bp, Homo sapiens
  misc_feature: GYAE6OF02I3PJJ.18.39.D06.1.454.CMB.1.raw
  modified_base (192)..(192): a, c, t, g, unknown or other
  misc_feature (192)..(192): n is a, c, g, or t
  modified_base (797)..(798): a, c, t, g, unknown or other
  misc_feature (797)..(798): n is a, c, g, or t
  modified_base (803)..(803): a, c, t, g, unknown or other
  misc_feature (803)..(803): n is a, c, g, or t
  modified_base (806)..(806): a, c, t, g, unknown or other
  misc_feature (806)..(806): n is a, c, g, or t
  modified_base (808)..(808): a, c, t, g, unknown or other
  misc_feature (808)..(808): n is a, c, g, or t
  modified_base (810)..(810): a, c, t, g, unknown or other
  misc_feature (810)..(810): n is a, c, g, or t
  modified_base (812)..(812): a, c, t, g, unknown or other
  misc_feature (812)..(812): n is a, c, g, or t
  modified_base (815)..(816): a, c, t, g, unknown or other
  misc_feature (815)..(816): n is a, c, g, or t
  modified_base (818)..(818): a, c, t, g, unknown or other
  misc_feature (818)..(818): n is a, c, g, or t
  modified_base (820)..(820): a, c, t, g, unknown or other
  misc_feature (820)..(820): n is a, c, g, or t
  modified_base (822)..(823): a, c, t, g, unknown or other
  misc_feature (822)..(823): n is a, c, g, or t
  modified_base (825)..(831): a, c, t, g, unknown or other
  misc_feature (825)..(831): n is a, c, g, or t
  modified_base (833)..(836): a, c, t, g, unknown or other
  misc_feature (833)..(836): n is a, c, g, or t
  modified_base (838)..(839): a, c, t, g, unknown or other
  misc_feature (838)..(839): n is a, c, g, or t
tcagtacgagtatgcacgaccggtgctcgatttagtgacatctcgagtggatgggatggatgaacggtaaaactgccaacacaggctatgcagaggcattccagggcagagtcaccatcgaccgggaaccccctccgaccggcacagcctacatggagctgagcagtctgacacctgacgacgacggccgtnttaattactgtcgcgaagacgccgacggaaattgtaggttgggtacgaaccgtaaaaagagtttggggttaccgttttaggttttttgggtttttacggggtacccggttaggttaaaaccgttacgggtcggggggtacccgtacgggggtaccctaaccccggttcgggttacccgtaacccggttccttccccgttacgtaaccgggtaccctttaaccccgtaaacccgggtaaaaccgggggcccccgttaaaccggtttcccggggtttaccccccgtttttcccccccggtggggtcccccggtcccccgtttaggaccccgttacccgggaaacgggtaccgaccccgttaaccccgttccgggggtttacggggggaaccctaaccgggtaccggtacccgggtccccgggttcggggtccctttaccggggtaccccgggtttaagggggtttaaaacccgggttaacccttttaaccccgggtttacccctaaaacgttttaacccggtttacccggtaacgtttacggggtaaaccgggtccgggtacgggtacgggacccggaaacgggtccgtaacgtaacgttagcctgnngacgnacngngngncgnncntntnngnnnnnnncnnnncnn

SEQ ID NO: 241126 - DNA, 373 bp, Homo sapiens
  misc_feature: GYAE6OF02H5234.18.39.D06.1.454.CMB.1.raw
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
  modified_base (354)..(373): a, c, t, g, unknown or other
  misc_feature (354)..(373): n is a, c, g, or t
tcagtacgagtatgcacgaccggtgctcgatttagtgacatctcgcagttctttggggggaagaggaagactgacggtcctcccaggagttcaggtgctgggcaccgtgggcatgggggaggtgtgtcacaagatttgggctctgggcaccgtgggcatgggggaggtgtgtcacaagatttgggccagggcaccctggtcaccgtctcctcagcttccaccaaggcccatcgtccttccccctggccgccctgcctccaggacgcacctcgtggggcacagcggcccctgggctcgcctggtcaaggactacttcccatacctcgtacngagcggctggcaaggcncatagcnnnnnnnnnnnnnnnnnnnn

SEQ ID NO: 241127 - DNA, 189 bp, Homo sapiens
  misc_feature: GYAE6OF02HXUHQ.18.39.D06.1.454.CMB.1.raw
  modified_base (182)..(189): a, c, t, g, unknown or other
  misc_feature (182)..(189): n is a, c, g, or t
tcagtacgagtatgcacgaccggtgctcgatttagtgacatctcgcagttctttgggctctgggcaccgtgggcatgggggaggtgtgtcacaagatttgggctctgggcacagcggccctgggctgcctggtcaaggctacttcccatactcgtactgagcgggctggcaaggcgcatagnnnnnnnn

SEQ ID NO: 241128 - DNA, 415 bp, Homo sapiens
  misc_feature: GYAE6OF02ILVBN.18.39.D06.1.454.CMB.1.raw
  modified_base (384)..(415): a, c, t, g, unknown or other
  misc_feature (384)..(415): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcatgggggaggtgtgtcacaagatttgggctctgggcaccgtgggcatgggggaggtgtgtcacaagagtttgggctcgtggaccaccctggtccacccgtctccctcagccttccaccaagggccccatccggtccttccccccgtggccgcccctgcctccgaggacgccacctctagggggcacacgcggccctgggctgcctggtcaaggctaccttcccatactcgtactgaggcgggctggcgaaggcgcactagcagcnnnnnnnnnnnnnnnnnnnnnnnnnnnnnnnn

SEQ ID NO: 241129 - DNA, 520 bp, Homo sapiens
  misc_feature: GYAE6OF02FZ4R8.18.39.D06.1.454.CMB.1.raw
  modified_base (209)..(209): a, c, t, g, unknown or other
  misc_feature (209)..(209): n is a, c, g, or t
  modified_base (228)..(228): a, c, t, g, unknown or other
  misc_feature (228)..(228): n is a, c, g, or t
  modified_base (368)..(368): a, c, t, g, unknown or other
  misc_feature (368)..(368): n is a, c, g, or t
  modified_base (499)..(499): a, c, t, g, unknown or other
  misc_feature (499)..(499): n is a, c, g, or t
  modified_base (506)..(520): a, c, t, g, unknown or other
  misc_feature (506)..(520): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagcccgngaatatgtggtgcaaaagnttggtcgtttgttttggttttggccggtgaactacgtggggcagggcacccgtggtcaccgtctcctcacgcttccaccaacgggcccacgtccggttccttccccccgtggcccgccccgtcgtcctcccgacgggacnccaccgtcggtggggggccaacgaggccgggcccgtggggcgtcggtcccgtaggggtacaacgggtaccttaccctttacccagttaccgtccggttacgtgacgggcgggtcgtgggaccgtaagggcncgatcgnnnnnnnnnnnnnnn

SEQ ID NO: 241130 - DNA, 804 bp, Homo sapiens
  misc_feature: GYAE6OF02G6BX3.18.39.D06.1.454.CMB.1.raw
tcagtacgagtatgcacgaccggtgctcgatttagtgacatctcgcagttctttggggctgtcctttggttttggagatggttttctcgagtgggggctgggagggctttgttggagaccttgcacttgtactccttgccgttcagccagtcctggtgcaggacggtgaggacgctgaccacacggaacgtgctgttgaactgcctcctccgcggtctttgtcttgactattatcgcctacctccgacgcccgtaccaccgtaccacttgaaccgtggaccgtcggggtcttcggtcgcctcaccgtccacccaccacgcacgtcgacctcgacgggtcgaaggtaactcgtaagtaagggtacttccggtttaggggggtttaggggggaaagaaggggtaaacggtacgtacggtacccggttccctacccggagggtacgtttacgacgggtacgaaacggtacccgtggggaccctcggaagttcggaacggttcctaccgtacggtcaacgtaacctaggtacgttaccctttccccgttaacgtaagtttaacgtttacgaactttacgttaacccgttaggtttcggggtacgacccgggtaacgtaccgggtaccgtaagggtaccgggaaaccgggtaacggggttacccgtagggttaacgggtagggtaacgggttgggggtaacgtaggggtaaacggttaacggttaaaaccgggttaaaaccgtccggaaacccgtaaaccggacggttaacgggaacttaacggggtacgaccgggtaacggtaaccgg

SEQ ID NO: 241131 - DNA, 749 bp, Homo sapiens
  misc_feature: GYAE6OF02F9ZXU.18.39.D06.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (220)..(220): a, c, t, g, unknown or other
  misc_feature (220)..(220): n is a, c, g, or t
  modified_base (664)..(664): a, c, t, g, unknown or other
  misc_feature (664)..(664): n is a, c, g, or t
  modified_base (676)..(676): a, c, t, g, unknown or other
  misc_feature (676)..(676): n is a, c, g, or t
  modified_base (684)..(684): a, c, t, g, unknown or other
  misc_feature (684)..(684): n is a, c, g, or t
  modified_base (695)..(695): a, c, t, g, unknown or other
  misc_feature (695)..(695): n is a, c, g, or t
  modified_base (711)..(711): a, c, t, g, unknown or other
  misc_feature (711)..(711): n is a, c, g, or t
tcagtacgagtatgcacgaccggtgctcgatttagtgacatctcgagtggatgggatggatgaacggtaaaactgccaacacaggctatgcagaggcattccagggcagagtcaccatcgaccgggaacccctcaccggcacagcctacatggagctgagcagtctgacacctgacgacacggcctctattactgtgcgagngccgagaatntggtggtnacaaaagtgtggttcgtttgtttggtttcggccgttagaactacggtggggacctagggcctacccgttgggtacctacccggttccttacccgtcgacggtccctttacccgaaccggtaacggggtccccctaggtttcccggttacccctttcccccggtcgggtaccccgtccccgttggtaccccgttaccgtaacgggaccgtacccgtaaccccgttcggggtccggggggtaacccaccggaaccgggccccgggtccccggttacgggggtccgttaccggtccccggtttaggggtaaccgtaaaccgggtaccctttaaccccgtttacccgaacgttttacccgtacccgggtttaacgccggggtaacgtcccgggggtacttcggggaccgtaaagggtcccgtacttaaaggtcggactgaccgtgacngtcgacgttcgngacgtcgngctcgtaacgntacggtcgaacgtcgngtcgtacgtcgtacgtacgacgtcgtcgtcgtcgtacg

SEQ ID NO: 241132 - DNA, 817 bp, Homo sapiens
  misc_feature: GYAE6OF02IC5MO.18.39.D06.1.454.CMB.1.raw
  modified_base (193)..(193): a, c, t, g, unknown or other
  misc_feature (193)..(193): n is a, c, g, or t
tcagtacgagtatgcacgaccggtgctcgatttagtgacatctcgagtggatgggatggatgaacggtaaactgccaacacaggctatgcagaggcattccagggcagagtcaccatgaccgggaaccctccaccggcacagcctacatggagctgagcagtctgacacctgacgacacggccgtctattacngtcgacgagacgaccgcgaaattacgttggtggagacaaaaaggtgtttgggttacgttttggttttttggtttttcggggacccgggttacggtaaaaccgttaccggttacgggggaccgtaacgggggtaccctaaccccgttggggtaccctaaccccggttacttccccgtacgtaacggtacccttttaccccgaaccccggtaaaacgggccccctaacgtttcccgggttcccgttttccccccccgtggggtccccgtacccccgtttcggacccgtttacccggacgggaaccgtacccgtaacccgttccgggtaggggggacctacgaacgggcccgggtcccccggtacgggtcccgtccggtacccgttacgggtaccgtaaccgggtacctttaaccccgtttccccaaaacggtttccttaaccgggtaaaccgttcggggaaacgtccccggggtaggtcggttaaccgtaaacgggaccggtttaccgaaaggttacggcgtaaccgtcgagtactacgtacgtacgacgtacgacgtacgacgacgtacgtacgtcgtcgtacgtacgtacgcgcgacgtcgtacgactcgcgtacgtcgtctcg

SEQ ID NO: 241133 - DNA, 410 bp, Homo sapiens
  misc_feature: GYAE6OF02IJEH6.18.39.D06.1.454.CMB.1.raw
  modified_base (297)..(297): a, c, t, g, unknown or other
  misc_feature (297)..(297): n is a, c, g, or t
  modified_base (392)..(410): a, c, t, g, unknown or other
  misc_feature (392)..(410): n is a, c, g, or t
tcagtacgagtatgcacgaccggtgctcgatttagtgacatctcgcagttctttgggttttggggggaagaggaagactgacggtcctcccaggagttcaggtgctgggcaccgtgggcatgggggaggtgtgtcacaagatttgggctctgggcaccgtgggcatggggggaggtgtgtcacaagatttgggctctgggcaccctggtcaccgtctcctcagccttccaccaagggcccatcggtccttccccctggccgcccctgcctccgaggacgccacctcgtggggcacgnggccggcccgtgggcctggcccgttggtaccaaggtaccttaccttcccaattacctcgtactgacggtcgggctggacaagggccacagtacgnnnnnnnnnnnnnnnnnnn

SEQ ID NO: 241134 - DNA, 942 bp, Homo sapiens
  misc_feature: GYAE6OF02JPXGR.18.39.D06.1.454.CMB.1.raw
  modified_base (219)..(219): a, c, t, g, unknown or other
  misc_feature (219)..(219): n is a, c, g, or t
  modified_base (315)..(315): a, c, t, g, unknown or other
  misc_feature (315)..(315): n is a, c, g, or t
tcagtacgagtatgcacgaccggtgctcgatttagtgacatctcgcagttctgggctgaggtgaagaaccctggggcctcagtgaaggtctcctgtcagacctatggacttccccttccagaattttgatatcctattgggtgcgacaggccagtggacaagggctcggagtggatggggatggatcggaaacggtaaaactgaccaacacaggctaanggcagaggctattccgagggctagagtcaccagtacggaccggaacccctccgacggccacacgcctaacactggacgctagacgcagtcacgacnccgtaggacgacaccggtccgtcttaattacgcgttgacggacgaacgcccggagaaacgttagtccggttagggtagaacccggtaaaaaggtcgttacggggtttaccggtttttcggttttttacggggttttacgggacccgggggttttaacgaaacccgggtttaccggggttcgggggtaacccgtaaccgggggtaccccggttaccccggttacccggggtttaccggtaccccggtttacccttacccggttacccggtttaacccggtccccggtttttaaaccccggaaacccccgggtttaaaaccgggggtcccccccttaaacggggtttaccccccgggggttttcccccccttttaaccccccggggtttcgggggtcccccggtttaaccccccgggttaacgggttcccccggtttacccgggaaaccgggggtccccttaaacccgggtaacccccggtttcccggggtaccgggggggttacccctaaccggtaccccgggtcccgggtcccccggttaggggtccccgttccggtcccgggtttaccgggaccgtaaacccgggttaacccgttccccggtttacccctaacgggttttaccccg

SEQ ID NO: 241135 - DNA, 684 bp, Homo sapiens
  misc_feature: GYAE6OF02GQRID.18.39.D06.1.454.CMB.1.raw
  modified_base (240)..(240): a, c, t, g, unknown or other
  misc_feature (240)..(240): n is a, c, g, or t
  modified_base (616)..(616): a, c, t, g, unknown or other
  misc_feature (616)..(616): n is a, c, g, or t
  modified_base (638)..(638): a, c, t, g, unknown or other
  misc_feature (638)..(638): n is a, c, g, or t
  modified_base (646)..(646): a, c, t, g, unknown or other
  misc_feature (646)..(646): n is a, c, g, or t
  modified_base (651)..(651): a, c, t, g, unknown or other
  misc_feature (651)..(651): n is a, c, g, or t
  modified_base (661)..(661): a, c, t, g, unknown or other
  misc_feature (661)..(661): n is a, c, g, or t
  modified_base (681)..(681): a, c, t, g, unknown or other
  misc_feature (681)..(681): n is a, c, g, or t
tcagtacgagtatgcacgaccggtgctcgatttagtgacatctcgagtggatgggatggatgaacggtaaaactgccaacacaggctatgcagaggcattccagggcagagtcaccatcgaccgggaacccctccaccggcacagcctacatggagctgagcagtctgacacctgacgacacggtccgtcttagttactgtgcgagagcccgagtaattacgtgtaggtgaacaaaagtnttgggttcgttttgttttggtttcgggtccggtagaaccgttacgtcggggaccacgggcctaccgtggtcctaccggttctcccgttcgacgtccgttacccaaccggaaccgggtccctaacgttccggtttcccgtttacccccgtcgggacccgttcccgtcggtaccgtcccgacgggtaacgtcccgtaacccgttccggtcggggaccaaccgacggtcccggcccgtgggtaccgtccggccgttacggtaaccgtaaacggtacccttacccgtttaccgtaacgttaaccgttccggtaacgtcgggtaaacggtccgggtacgtcgggaaccgtaacggcccgtaaggtacttaacgcgacgcgngcgacgtcgcgcgtcacgtcgncgtctcgnagcgngtcgtgtcgngtcgcgctgtacgcgacgtntcg

SEQ ID NO: 241136 - DNA, 196 bp, Homo sapiens
  misc_feature: GYAE6OF02H8CGM.18.39.D06.1.454.CMB.1.raw
  modified_base (183)..(196): a, c, t, g, unknown or other
  misc_feature (183)..(196): n is a, c, g, or t
tcagtacgagtatgcacgaccggtgctcgatttagtgacatctcgcagttctttgggctctgggcaccgtgggcagtgggggaggtgtgtcacaagatttgggctctgggcacagcggccctgggctgcctggtcaaggactacttcccatactcgtactgagcgggctggcaggcgcagtgnnnnnnnnnnnnnn

SEQ ID NO: 241137 - DNA, 945 bp, Homo sapiens
  misc_feature: GYAE6OF02GC9KM.18.39.D06.1.454.CMB.1.raw
tcagtacgagtatgcacgaccggtgctcgatttagtgacatctcgtcgagttctggggctggaggtgaagaacccgtggggcctcagtgaaggtctcctgtcacgacctatggactttccccttccagtaattttgatatccattgggtgcgacaggccagtggacaagggctcgagtggatgggatggatgaacggtaaactgaccaacgacaggcgtatcgcagaggcattaccgagggcagagtcacctagtccggaccccggaacccctccaaccggacaccgacgcctacgagtggacacgtaggacgcctaggtcctacgaacctaccgtggaaccgtaccgaccgggtacccgttacgttaacgttaccgtgggtaccggtaccgaacgggacgtcccggaacgtaagttacgtgggttcgggtacgaacggaaaacggtcggtttgggtttaccggttttgggtttttcgggttttaccgggaccgggtttaacggtaacgttaccgggggtacgggggaccccgtacgggggtcccctaaccccgggtttcggggtacccctaacccggtttcccgttacccggtaccgtaccggttcccgtttaaccccggaaacccgggttacccggggtacccccttaaccgggtttcccccgggtttaccccccttttaccccccggggtagggtaccccccgtttacccccggtttaccggggttacccccgtttaacccggggaaccgggtaacccgggtaccccctaaccccgggggtttaccgggggttaccgggggggcccttaaaccgggtacccccgggggtcccggggttaaccccggttcgggggtacccgtttaccgggtacccggttaccgggtaacccgtaaaccgggttaccccttttaccccgttaccccggtaaccggtttacccgg

SEQ ID NO: 241138 - DNA, 645 bp, Homo sapiens
  misc_feature: GYAE6OF02IQQ0Z.18.39.D06.1.454.CMB.1.raw
  modified_base (323)..(323): a, c, t, g, unknown or other
  misc_feature (323)..(323): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
tcagtacgagtatgcacgaccggtgctcgatttagtgacatctcgcagttctggggctgaggtgaagaaccctggggcctcagtgaaggtctcctgtcagacctatggattcccttccagaattttgatatccattggtgcgacaggccagtggacaagggctcgagtggatgggatggatgaacggtaaaactgaccaacacaggctatgcagagcatccgaggcagagtcaccatgaccggaaccctcgaccggcaacacgcctacgatcggacgctgacgcaagtctacgacaccgtgacgacacggccgtctagttacngtgcgagacgcccgagaaatcgttgngggtanacgaaaagtctcgggttactttgttttggtttcgggaccggtaggtaactacggtcggggacctacggggacctacccgtggtccgtaccggtcttccgcgacgtccttaccgaccgaaacgggcccctaagtttcccggtaccgttcccccgttggcccgtacccctcgtcctacccggacggtacgccgtaaccctcgggtaccgggtacgacgtacgccggccggttacgggccgttcgacccggtaggtaccgaaacgtaccgtacctacccgtacgttaacccgg

SEQ ID NO: 241139 - DNA, 973 bp, Homo sapiens
  misc_feature: GYAE6OF02G7LIC.18.39.D06.1.454.CMB.1.raw
  modified_base (146)..(146): a, c, t, g, unknown or other
  misc_feature (146)..(146): n is a, c, g, or t
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
  modified_base (295)..(295): a, c, t, g, unknown or other
  misc_feature (295)..(295): n is a, c, g, or t
  modified_base (431)..(431): a, c, t, g, unknown or other
  misc_feature (431)..(431): n is a, c, g, or t
tcagtacgagtatgcacgaccggtgctcgatttagtgacatctcgcagttctggggctgaggtgaagaaccctggggcctcagtgaaggtctcctgtcagacctatggacttccccttcagtaattttgactatcctattgggtcncgacaggccagtaggacgaagggctcgagtggatgggatggataggaaacggtaaaacncgaccaacacgagtctagngacagacgctacgtccgagggcaagacgtaccaccagtacccggacccggacccctccgaccggcaaccgngtaccctacgaacgtgggacgcgtagacgtacgagttcagacccacgttcggaacccgaccgtacccgggtaccgttactttaacgttacgtggtacggcggtaaccgaccgggtcccgaaagaaacttttacggngggggttacggtaacggaacttaaagggttcggttttcgggtttacggttttttaacggggttttttggggtttttaccggggaccgggtttaacggtttaaacccgggttcggggtacccgggggtaccgggtaccgggtaccccggttaccccgggttttcgggttaaacccccgttcccggtttacccgtttccccgtacccggtaacccggtttacccgttaacccccggaaaccggggttacccccggggtacccctttaccgggtttcccccggggttttccccctttccccggggtcccgggtaccccggtcccccgggtttaccgtcccggttacccgggaccgggaaacccgtttacccggtaccggggtttaccccgggggaaccccgggggtcgtaaacccgggtcccggggtacccgggttacccccggttgggggtaacccctttcggggtacccgtaaccggggtttaccggtaaaccccgtttaaccccggttttaccccggtacccgtttcccgtttaaacccggg

SEQ ID NO: 241140 - DNA, 615 bp, Homo sapiens
  misc_feature: GYAE6OF02IJQMY.18.39.D06.1.454.CMB.1.raw
  modified_base (265)..(265): a, c, t, g, unknown or other
  misc_feature (265)..(265): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (450)..(450): a, c, t, g, unknown or other
  misc_feature (450)..(450): n is a, c, g, or t
  modified_base (571)..(571): a, c, t, g, unknown or other
  misc_feature (571)..(571): n is a, c, g, or t
tcagtacgagtatgcacgaccggtgctcgatttagtgacatctcgcagttctggggctgaggtgaagaaccctggggcctcagtgaaggtctcctgtcagacctatggattccccttcagtaattttgatatccattgggtgcgacaggccaggtggacaagggctcgagtggatgggatggatagaacggtaaactgaccaacacaggctagtgcagagcagttccgaggcagagtcacagtcgacccggaccctcaccggcanaccgctagatggagctgagctagtcngaaccncgtagacgaccgcgccgtntattacngtgacgacgagccagtaatgtggtgagacaaaggtgttaggttgttttggttttggttacgggccggttaagaaccggttggtacggggtcctaagggtcccaccggttcgcctaaccgtctccgtntcgtaccttaccgaacgacggtaccctacgtccgtcccttcccgtcggcctcccgttgccctaccggagtccgtacccgtacgttcggggaccggctacggaccggtccggccgtcggtcncggttccggtacgtaccgaccgtaccctacgttcccaattccgg

SEQ ID NO: 241141 - DNA, 523 bp, Homo sapiens
  misc_feature: GYAE6OF02JCWBJ.18.39.D06.1.454.CMB.1.raw
  modified_base (322)..(322): a, c, t, g, unknown or other
  misc_feature (322)..(322): n is a, c, g, or t
  modified_base (494)..(523): a, c, t, g, unknown or other
  misc_feature (494)..(523): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgacaaagatggtcgtttgttttgttttggccggtgaactcgtggggccagggcaccgtggtcaccgtctcctcagctccacgacggcccatcgtccttccccngccgcctgcctccgaggcgcacctcggtcggggcacgacggccggccgtgggcctcggcccgtgggtaccaagggtaccttacccgttaccccaacgttccgttaccggtaccgttcggacgggtcccggggtacgttcggggaaccgtaacggggccgtaccaagtacggnnnnnnnnnnnnnnnnnnnnnnnnnnnnnn

SEQ ID NO: 241142 - DNA, 782 bp, Homo sapiens
  misc_feature: GYAE6OF02H5HB5.18.39.D06.1.454.CMB.1.raw
  modified_base (144)..(144): a, c, t, g, unknown or other
  misc_feature (144)..(144): n is a, c, g, or t
  modified_base (214)..(214): a, c, t, g, unknown or other
  misc_feature (214)..(214): n is a, c, g, or t
  modified_base (325)..(325): a, c, t, g, unknown or other
  misc_feature (325)..(325): n is a, c, g, or t
tcagtacgagtatgcacgaccggtgctcgatttagtgacatctcgcagttctttggggctgtcctttggttttggagatggttttctcgatgggggctgggagggctttggttggagaccttgctacttgtactcctgccgttnagccagtcctggtgcaggacggtgaggacgctgaccacacggaacgtgctgttagaactgctcctcccgnggtctttgtcttggctagtttactcggacctacctccgacggtccccgtaccacgttaaccacttggaacctgggtaccgtcggggttcttcgtaggctcaccgtccaccncacgtcacgtcgaccctacgaggggtaccggaatcagtaacggtatccggtttggggtttagggggaagtaggaacgtacgtcggtaaccggtcctacccgagggtacgttcggaacgggttagaaaacggaccccggtgggggtacccttcgaaggtacggaaaggtttccctaccgttggtaccctaaggtaaccctttacgtacgggttaaccctttccccgtttaaccgaacggttttaacgttttacgaacgttaacttcccgtaagttttacggggtccgaacggtaaccgtacggggtaccctaaaggggttccggtaaacggtaaacgggccgttacggggaagtacgggtaacggtacggggttagaggggttaactacgggaaaggttaaaacccggtgtaacccgaacgtcggtaacgggtctaaggtccggactacggtgtaccg

SEQ ID NO: 241143 - DNA, 251 bp, Homo sapiens
  misc_feature: GYAE6OF02GK0RV.18.39.D06.1.454.CMB.1.raw
  modified_base (69)..(69): a, c, t, g, unknown or other
  misc_feature (69)..(69): n is a, c, g, or t
  modified_base (158)..(158): a, c, t, g, unknown or other
  misc_feature (158)..(158): n is a, c, g, or t
  modified_base (184)..(184): a, c, t, g, unknown or other
  misc_feature (184)..(184): n is a, c, g, or t
  modified_base (186)..(187): a, c, t, g, unknown or other
  misc_feature (186)..(187): n is a, c, g, or t
  modified_base (189)..(190): a, c, t, g, unknown or other
  misc_feature (189)..(190): n is a, c, g, or t
  modified_base (192)..(251): a, c, t, g, unknown or other
  misc_feature (192)..(251): n is a, c, g, or t
tcagtacgagtatgcacgaccggtgctcgatttagtgacatctcggcagttctttgggtttgggggaanaggagactgacggtcctcccaggagttcaggtgctgggcacagcggccctgggctgcctggtcaaggctacttcccagtactcgtaccngagcgggctgggccaaggcgcatagngnngnngnnnnnnnnnnnnnnnnnnnnnnnnnnnnnnnnnnnnnnnnnnnnnnnnnnnnnnnnnnnn

SEQ ID NO: 241144 - DNA, 525 bp, Homo sapiens
  misc_feature: GYAE6OF02I5BWQ.18.39.D06.1.454.CMB.1.raw
  modified_base (344)..(344): a, c, t, g, unknown or other
  misc_feature (344)..(344): n is a, c, g, or t
  modified_base (492)..(492): a, c, t, g, unknown or other
  misc_feature (492)..(492): n is a, c, g, or t
  modified_base (495)..(496): a, c, t, g, unknown or other
  misc_feature (495)..(496): n is a, c, g, or t
  modified_base (498)..(525): a, c, t, g, unknown or other
  misc_feature (498)..(525): n is a, c, g, or t
tcagtacgagtatgcacgaccggtgctcgatttagtgacatctcgagtggatgggatggatgaacggtaaaactgccaacacaggctatgcagaggcattccagggcagagtcaccatcgaccgggaacccctccaccggcacagcctacagtggagctgagcagtctgaccacctgacgacacggcctctattactgtgcgagcgccgagaatgtggtggtcgaacaaagtgttggttcgtttggttttggtttcgggccgttgtaactcggtgggccgaggcctaccgtcggtcctaccgtctcctcacgtcctccaccgacggccagtccgttcctcccgnggccgccctgtccctcgacgacgccaccgtcgggtcggggacacgcggcccggtccgtcggcgtcgtccggtggtaccaacggtaccctccttaccacgttcctcgtactcggcggtccgggcgtcggacgacggcgacgtagtacgngtnncnnnnnnnnnnnnnnnnnnnnnnnnnnnn

SEQ ID NO: 241145 - DNA, 581 bp, Homo sapiens
  misc_feature: GYAE6OF02F8Y1B.18.39.D06.1.454.CMB.1.raw
  modified_base (160)..(160): a, c, t, g, unknown or other
  misc_feature (160)..(160): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (373)..(373): a, c, t, g, unknown or other
  misc_feature (373)..(373): n is a, c, g, or t
  modified_base (501)..(501): a, c, t, g, unknown or other
  misc_feature (501)..(501): n is a, c, g, or t
  modified_base (516)..(516): a, c, t, g, unknown or other
  misc_feature (516)..(516): n is a, c, g, or t
  modified_base (536)..(536): a, c, t, g, unknown or other
  misc_feature (536)..(536): n is a, c, g, or t
  modified_base (544)..(544): a, c, t, g, unknown or other
  misc_feature (544)..(544): n is a, c, g, or t
  modified_base (550)..(552): a, c, t, g, unknown or other
  misc_feature (550)..(552): n is a, c, g, or t
  modified_base (555)..(558): a, c, t, g, unknown or other
  misc_feature (555)..(558): n is a, c, g, or t
  modified_base (560)..(580): a, c, t, g, unknown or other
  misc_feature (560)..(580): n is a, c, g, or t
tcagtacgagtatgcacgaccggtgctcgatttagtgacatctcgagtgggatgggatggatgaacggtaaaactgccaaacacaggctatgcagaggcattccagggcagagtcaccatgacccgggaacccctccaccggcacagccctacatggganctgagcagtctgacacctgacgacacggccgtctattactgtgacgagacgccgacgaaatntaggtggtnacaaaaaggtnttgggttcgtttggttttggttttcggggccggttagtaacctacggtgggccgagggccacccgtggtaccaccgtcctcctcacgtccttacccaaccgaacgggcccagttccggttccctcccccgnggcccgtaccctcgtcctccgagggtaccgccgaacccttcggcgggggtacaccggtacgcccgggccgttcgggccgtcggtccgtggtacgaaacgtacctacccttaccaactactacgtacgnggaccggcgggtccngggtaccgaacgggccgtanaacgtacntcagcnnngtnnnnannnnnnnnnnnnnnnnnnnnnc

SEQ ID NO: 241146 - DNA, 531 bp, Homo sapiens
  misc_feature: GYAE6OF02I9DFG.18.39.D06.1.454.CMB.1.raw
  modified_base (185)..(185): a, c, t, g, unknown or other
  misc_feature (185)..(185): n is a, c, g, or t
  modified_base (192)..(192): a, c, t, g, unknown or other
  misc_feature (192)..(192): n is a, c, g, or t
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaaccctccaccggcacagcctacatggagctgagcagtctgacacctgacacacggcctntattacngtgcgagcgcgacgaatanggtggtgacaaagntggtcgttgttttgttcggcggtgaactacgtgggccgngggcacctggtcaccgtctcncagcttccacgacggccngtcgtcctcccctgcgccctgcctccgaggacgcacctcgtgggccacgagccggcctcgggctcggacctggtccaagggtacctaccgttccctacgtaccgttccgtacgtcggaacggtcggggtaccgtcgggaccgaacgggtccgacgtaacggtagtcgcngtcncgtagcctgncncgcgcgcgcgcgncngcgcgngcncgngtcgcgcgngctngtc

SEQ ID NO: 241147 - DNA, 545 bp, Homo sapiens
  misc_feature: GYAE6OF02JR50D.18.39.D06.1.454.CMB.1.raw
  modified_base (488)..(490): a, c, t, g, unknown or other
  misc_feature (488)..(490): n is a, c, g, or t
  modified_base (492)..(545): a, c, t, g, unknown or other
  misc_feature (492)..(545): n is a, c, g, or t
tcagtacgagtatgcacgaccggtgctcgatttagtgacatctcgcattcttttggggttttggggggaagaggaagactgacggtcctcccaggagttcaggtgctgggcaccggtgggcagtgggggagtgtgtcacaagatttgggctcgtgggcaccggtgggcagtggggggagtgtgtacacgaagtagtttgggctcgtagggcctacccgtgggttccacccggttctcccgtcgacgtccgttacccgaacctaacggggccccctaaggtttcccgggttcccctttcccccccgtggggccccgtccccttaggccctaccgagggttacgccctacccggtcggtcggggggccacgtagggcccggtccccgtgggtcctcgccggtggtacggaacggtccttaaccgtcctataccgtcggtacctgggacggtccgggcgttacggaccgtaagggtccacaagttaccggnnngnnnnnnnnnnnnnnnnnnnnnnnnnnnnnnnnnnnnnnnnnnnnnnnnnnnnnn

SEQ ID NO: 241148 - DNA, 1016 bp, Homo sapiens
  misc_feature: GYAE6OF02IP8B1.18.39.D06.1.454.CMB.1.raw
  modified_base (753)..(753): a, c, t, g, unknown or other
  misc_feature (753)..(753): n is a, c, g, or t
tcagtacgagtatgcacgaccggtgctcgatttagtgacatctcgcagttctggggctgaggtgaagaacccgtggggcctcagtgaagggtctcctgtcacgacctagtggtacttcccccttccagtaattttgatatccagttgggtgcgacgaggccaggtggacgaagggctcggaggtggagtgggatggataggaaacggtaaaactcgaccaacacgaggactagtgacaggacggctacgttccgagggacaggtacgtaccaaccacggtaccgggaaccccgggtaaccccctaccggacccgggaccaaccgaaccggtcccgtaacgaggtacggacggtcgtaggacgacgtacgtacgtacgaacctaccgtacggaaccgaccgtaccggtacccttacgttaacgtttaccgtggacggaccggtaacggaccggtaccccggtaagtaaagttacggttgggtaccgggttagaaccggtaaaaggttggtttcgggttttacggtttttacggggtttttcggggttttccggggaccgggtttaacggtaaccggttaccgggggtaccggggacccggttacgggtccccgtaaccccggtttcgggggtacccctacccggtttcctacccggtactacccgggtttacccgttaacccccggaaccgggtaacccggggttcccccttaacgggttttcccccggtaccccccgggttttccccccgggnggtccccccgggtttaccccgtttacggggacccccggtacccggggtaacccgggtacccgttaccccgggtaaacccggggtttcccggggggtacccggggaacccttaccccgggggtcccgggacccccccggggtttaccgggttcccggggtaccctttccccggggttaaggggttacccccgtaaccgggttaaaaccccggttcccccggtttttacccccgtttaaacccggggcccttttacccccggggg

SEQ ID NO: 241149 - DNA, 575 bp, Homo sapiens
  misc_feature: GYAE6OF02GSDM1.18.39.D06.1.454.CMB.1.raw
  modified_base (187)..(187): a, c, t, g, unknown or other
  misc_feature (187)..(187): n is a, c, g, or t
  modified_base (426)..(426): a, c, t, g, unknown or other
  misc_feature (426)..(426): n is a, c, g, or t
  modified_base (528)..(528): a, c, t, g, unknown or other
  misc_feature (528)..(528): n is a, c, g, or t
  modified_base (543)..(545): a, c, t, g, unknown or other
  misc_feature (543)..(545): n is a, c, g, or t
  modified_base (547)..(547): a, c, t, g, unknown or other
  misc_feature (547)..(547): n is a, c, g, or t
  modified_base (550)..(575): a, c, t, g, unknown or other
  misc_feature (550)..(575): n is a, c, g, or t
tcagtacgagtatgcacgaccggtgctcgatttagtgacatctcgagtggatgggatggatgaacggtaaaactgccaacacaggctatgcagaggcattccagggcagagtcaccatcgaccgggaacccctcaccggcacagcctacatggagctgagcagtctgacacctgacgacacggcctntattactgtgcgagacgccgacgaattagtggtggtgacaaaagtgttgggttcgttttggttttggttttcgggcccggttagtaaaccgttacggtcgggggaccgtaggggccctaccccgttggtcctacccgttcctcctacgacgtcccttacccgaaccgaacgggcccctacggttcccggttccccttcccccggtggtcccctccccgtcgtcccgtaccgagggaccnccctaacccgtcgagacgtccacgcggccggcccgtgggcctcggccgtggtacgaacggttcctaccttaccattccgtcgtactgggacggcggctcggngaacggtcatagtgnnngnagnnnnnnnnnnnnnnnnnnnnnnnnnn

SEQ ID NO: 241150 - DNA, 809 bp, Homo sapiens
  misc_feature: GYAE6OF02HA1HQ.18.39.D06.1.454.CMB.1.raw
  modified_base (226)..(226): a, c, t, g, unknown or other
  misc_feature (226)..(226): n is a, c, g, or t
  modified_base (258)..(258): a, c, t, g, unknown or other
  misc_feature (258)..(258): n is a, c, g, or t
  modified_base (304)..(304): a, c, t, g, unknown or other
  misc_feature (304)..(304): n is a, c, g, or t
  modified_base (355)..(355): a, c, t, g, unknown or other
  misc_feature (355)..(355): n is a, c, g, or t
tcagtacgagtatgcacgaccggtgctcgatttagtgacatctcgcagttctggggctgaggtgaagaaccctggggcctcagtgaaggtctcctgtcagacctagtggacttccccttccagtaattttgatatccattgggtgcgacacggccagtggaacgaagggctcggagtggagtgggatgagtacggaaacggtaaaactgaccgaacacgaggctancgacgaggagctagttcccgagggcaggtacnccgaacacgtccggaaccccggacccctaccgacccgggacctacnccggaccctagacgtaggacgtcagacggctacggtccgtagacctaccgnggaaccgacgaccggcccttataacgttccgtggtcgaaccggagtccggaacccgtcggtaaatggttacggtcgggtaaccaaggaaaagttcgggtttcggttacgtttttgggttttaccggggtttcgggccccggttaaaggtaaccggtttaccgggtcgggggtaccggtacccggggtaccgttaccccggtcgggtaacccgttcccggtaccctcccgttacggaccgtccttaccggacccgtaaccgggtcccgtaccgttcccggttccccgtacccgtccggtcccggtcccgtacccgtccggtaccgccggacccgtacgtaccgggtccggtccgggaccgtccggaccggtcccgggcccgtcggtccggtcccggtacgggttcccgtaagttacccggaacccgttttacccgtacccgttacccgtacccgg

SEQ ID NO: 241151 - DNA, 957 bp, Homo sapiens
  misc_feature: GYAE6OF02F02OJ.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggacttccccttccagtaattttgatatccagttgggtgcgacaggccagtggacaagggctcgagtggatgggatggataggaaacggtaaaactgaccaacacgaggctagtgacgaggtacggctacgttccggaagggcaaggacgtccaaccgagtaccgggaaccccgggaaccccctccgacccggacaaccgacgccctaacgagtcggacgcgtggacgaccgtagtccgtacgacctaccgtaggacccgaccgaccggtccttacgttaacgttaccgtggtcgacggtacggaccggcccgtaacgtaagttacggttacgggttgggtaacgaaacgtaaaacgggttggttttcgggttttacgggttttttgggtttttcggggtttttaccggggacccgggttttaaacggtaaaccggtttaccggggggtcggggtaaccccggtaacggggtcccctaaccccgggtttacgggtaccccgttacccggtttcccttaccccgttcggtaacccggttcccctttaacccccggaaacccggttacccggggttacccccttaacgggttttccccccggttccccgtttcccccgggtcggtacccccgttcccgtccgggttacccgtacccgggacgggtaccctaccccggttccgggttaccgggggtaccggggaccctaccggggcccgggggtttcccccgggacccgggtttcgggggtccccgtttacccggggtaccccggtttaacggggtttaacccccgtaaaacccgggtttccccttttacccccggtttaaccgaacccgggttttaaccccgg

SEQ ID NO: 241152 - DNA, 724 bp, Homo sapiens
  misc_feature: GYAE6OF02FTXJW.18.39.D06.1.454.CMB.1.raw
  modified_base (305)..(305): a, c, t, g, unknown or other
  misc_feature (305)..(305): n is a, c, g, or t
  modified_base (391)..(391): a, c, t, g, unknown or other
  misc_feature (391)..(391): n is a, c, g, or t
  modified_base (425)..(425): a, c, t, g, unknown or other
  misc_feature (425)..(425): n is a, c, g, or t
tcagtacgagtatgcacgaccggtgctcgatttagtgacatctcgcagttctggggctgaggtgaagaaccctggggcctcagtgaaggtctcctgtcagacctatggacttccccttcagtaattttgatactccattgggtagcgacaggccaaggtggacaagggctcgagtggatgggatggatagaacggtaaactgccaacacgagctagtgctaggacgactacgttcgagggtcaacgtagtaccaacgtataccggaacccggtaaccccctccgaaccggacacggactcctaanacgtaggacgcgtagacggtactacggtctaacgaccaccgttgaaaccggtaccacccgggtacgttacgtaacttacggtaggngtaccggagacgaccggtaataagtcgtagggtntacgaataaaggtcgtagttcggttttagtttagggtttccggtaggttactaaacgttcggtacgggtacccgaggtaccctaccggtccgtacgtacccgtcctctacgacgtacctaccgtaaccgcggacctcggtacccgtttcctaccccgtcgaccctcccgtacggtccaccggtaggacctccgtaaccgtccggggcggtaaccaccggaaccggtcccgccggtaccggtccgttaccggtcggttacccgggaacaccggttacccttaacgtcccaagtttccccg

SEQ ID NO: 241153 - DNA, 238 bp, Homo sapiens
  misc_feature: GYAE6OF02GR2SY.18.39.D06.1.454.CMB.1.raw
  modified_base (226)..(238): a, c, t, g, unknown or other
  misc_feature (226)..(238): n is a, c, g, or t
tcagtacgagtatgcacgaccggtgctcgatttagtgacatctcgcagttctttgggttttgggggaagaggaagactgacggtcctcccaggagttcaggtgctgggcaccgtgggcatgggggagtgtgtcacaagatttgggctctgggcacagcggccctgggctgcctggtcaaggctacttcccatactcgtactgagcgggctggcaaggcgctatagnnnnnnnnnnnnn

SEQ ID NO: 241154 - DNA, 833 bp, Homo sapiens
  misc_feature: GYAE6OF02GIVTD.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatggaaacggtaaaactgaccaacacaggctagtgcaaggaggctagttccgagggcagagtccaccatcggacccggacccctccgaccggcacacgcctacgagtggacgctaggacgcgagtcctacgaccaccgtaggaccgaccgccgggtccgttatacgttacgtgtagcggaaggacgccggacggtaaattaggtcggtagggttacaacgtaaaaggtcgtttgggttcggtttttacgggtttttgggttttcggggcccgggtttacgtaaacggtttcggggttccgggggacccggtacgggtacccctaccccgggttcgggtcccttaccccggttaccttcccgttaccgacgttcccttaaccccggaaccggtaacccggggtccccttaaccgttcccggggtttaaccccccttttccccccgggtagggtaccccccggtcccttccgggtaccccttacccgggtacgggaccgtaccccctacccgggttaccgggttcggggaacccctacgggtaaccgggtccccgggaccccgggtttaggggtcccgtacccgtaccccgggttagggtaaccgttaaacccgggtaccctttacccggttaacccgaccggtttaaccccgg

SEQ ID NO: 241155 - DNA, 457 bp, Homo sapiens
  misc_feature: GYAE6OF02HL1MW.18.39.D06.1.454.CMB.1.raw
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (403)..(404): a, c, t, g, unknown or other
  misc_feature (403)..(404): n is a, c, g, or t
  modified_base (407)..(408): a, c, t, g, unknown or other
  misc_feature (407)..(408): n is a, c, g, or t
  modified_base (412)..(457): a, c, t, g, unknown or other
  misc_feature (412)..(457): n is a, c, g, or t
tcagtacgagtatgcacgaccggtgctcgatttagtgacatctcgcagttctttgggttttggggggaagaggaagactgacggtcctccccaggagttcaggtgctgggcaccgtgggcagtgggggagtgtgtcacaagatttgggctctgggcaccggtgggcagtggggggagtgtgtcacaagatttgggctcgtgggccacccgtggtccaccgtctcctcagctcccacgaacggcccatccggtccttcccccnggccnccctgcctcgaggacncctacctcgtggggccagacggccggccgtgggctgtcgtggtacaaggtacctaccttcccattaccgtcgtacgtggacggcgggtctgggccgaacgggcgtaaccagtgagcatgnngannactnnnnnnnnnnnnnnnnnnnnnnnnnnnnnnnnnnnnnnnnnnnnnn

SEQ ID NO: 241156 - DNA, 683 bp, Homo sapiens
  misc_feature: GYAE6OF02FYOHO.18.39.D06.1.454.CMB.1.raw
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
tcagtacgagtatgcacgaccggtgctcgatttagtgacatctcgcagttctggggctgaggtgaagaaccctggggcctcagtgaaggtctcctgtcagacctatggacttccccttccagtaattttgatatccattgggtgcgacaggccagtggacgaagggctcgagtggatgggatggatagaacggtaaaaactgaccaacacaggctatgcagaggacattccgagggcagagtcacagtcgaaccggaacccctccgaccggcaacagcctaanactggacnctgagcagtcngaccacctgacgacacggcctctattacngtgcaganccganaatatcgtggtnacaaagactggtcgtttgttttaggttttcggcggttacgaacgtagtcggggtacgacgggtcaccccgttggtcctaacccggtccttcctaccgacgtacctttaccccgaaccgtaaaccggggcccctaagttccccggtttaccgtttcccccccggtgggacccgtcccccgttgccccgttaccgacggaccgaccgtacccgttacggtcgggggaccaaccggacggtccgggtacccggttcggggacccttcggtacccggtttacgggaaccgaaacgggttacccttaacccgttaccccgatttaaccccgg

SEQ ID NO: 241157 - DNA, 505 bp, Homo sapiens
  misc_feature: GYAE6OF02HMTQU.18.39.D06.1.454.CMB.1.raw
  modified_base (276)..(276): a, c, t, g, unknown or other
  misc_feature (276)..(276): n is a, c, g, or t
  modified_base (446)..(446): a, c, t, g, unknown or other
  misc_feature (446)..(446): n is a, c, g, or t
  modified_base (450)..(505): a, c, t, g, unknown or other
  misc_feature (450)..(505): n is a, c, g, or t
tcagtacgagtatgcacgaccggtgctcgatttagtgacatctcgcagttctttggggggaagaggaagactgacggtcctcccaggagttcaggtgctgggcaccgtgggcagtggggggaggtgtgtcacaagatttgggctctgggcaccgtgggcagtggggggagtgtgtcacaagatttgggccagggcaccctggtccaccgtctcctcagcttccaccaacgggcccatccggtccttcccccgtggccgcccctgcctccgaggacnccacctcgtgggggaccacgacggccgggtcccgtggggcctcggacccgttgggtccgaaacgggtacctttaccctttaccccgaaacttaccttaccgggtaccgttcgggaacggtcccgggggtcgtacggggaccgtaaaggggtccgtacgtaacgttacggncagnnnnnnnnnnnnnnnnnnnnnnnnnnnnnnnnnnnnnnnnnnnnnnnnnnnnnnnn

SEQ ID NO: 241158 - DNA, 863 bp, Homo sapiens
  misc_feature: GYAE6OF02FV251.18.39.D06.1.454.CMB.1.raw
tcagtacgagtatgcacgaccggtgctcgatttagtgacatctcgcagttctggggctgaggtgagaaccctgggcctcagtgaaggtctcctgtcagacctatggattccccttccagtaattttgatatccattgggtgcgacaggccagtggacaagggctcgagtggatgggatggatgaacggtaaaactgaccaacacaggctagtgacaggacggcacgttccgagggacaggacgtcaccgatccggaacccgggaaccccctccgacccggcaaccgacgcccttaacagtggaacgcctagacgcctaagtcctaggaccctaccgtagaccgtaccgaccggtccttactaacttacgtgtacgcgagtacgccgacgaattgtcggtggtcgaacgtaaagagttgggttcgtttttagggttttcggttttcgggtacccggttagtaaaccgttaccgggttcggggacccgtaacggggtcccctaaccccgggttcggttaccccgtaaccccggtttccgttaccccggtaccgtaacggttcccgtttaaacccgaaccccggggtaaccgggttcccccgttaacggtttacccccgggtttcccccgtttaccccccgggtcgggtaccccgtccccccggtttacggtccccgttacccggtaaccgggccggttaccccgtaaccgtttacccgggggtaccggggtaccctaccggtacccgggtaccccggggtcccccggtagggtcccccggttaccggtccccggttacgggttaccccggtaaaccgggtttacccctttaaccccggtttaccccgttaacgttaacccccggg

SEQ ID NO: 241159 - DNA, 835 bp, Homo sapiens
  misc_feature: GYAE6OF02JTT9I.18.39.D06.1.454.CMB.1.raw
tcagtacgagtatgcacgaccggtgctcgatttagtgacatctcgcagttctggggctgaggtgaagaaccctggggcctcagtgaaggtctcctgtcagacctatggacttccccttccagtaattttgatatccattgggtgcgacgaggccagtggaccaagggctcgagtggagtgggatggagtggaacggtaaaacgtcgacaacacgaggctagtgacgagaggctacttccgagggcaggacgtaccaccgtagtaccgggacccgggtaaccccctccgaacccggacaaccgtaccgtaccctaaccgagttcggggaactaccgttaggacggaccgtaacggtccgtacggaccctaaccggttacggaaccgacggtaccggaccggtttacttaacgttacggtcgtacggacggacggtacgacccggaagtaagttggtaccggtggtaacgaaccgtaaagggttacgtttcggggtttcggttttacggtttttcgggtttacgggggtacccgttaacggtaaccggttccgggtaacggggtaccgtaccgggaccccgttaccggtcggtaccctacccggtcttaccgtcgtacgtcccgttaccgtacccgaccggtcccttagttcccggtccccttacccgccgtacgtccccggtatcccggaacgtcggtacccgaccgttaccgggttcggaccgggcccttacggacccgggttcccggtacggggtccgttaccgggttcccgcggggttacgtaacccggggaacctttccccggtaacccggtcccgttacccggtaacccgg

SEQ ID NO: 241160 - DNA, 787 bp, Homo sapiens
  misc_feature: GYAE6OF02JAYJA.18.39.D06.1.454.CMB.1.raw
  modified_base (742)..(742): a, c, t, g, unknown or other
  misc_feature (742)..(742): n is a, c, g, or t
  modified_base (749)..(749): a, c, t, g, unknown or other
  misc_feature (749)..(749): n is a, c, g, or t
  modified_base (751)..(751): a, c, t, g, unknown or other
  misc_feature (751)..(751): n is a, c, g, or t
  modified_base (753)..(753): a, c, t, g, unknown or other
  misc_feature (753)..(753): n is a, c, g, or t
  modified_base (755)..(755): a, c, t, g, unknown or other
  misc_feature (755)..(755): n is a, c, g, or t
  modified_base (757)..(757): a, c, t, g, unknown or other
  misc_feature (757)..(757): n is a, c, g, or t
  modified_base (760)..(761): a, c, t, g, unknown or other
  misc_feature (760)..(761): n is a, c, g, or t
  modified_base (765)..(765): a, c, t, g, unknown or other
  misc_feature (765)..(765): n is a, c, g, or t
  modified_base (767)..(771): a, c, t, g, unknown or other
  misc_feature (767)..(771): n is a, c, g, or t
  modified_base (773)..(773): a, c, t, g, unknown or other
  misc_feature (773)..(773): n is a, c, g, or t
  modified_base (775)..(780): a, c, t, g, unknown or other
  misc_feature (775)..(780): n is a, c, g, or t
  modified_base (782)..(786): a, c, t, g, unknown or other
  misc_feature (782)..(786): n is a, c, g, or t
tcagtacgagtatgcacgaccggtgctcgatttagtgacatctcgagtggatgggatggatgaaacggtaaaactgccaaacacaggctatgcagaggcattccagggcagagtcaccatgacccgggaacccctccaccggcacagcctacatggagctgagcagtctgacacctgacgacacggccgtctattctgtcggcgagacgccgacgaattagtgtgggtcgacaaaaggtgttcgggttcggttttggttttcggtttttcggggccggtagtaaaccgttacggtcgggggacccgtaaggggcccttaaccccggttggtaccccgtaccccgtttcccgttaccccttaccgtcggtacccctttacccccgaaaccggtaaaccggggtccccctaacggtttcccgggtttacccccttttcccccccgttcggggccccgttcccccgttcgggtaccccttacccgggaacgggtaccgtaccccggtaaccccgtttcggggtaccgggggggaccctaaccggtacccgggtcccgggtcccccggtagggggttcccttcccgggggtccccgtttcggggtaaaccgtaaaccgggtaccccttttaacccggtttacccccgttaagttaccccggtttcccgggtaaacttcgggggtaccggggtacccggggtccggttaaccgggaccggtaaccgggtcgtacctaggtacggtcncgctcgncncncncncgnngtcncnnnnngncnnnnnngnnnnnc

SEQ ID NO: 241161 - DNA, 789 bp, Homo sapiens
  misc_feature: GYAE6OF02H721O.18.39.D06.1.454.CMB.1.raw
  modified_base (140)..(140): a, c, t, g, unknown or other
  misc_feature (140)..(140): n is a, c, g, or t
  modified_base (214)..(214): a, c, t, g, unknown or other
  misc_feature (214)..(214): n is a, c, g, or t
  modified_base (484)..(484): a, c, t, g, unknown or other
  misc_feature (484)..(484): n is a, c, g, or t
  modified_base (674)..(674): a, c, t, g, unknown or other
  misc_feature (674)..(674): n is a, c, g, or t
tcagtacgagtatgcacgaccggtgctcgatttagtgacatctcgcagttctggggctgaggtgaagaaccctgggcctcagtgaaggtctcctgtcagacctatggattcccttcagtaattttgatatccattgggtncgacaggccagtggacaagggctcgagtggatgggatggatagaaacggtaaactgaccaaacacgaggatagngacgaagacggtcacgttccgagggacaaggacgtaccaaccgtagtacggaaccccgggaacccctccgaacccgggctaaacgacggtacccttaagaacgttacgggactacgtacgggaacgtaccgtaaggttcctaacggaaacccgttacgtaacggaaccggaaccggtaccgggtacccgttacttaacgttttaacccgtgggtacgacggtaacggaccggaaccggtaacgttaaagtaacgtttgggtaccggtaanaaccgtaaaaggttcgttacgggttttccggttttagttttacgggttttaccgggaccggggttaattaaacccggttacggtacggggaccgtacgggaccgttaaccgtacgggtacctacggtcctaccgtatacgtaccgttaccgaacgtacggccgtacgtcgtccttccgcgtaccgccgtntccgtcgacgtcacgtaccgttcgacgggactccggtacggcccgtaccggttcgggacctcggtaccgtacggtaacggtaaccgtacccttaacgttacccgacgttaaccgg

SEQ ID NO: 241162 - DNA, 773 bp, Homo sapiens
  misc_feature: GYAE6OF02G08XQ.18.39.D06.1.454.CMB.1.raw
  modified_base (143)..(143): a, c, t, g, unknown or other
  misc_feature (143)..(143): n is a, c, g, or t
  modified_base (301)..(301): a, c, t, g, unknown or other
  misc_feature (301)..(301): n is a, c, g, or t
  modified_base (383)..(383): a, c, t, g, unknown or other
  misc_feature (383)..(383): n is a, c, g, or t
tcagtacgagtatgcacgaccggtgctcgatttagtgacatctcgcagttctggggctgaggtgaagaaccctgggcctcagtgaaggtctcctgtcagacctatggattccccttccagtaattttgatatccagttgggtncgacaggccagtggacaagggctcgagtggactgggatggatgaaacggtaaactcgaccaacacaggcctatgacaggaggcacgttccgagggcaaggacgtacaccagtccggaacccgggtaaccccctccgacccggcaaccacggcctaacngtacggacgtcctggaagtccaagttccgtagacccgtacctaggaaccgaccggacccgggtaccgttcttaagttaccgnggtcgcggtaacggaccgccggaagtaaacgttcgttagggtcggtaacgtaccgaaaaggttcggtttcgggtttacgtttttggtttttacgggttttgggaccggtttacggaaacgtttcggggtaccggggtccgagggtacccctcccggtacgggtaccttaccggccccttacgtactaccgttcccttaacccggaccgaaacccggtcccgttaccgttcccggtttcccgtacccccgtcgggtaccctcccgttcgacccgtaccggcgaccgccggtacctcggggtacggtcctaccggaccggttccgggccggttcggaccacgggtttccgacggtaccgtaaccgttaccctacgtttacccacgtttcccg

SEQ ID NO: 241163 - DNA, 635 bp, Homo sapiens
  misc_feature: GYAE6OF02FTAWG.18.39.D06.1.454.CMB.1.raw
  modified_base (147)..(147): a, c, t, g, unknown or other
  misc_feature (147)..(147): n is a, c, g, or t
  modified_base (283)..(283): a, c, t, g, unknown or other
  misc_feature (283)..(283): n is a, c, g, or t
tcagtacgagtatgcacgaccggtgctcgatttagtgacatctcgcagttctggggctgaggtgaagaaccctggggcctcagtgaaggtctcctgtcagacctatggattccccttccagaattttgatatccattgggtgcgacnggccagtggacaagggctcaagtggatgggatggatgaacggtaaaactgcaacacaggctatgcagaggcattccgagggcagagtcaccatcggaacccgggaacccctccgaccggcaccagcctacatgganctgagcagtctagaccactgaccgtacaccggccgttctagttacctgtacgcggagacgccgacgaatagttgtgggtgaccaaagagttggtacgtttgtttttgtttgggtcccggtagtaacgtcgtggggccgacgggtccacccgtgggtccaccgttcctccgtcacgtccttcccgaaccgtaacggccccaagtcccggtcccgttacccccgtggcccggtaccctcgttcctcccggtaacggaccgtaccgtcccgttacggtcgggggccgtaaccgacggtcccggtacccggtcgggacctcgccgtgtaccgacgttaccaccgttcccataaccg

SEQ ID NO: 241164 - DNA, 573 bp, Homo sapiens
  misc_feature: GYAE6OF02JZICO.18.39.D06.1.454.CMB.1.raw
  modified_base (161)..(161): a, c, t, g, unknown or other
  misc_feature (161)..(161): n is a, c, g, or t
  modified_base (163)..(163): a, c, t, g, unknown or other
  misc_feature (163)..(163): n is a, c, g, or t
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (297)..(297): a, c, t, g, unknown or other
  misc_feature (297)..(297): n is a, c, g, or t
  modified_base (389)..(389): a, c, t, g, unknown or other
  misc_feature (389)..(389): n is a, c, g, or t
  modified_base (405)..(405): a, c, t, g, unknown or other
  misc_feature (405)..(405): n is a, c, g, or t
  modified_base (505)..(505): a, c, t, g, unknown or other
  misc_feature (505)..(505): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (546)..(573): a, c, t, g, unknown or other
  misc_feature (546)..(573): n is a, c, g, or t
tcagtacgagtatgcacgaccggtgctcgatttagtgacatctcgagtggatgggatggatgaacggtaaaactgccaacacaggctatgcagaggcattccgagggcagagtcacatcggaccggaacccctcaccggcacacgcctacatggagctgancngttctgacaccgtgacgacacgggtcctcttattaccgngtcgacgagacgccgtagtaaattgtggtcgganaacgaaagtcgtttggttcgttttgttttggtttcgggacgttagtaactcggtgggaccngggcctaccgttgtccacccgttctccttacacgtcgttcccaacgtaccggcctaccggttcggttacccctccccggtggccctacccgnggtcctaccgaggtcnccgtacccttgggtcgggactccgaccgggccgttccgggcgactccgaacccggtttgaactaccggtacttccctacccatttacgggtccaagggtncggggacccgttgcgtaaccgaaggccgtanatcgntnatnnnnnnnnnnnnnnnnnnnnnnnnnnnn

SEQ ID NO: 241165 - DNA, 814 bp, Homo sapiens
  misc_feature: GYAE6OF02I7QDX.18.39.D06.1.454.CMB.1.raw
  modified_base (309)..(309): a, c, t, g, unknown or other
  misc_feature (309)..(309): n is a, c, g, or t
  modified_base (399)..(399): a, c, t, g, unknown or other
  misc_feature (399)..(399): n is a, c, g, or t
tcagtacgagtatgcacgaccggtgctcgatttagtgacatctcgcagttctggggctgaggtgaagaaccctggggcctcagtgaaggtctcctgtcagacctatggacttcccccttccagtaattttgatatccattgggtgcgacaggccagtggacagggctcgagtgatgggatggatgaacgtaaactgaccaacacaggtctatggacaggtaggctacgttcccgaggggtcaggacttaccaccgagtcggaacccccgggtaacccctccgaacccgggctaacgaccggtaccctanacgtgggaacgtcgtagacgtctaagtaccgtgaaccctacctacgggaacgacccggtaccgggtcccgttagttttaactttaccggngggtacgtaccggacggtaccggacccggtactaaaggttcgttaggggtacggtactaacggtaaacggttagtttcggggttttaccggttttagggttttttccgggtttacggggccgtttacgtaaacgttcggggtacgggtcccgtacgggtcccgtacccggtggtacccgtaccgttctcccgtaccgtcgtcccgttaacccgtacccgaaccggtcccgtaacggttccccggttacccttccccggtacggtccccgtacccgtcgtacccgttaccgacgggtacccgtccgtacccggtacgggttccggggaccttacggaccgggtccccggtacggttcggtaccgtccgtccggtacggttcgaaaccggttcctttaccgacccgtacgttaccgg

SEQ ID NO: 241166 - DNA, 163 bp, Homo sapiens
  misc_feature: GYAE6OF02IBFR4.18.39.D06.1.454.CMB.1.raw
  modified_base (138)..(163): a, c, t, g, unknown or other
  misc_feature (138)..(163): n is a, c, g, or t
tcagtacgagtatgcacgaccggtgctcgatttagtgacatctcgcagttctggggctgagtgaagaaccctggggcctcagtgaaggtctcctgtcagacctatggattccccttcagtaattttgactatcagttnnnnnnnnnnnnnnnnnnnnnnnnnn

SEQ ID NO: 241167 - DNA, 814 bp, Homo sapiens
  misc_feature: GYAE6OF02GXHBQ.18.39.D06.1.454.CMB.1.raw
  modified_base (154)..(154): a, c, t, g, unknown or other
  misc_feature (154)..(154): n is a, c, g, or t
  modified_base (194)..(194): a, c, t, g, unknown or other
  misc_feature (194)..(194): n is a, c, g, or t
  modified_base (723)..(723): a, c, t, g, unknown or other
  misc_feature (723)..(723): n is a, c, g, or t
  modified_base (735)..(735): a, c, t, g, unknown or other
  misc_feature (735)..(735): n is a, c, g, or t
tcagtacgagtatgcacgaccggtgctcgatttagtgacatctcgagtggatgggatggatgaacggtaaaactgccaacacaggctatgcagaggcattccagggcagagtcaccatgaccgggaacccctcaccggcacagcctacatgganctgagcagtctgacacctgacgacacggccgtctattacngtgcgagacgccggacgaaattgtggtaggtgaccaaaagtgttgggttccgttttgttttacgggttttcggccgggttagtaaaccgttacggtcgggggacccgaacgggggccctaccccggttggtacccgacccggttcctaccccgtcgaacggtcccttaccccgaacccggtaacggggtccccctaaggtttccccgggtttacccctttccccccggtggggtaccccgtcccccgttaggtccccttacccggaacgggtaccgtaccccgtaacccggtttcggggtaccggggggaccctaaccggtaccgggtccccgggtccccggttaggggtcccgttccggtaccccggttcggggtaaacccgaaacgggtttaccctttaaccccgtttaccccgtaagtttaaccccgttaccggttaacggttacgggaaccgggtcccgggggtacgtttaccggggaaccgtaaacgggggtcccgtaacgtaaacggttcgccgacgtgacgngtacgcgtacgngcgtacgtgtgacgagtcgtacgtacgtacgacgtacgacgtcgtacgtacgtacgtacgagacgcgtacgtacgtacg

SEQ ID NO: 241168 - DNA, 112 bp, Homo sapiens
  misc_feature: GYAE6OF01DFV2M.46.78.H01.1.454.CMB.1.raw
  modified_base (112)..(112): a, c, t, g, unknown or other
  misc_feature (112)..(112): n is a, c, g, or t
tcagactagcagtacacgaccggtgctcgatttagtgtgagtagtttgggtttgggctacgtggacgacacgcagtcgtgtctgatctgagcgggctggcaaggcgcatagn

SEQ ID NO: 241169 - DNA, 112 bp, Homo sapiens; identical to SEQ ID NO: 241168
  misc_feature: GYAE6OF02I5H2O.46.78.H01.1.454.CMB.1.raw
  modified_base (112)..(112): a, c, t, g, unknown or other
  misc_feature (112)..(112): n is a, c, g, or t

SEQ ID NO: 241170 - DNA, 257 bp, Homo sapiens
  misc_feature: GYAE6OF01BULI1.29.55.E11.1.454.CMB.1.raw
  modified_base (256)..(257): a, c, t, g, unknown or other
  misc_feature (256)..(257): n is a, c, g, or t
tcagatagagtactcacgaccggtgctcgatttagcactcgcacgttgggtttgggacagacttcactctcaccatcagcagactggagcctgaagattttgcagtttattactgtcagcagtataattactggcctccggcgttcggccaagggaccaaggtggaaatcaaacgaactgtggctgcaccatctgtcttcatcttcccgccatctgaacgtctactgctgagcgggctggcaaggcgcattaaggnn

SEQ ID NO: 241171 - DNA, 554 bp, Homo sapiens
  misc_feature: GYAE6OF01E35VD.29.55.E11.1.454.CMB.1.raw
  modified_base (223)..(223): a, c, t, g, unknown or other
  misc_feature (223)..(223): n is a, c, g, or t
  modified_base (407)..(407): a, c, t, g, unknown or other
  misc_feature (407)..(407): n is a, c, g, or t
tcagatagagtactcacgaccggtgctcgatttagcactcgcacgttgggtttgggggagtcagtctcagtcaggacacagcatggacatgagggtcccgctcagctcctggggctcctgctactctggctccgaggtgccagatgtgacatccagatcgacccagtctccatcatccctgtctgcatctgtcggagacagaatcacctattatttgccgganagtcacgacaataaacacctttttaatggtatcagcacaaaccagggaacgccccaaagcctcctgatcgatgctgcatccaattagagagtcgggtcccagtccgaggttcaggtggcgagtggatcgtagggactaaagtttcactcacaccatcagcagtcctagacctaacgtgaagttntttacgacctaactttactattacgtacaacgtacgtaagttactacgttactttcccttacgtactttccggacccgtagggaccgtagtaccgtatactacgaaacgtacgtcgtaggtcttcgactaaccgcttcgtcgttacc

SEQ ID NO: 241172 - DNA, 501 bp, Homo sapiens
  misc_feature: GYAE6OF02G1ETS.29.55.E11.1.454.CMB.1.raw
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (384)..(384): a, c, t, g, unknown or other
  misc_feature (384)..(384): n is a, c, g, or t
  modified_base (396)..(396): a, c, t, g, unknown or other
  misc_feature (396)..(396): n is a, c, g, or t
  modified_base (427)..(427): a, c, t, g, unknown or other
  misc_feature (427)..(427): n is a, c, g, or t
tcagatagagtactcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgacaagtcacgacataaactaccttttaaatgtatcancacaaccaggaacgcccaaagctcngatcgatgctgcatacctaattagagtaggtcggggtcccatccgaggttcaggtggcgtagtggatcgagggtactaaatttcactctcaccatcagcagtcngacaactgaatntttgactaacttatattgacaacagtattanagttattcctttctactttcggcctagggacctagtcaatatacaaacgacttgacgctgacctacattctgtc

SEQ ID NO: 241173 - DNA, 503 bp, Homo sapiens
  misc_feature: GYAE6OF01DXW2G.35.27.C05.1.454.CMB.1.raw
  modified_base (467)..(467): a, c, t, g, unknown or other
  misc_feature (467)..(467): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctctggtaccaacaccaccaggcaaacgccccaaactcatgatttatgatgtcagtaatcgccctcgtaggggtttctaatcgcttctctggctccaagtctggcaacacgcctccctgacctatctctggctccagctgacgacgaggctgattatactgctagctacatataacaaccagcagcactctcgtgtcggcggacggacaacgntacgaccgtctaggtcagcccaagctcgcccctcgg

SEQ ID NO: 241174 - DNA, 246 bp, Homo sapiens
  misc_feature: GYAE6OF01EYAKZ.35.27.C05.1.454.CMB.1.raw
  modified_base (245)..(246): a, c, t, g, unknown or other
  misc_feature (245)..(246): n is a, c, g, or t
tcagtacagatcgtcacgaccggtgctcgatttagacgcgatcgaagggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccaccctcctcacgatctgtactgagcgggctggcaaggcgcatagnn

SEQ ID NO: 241175 - DNA, 495 bp, Homo sapiens
  misc_feature: GYAE6OF01AY08E.35.27.C05.1.454.CMB.1.raw
  modified_base (301)..(301): a, c, t, g, unknown or other
  misc_feature (301)..(301): n is a, c, g, or t
  modified_base (426)..(426): a, c, t, g, unknown or other
  misc_feature (426)..(426): n is a, c, g, or t
  modified_base (453)..(453): a, c, t, g, unknown or other
  misc_feature (453)..(453): n is a, c, g, or t
tcagtacagatcgtcacgaccggtgctcgatttagacgcgatcgaagggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccaggcaaagcccccaaactcatgatttangatgtcagtaatcggccctcgaggggtttctaatcgcttctctggctccaagtctggcaacacggcctccctgaccatctctgggctccaggctgacgcgaggctgattatactgcagctcatanacaagcagcagcactctcgtgtccggnggaggccaagctgaccgtctaggtcagcccaagcctgccccg

SEQ ID NO: 241176 - DNA, 502 bp, Homo sapiens
  misc_feature: GYAE6OF01B8YE9.35.27.C05.1.454.CMB.1.raw
  modified_base (418)..(418): a, c, t, g, unknown or other
  misc_feature (418)..(418): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaacgcccccaaaactcatgatttatgatgtcagtaatcggccctcgaggggtttctaatcgcttctctggctccaagtctggcaacacgcctcctgaccatctctgggctcaggctgatgacgaggctgattattacngcagctcatactacaaccagcagcactctcgtgtcggcggaggaccagctcgaccgtctaggtcacgacccaggcctcgccccg

SEQ ID NO: 241177 - DNA, 479 bp, Homo sapiens
  misc_feature: GYAE6OF01EJ5EK.35.27.C05.1.454.CMB.1.raw
  modified_base (470)..(479): a, c, t, g, unknown or other
  misc_feature (470)..(479): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacacactgaatctgcaaatgaacagcctgagagccgaggacacggccgtatattactgtgcgaaagacatatcgcgtattactatgcttcggagacttaaattgagctttgactactggggccagggaaccctggtcaccgtctcctcagcctccaccaagggcccatcggtcttcccctggcaccctcctccaagagcacctctggggcacagcgccctgggctgcctggtcaaggactacttccacgatctgtactgagcgggctggcaaggcgcatagnnnnnnnnnn

SEQ ID NO: 241178 - DNA, 597 bp, Homo sapiens
  misc_feature: GYAE6OF01B3R3Q.35.27.C05.1.454.CMB.1.raw
  modified_base (243)..(243): a, c, t, g, unknown or other
  misc_feature (243)..(243): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
  modified_base (449)..(449): a, c, t, g, unknown or other
  misc_feature (449)..(449): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcaggcacagggtcctgggcccaggtccaggccctgactcgagcctgcctccgtgtctgggtctcctggacagtcgatcaccatctcctgcactggaaccagcagtgacgttggngctgataactatgtctcctaggaccaacaccaccaggacaacnccccaaatcatnatttangatcgacagtaactcggccctgtagggttctaatcgtctttcnctggctccaagtcgtaggacaacgaccggccttccgtacaccactcgtcgcgggtcctacgacgtctaggaaccgagtacggtactagtaatttaactacgngacgacgtactactatacgtacgacgacgacgtacgtacgttaacgttacgttacggttacgggtacgggtaacggtaacgtaacggtacgtaccgtaccgtacgtacgacgaccgtacgtaccgtacccgtcccgtccgtcgtaccg

SEQ ID NO: 241179 - DNA, 659 bp, Homo sapiens
  misc_feature: GYAE6OF01B8P4M.35.27.C05.1.454.CMB.1.raw
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
  modified_base (363)..(363): a, c, t, g, unknown or other
  misc_feature (363)..(363): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagcggtgtgtttctaggtcggctatttaaaaggtgtcagtgtgaggtgcagctgttggagtcgtgggggaggcttggtacagcctggggggtccctgagctctcctgtgaagcctntggattcacctttaggaactatgccatgtgctggggccnccgaggtctccgaggggaaggggctgggagtgggtctanagttatagtggtagtggtnatactatacactacgcaagtcgtccgtaggaacgggtccggttacacctaatcctacccagacgtactaaacttaccgaaacgaaacaacctacctaggaaaaccctttcgtaacgaacaaaagtaacgaaccgaacgaccgtacgacggacggaccggaacggaaccggaccggtaccgtaacgttaacgttaacgttacggtacggtaacggtaaacggtaaacgtaacgtaacgtacgttaacgttaacgttaacgttacgttacgttacggttaacggttaacggttaaacg

SEQ ID NO: 241180 - DNA, 613 bp, Homo sapiens
  misc_feature: GYAE6OF01CN8K0.35.27.C05.1.454.CMB.1.raw
  modified_base (242)..(242): a, c, t, g, unknown or other
  misc_feature (242)..(242): n is a, c, g, or t
  modified_base (302)..(302): a, c, t, g, unknown or other
  misc_feature (302)..(302): n is a, c, g, or t
  modified_base (455)..(455): a, c, t, g, unknown or other
  misc_feature (455)..(455): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtcctccgtggacaggtcgatcacatctcctgcactggaaccagcagtgacgttggngctgataactatgtctcctggtaccaacaccaccaggcaaagccccaaatcatgatttangatgtcagtaatcggcctgagggtttctaatcgcttctcgtaggctccaagtcctggacaacacggccctaccgtagacccattcctacgtgggacctccgaaggtcctaggacggtacgaggctaggaatttagtagtttcgttagccttanatagtgactaggtaagtacgactaacttaatcgtacgttaggtaacctggggtaaacctaacgggttcaaaccccgggtttcctaacgggggttaccaacgggttacccccaaacgggtacccctaaaaccccccgtagtccggtaccttaaccccgg

SEQ ID NO: 241181 - DNA, 479 bp, Homo sapiens
  misc_feature: GYAE6OF01ERIKA.35.27.C05.1.454.CMB.1.raw
  modified_base (473)..(479): a, c, t, g, unknown or other
  misc_feature (473)..(479): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacacactgaatctgcaaatgaacagcctgagagccgaggacacggccgtatattactgtgcgaaagacatatcgcgtattactatgctttcggagacttaaattgagctttgactactggggccagggaaccctggtcaccgtctcctcagcctcaccaagggcccatcggtcttccccctggcaccctcctccaagagccacctctgggggcacagcggccctgggctgcctggtcaaggacctacttccacgatctgtactgagcggctggcaaggcgcatgnnnnnnn

SEQ ID NO: 241182 - DNA, 493 bp, Homo sapiens
  misc_feature: GYAE6OF01BHZKK.35.27.C05.1.454.CMB.1.raw
  modified_base (304)..(304): a, c, t, g, unknown or other
  misc_feature (304)..(304): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaacgcccccaaactcatgatttangatgtcagtaatcggccctcgagggtttctaatcgcttctctggctcaagtctggcaacacggcctcctgaccatctcgtggcctcgagctgacgacgagctgattatactgcagctnatatacacngcagcatctcgtgttcggcggaggaccagctacgccgtctagcagcccaggctcgcccgtcg

SEQ ID NO: 241183 - DNA, 612 bp, Homo sapiens
  misc_feature: GYAE6OF01CXAP5.35.27.C05.1.454.CMB.1.raw
  modified_base (236)..(236): a, c, t, g, unknown or other
  misc_feature (236)..(236): n is a, c, g, or t
  modified_base (252)..(252): a, c, t, g, unknown or other
  misc_feature (252)..(252): n is a, c, g, or t
  modified_base (318)..(318): a, c, t, g, unknown or other
  misc_feature (318)..(318): n is a, c, g, or t
tcagtacagatcgtcacgaccggtgctcgatttagacgcgatcgaagggtttgggggggtcgtcaggaggcagcgctctcgggacgtctccaccatggtcctgggctctgctattcctcaccctcctcactcagggcacagggtcctgggcccaggtctgccctgacgttcagcctgccttccgtgtctgggtctcctggacagtcgatcaccatctccggtgctacgtggaaccngcgagtgacgttggtnctgataactatcgtctctggtaccaacaccaccctaggcaaacgcccccaaaatcgactgatttangagtggtcaggtaatccgggccctcgtaggggtttactaagtcgtacttcgtcgtggtctacctaaagtctggacaacgtacgccttccgtgaccatctcgtcggcttcaggtctagaacgacgaggtctagtatttactactgacagtactacgataactacctaaccgagtaccaggcctaaccgttcgttacggttagttccggcgttagggacgggtaccgaaggtctacggtacccgttaaccgtagggtaccgacggacccgaaacgggtcccgttccggtccccccg

SEQ ID NO: 241184 - DNA, 526 bp, Homo sapiens
  misc_feature: GYAE6OF01B7URX.35.27.C05.1.454.CMB.1.raw
  modified_base (371)..(371): a, c, t, g, unknown or other
  misc_feature (371)..(371): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaacgcccccaaactcatgatttatgatgtcagtaatcgccctctagggttctaatcgcttctctggctcaagtctggcaacacgcctccngaccatctctggctcagctgacgacgaggctagtattattactgcagctacataactacaaccagcagcactctcgtgttcggcggacgggaccaggtctacggcccgtccgtaggtccacggaccccaagggcctcccggcccccgttaccggg

SEQ ID NO: 241185 - DNA, 655 bp, Homo sapiens
  misc_feature: GYAE6OF01EKNMZ.35.27.C05.1.454.CMB.1.raw
  modified_base (645)..(645): a, c, t, g, unknown or other
  misc_feature (645)..(645): n is a, c, g, or t
tcagtacagatcgtcacgaccggtgctcgatttagacgcgatcgaagggtttggggctcaactttcttgtccgccaggctccagggaaggggctggacgtgggtctcagttattagtggtagtggtgatactatacactacgcagactccgtgaagggccgttcaccatctccagagacaattccaagaacacactgaatcgtgacaaaatcgaaacagcctgagagccgaggacacgggcctatactactgtagcgaaagacatatcgcgtattactatgccttcggagacttaaattgagtctttgactacgtcggggccacgggaaccctcggtcaccggtctcctcacgcctccaccgaacgggcccagtccggtccctccccgtcggcctacccctcctacccaacgacgcctaccgtacgtcgggggtaccaccgtacggcccggtacccgtgggcctacggtcccgttagggtaccgtaaacggtacccttaaccgttcccgtaaccgtacgttccgttacgtaacgttcggaacggtccggggtcgtacgggtacccggtaacggggtcccggtaccgtaacggttaacggacgtacgacggtacacgaacgcgtagctagcgaccgacactctctntctcgtcgtc

SEQ ID NO: 241186 - DNA, 503 bp, Homo sapiens
  misc_feature: GYAE6OF01A8IOZ.35.27.C05.1.454.CMB.1.raw
  modified_base (401)..(401): a, c, t, g, unknown or other
  misc_feature (401)..(401): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
tcagtacagatcgtcacgaccggtgctcgatttagacgcgatcgaagggtttgggggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatgttgggggttatgaccttgtctcctggtatcaacagcacccaggcaaagcccccaaactcttaattataaggacactaagcgaccctcagggatttctaatcgcttctctggctccaagtctggcaactcgcctcctgacaatctctgggctccgggctgaggacgnggctgattattattgttgctcatatgcaggtagtagctactaatgtctacggactggaccaaggtcaccgtctaggtcagcccaggccaacccntcgcnctc

SEQ ID NO: 241187 - DNA, 510 bp, Homo sapiens
  misc_feature: GYAE6OF01C5UE0.35.27.C05.1.454.CMB.1.raw
  modified_base (240)..(240): a, c, t, g, unknown or other
  misc_feature (240)..(240): n is a, c, g, or t
  modified_base (418)..(418): a, c, t, g, unknown or other
  misc_feature (418)..(418): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgataactatgtctctggtaccaacaccaccaggcaaacgcccccaaactcatgatttatgatgtcagtaatcggccctcaggggtttctaatcgcttctctggctccaagtctggcaacacggcctccctgaccatctctgggctccgagctgacgacgaggctgtattattacngcagctcatatacaaccagcagcactctcgttgtcggcggacgggaccacgctcggaccgtccgtagtcacgacccaggcctcgccccgtcg

SEQ ID NO: 241188 - DNA, 532 bp, Homo sapiens
  misc_feature: GYAE6OF01BKLB3.35.27.C05.1.454.CMB.1.raw
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctctggtaccaacaccaccaggacaaacgcccccaaactcatgatttatgatgtcagtaatcgccctgtagggtttctaatcgcttctctggctcagtctggcaacacgcctcctgaccatctctggcctcgagctgacgacgagctgattatactgcagctcatactacaaccagcagctactctcgtcgttcggcggaacgggtaccagtcgtacggtacccgttccgtaacgggtccacggaccccaagggtccctccggtccccccgttaccgg

SEQ ID NO: 241189 - DNA, 504 bp, Homo sapiens
  misc_feature: GYAE6OF01DWSA8.35.27.C05.1.454.CMB.1.raw
  modified_base (241)..(241): a, c, t, g, unknown or other
  misc_feature (241)..(241): n is a, c, g, or t
  modified_base (303)..(303): a, c, t, g, unknown or other
  misc_feature (303)..(303): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgataactatgtctcctggtaccaacaccaccaggcaaagcccccaaactcatgatttangatgtcagtaatcggccctcgaggggtttctaatcgcttctctggctccaagtctggcaacacggcctcctgaccatctcgtcggctccgagctgacgacgaggctgattatactgcagctcatataacaacagcagcactctcgtgtcggcggaggaccaagctacgccgtctaggcacgcccaaggcctcgcccctcgg

SEQ ID NO: 241190 - DNA, 525 bp, Homo sapiens
  misc_feature: GYAE6OF01C7U71.35.27.C05.1.454.CMB.1.raw
  modified_base (241)..(241): a, c, t, g, unknown or other
  misc_feature (241)..(241): n is a, c, g, or t
  modified_base (367)..(367): a, c, t, g, unknown or other
  misc_feature (367)..(367): n is a, c, g, or t
  modified_base (428)..(428): a, c, t, g, unknown or other
  misc_feature (428)..(428): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgataactatgtctcctggtaccaacaccaccaggcaaacgcccccaaactcatgatttatgatgtcagtaatcggccctgacggggtttctaatcgcttctctggtctccaagtctggcaacncgcctccctgacccatctctcgggctccaggctgacgacgagctgattattactgcagctnatactaacaacagcagcacgtctcggtcgttcgggcggacggaccgagctacgcccggtcctaggtcacggacccaaggtcctccgccccgtaccgg

SEQ ID NO: 241191 - DNA, 512 bp, Homo sapiens
  misc_feature: GYAE6OF01CS3TW.35.27.C05.1.454.CMB.1.raw
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccaggcaaagcccccaaactcatgatttatgatgtcagtaatcggccctcaggggtttctaatcgcttctctggctcaagtctggcaacacggcctccctgaccatctctgggctccgaggctgacgacgaggctgatttatactgcagctacataactacaaccagtcagcactctcggtgttcggcggaggacaagctggacccgtcgtaggcacgccaaggcctcgcccccgtcgg

SEQ ID NO: 241192 - DNA, 513 bp, Homo sapiens
  misc_feature: GYAE6OF01CGEL4.35.27.C05.1.454.CMB.1.raw
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaagcccccaaaactcatgatttangatgtcagtaatcggccctnaggggtttctaatcgcttctctggctccaagtctggcaacacggcctccctgaccatctctgggctccaggctgacgacgaggctgattattactgcagctcatactacaaccagcagcactctcgtgttcggcggaggaccaagctcggaccgtccgtaggtcacgcccaaggcctcgcccccgtcgg

SEQ ID NO: 241193 - DNA, 529 bp, Homo sapiens
  misc_feature: GYAE6OF01AZI3P.35.27.C05.1.454.CMB.1.raw
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (413)..(413): a, c, t, g, unknown or other
  misc_feature (413)..(413): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaacgcccccaaactcatgatttangatgtcagtaatcggccctcgacggggtccctgatcgcttctctgctcagtctgacacncgcctccctacgtctcgtggctcagctgagntgngctagtattatcgtnctagctacatagtcgacgagacagtaccgttaacgtttgtacggtttcggacgggtacggaccgtaggtcgaccgtcgtaggtccacgacccaagcctccgccccgtggtcctccg

SEQ ID NO: 241194 - DNA, 563 bp, Homo sapiens
  misc_feature: GYAE6OF01C4FL1.35.27.C05.1.454.CMB.1.raw
  modified_base (241)..(241): a, c, t, g, unknown or other
  misc_feature (241)..(241): n is a, c, g, or t
  modified_base (368)..(368): a, c, t, g, unknown or other
  misc_feature (368)..(368): n is a, c, g, or t
  modified_base (432)..(432): a, c, t, g, unknown or other
  misc_feature (432)..(432): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcagtgacgttggngctgataactatgtctcctggtaccaacaccaccaggacaaacgccccaaactcatgatttatgatgtcagtaatcggccctcgtaggggtttctaatcgtcttctctgctcctaagtctggcaacncgtcctccctgaccatcctacgtcgggccttcgacggctagacgacgaggctagtattattacngtccagtctcataacaccaaccgtagcagcctacttctcgttcggttcgggaccgggacgggaccgagtaccgtcggacccgtccgttaggccgacggaccccgaaggccctcccggtcccccgtaccggg

SEQ ID NO: 241195 - DNA, 639 bp, Homo sapiens
  misc_feature: GYAE6OF01DLCSA.35.27.C05.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (303)..(303): a, c, t, g, unknown or other
  misc_feature (303)..(303): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggnctgataactatgtctctagtaccaacaccaccagacaaacgaccccaaactcatgtatttangatgtacagtaactcgtaccctggtacggttctaacgtcgtcttcgttcgtcggtcctacgtaagtcgtacggaccaacgtaccgtcccctaccgtacgaccctacttcgtccggtcggccttccgaggtcctacggacgacggacgtcgttagtaatttacttacgcgacgtaacgtctaactaaacttacaacgtaacgacgacgactaacgcctacttccggttacgttcgggttaccggacgggtacggaacccgtaggtcccggtccgtaacccggttaccgtacggtaccaacccgacccggtaaccggtcccgtccccggtaccccccg

SEQ ID NO: 241196 - DNA, 518 bp, Homo sapiens
  misc_feature: GYAE6OF01E36E4.35.27.C05.1.454.CMB.1.raw
  modified_base (424)..(424): a, c, t, g, unknown or other
  misc_feature (424)..(424): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaacgcccccaaactctaatttataagacactaagcgaccctcaggatttctaatcgcttctctggctccaagtctgcaactcgcctcctgacaatctctgggctccgggctgaggacgaggctgattattattgtgctcatangcagtagtagcactatgtcttcggaactggaccaggtcacgtcctaggtcagacccacggccaaccccactctacactctcgttccccgtcccc

SEQ ID NO: 241197 - DNA, 657 bp, Homo sapiens
  misc_feature: GYAE6OF01CQ8CO.35.27.C05.1.454.CMB.1.raw
  modified_base (308)..(308): a, c, t, g, unknown or other
  misc_feature (308)..(308): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctggcccagtctgccctgactcggagcctgcctccgtgtctgggtctcctggacagtcgatcaccatctcctgcactggaaccagcagtgacgttggtgctagataactatgtctcctaggtaccaacaccaccaggacaacgaccccaaatcatacgtatttangtatgtactaagtaacgtccgtaccctggtacgggtttacctaacgtcgtctttccgtcgtcggtcctaccgaagtccgtcggactaaccgtaccggtcccttaccccgtacgaaccctcgtcctcggtccgggtaccttcccgaggccgttacggaccgaacggtacggtcttaaggttactttaactacgtcgacgtacgtcctacttaataactaacccgaaccgagaccgtaacgtcctaaccgttcgtccggttcggttaccgggacgggtacggaaccgacgtcgtaccggacccgttacgtacggacaccggaccaacggtcctcccggtccccgttaccgg

SEQ ID NO: 241198 - DNA, 577 bp, Homo sapiens
  misc_feature: GYAE6OF01CJ0I1.35.27.C05.1.454.CMB.1.raw
  modified_base (483)..(483): a, c, t, g, unknown or other
  misc_feature (483)..(483): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagctggtctttttcttgtggctattttaaaggtgtccagtgtgaggtgcagctgttggagtcgtgggggaggcttggtacagccgtggggggtccctgagactctcctgtgaagcctctggattcacctttaggaactatgccatgtgcgtgggtccgccgaggctccgaggggaggggctgggagtgggtctcgtagttattaggtggtagtggtgatactatacactacgcagaccgtccgtggaacggggtcccggttacaccgatccgtacccaggaacgaactaacttaccaagaaaccacactagaaatcctagacaaatcgaaacngcctaggacgacgccggaggaccacggaccgtaatnttacnggtagaacgaaacgtanattanccggtattatactagtgtcgtgtaagttaac

SEQ ID NO: 241199 - DNA, 462 bp, Homo sapiens
  misc_feature: GYAE6OF01E1PIY.35.27.C05.1.454.CMB.1.raw
  modified_base (453)..(462): a, c, t, g, unknown or other
  misc_feature (453)..(462): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacactttgttcctgcaaatgaacagcctgagagccgaggacacggcgatatattactgtgcgagaagcgatgggagcctacccccggatgagcactggggccagggcaccctggtcgccgtctcttcagcctccaccaagggcccatcggtcttccccctggcaccctcctccacggagcacctccgagacgcacagcggcctgggctgcctggtcaaggactacttccacgactctgtactgagcgggctggcaaggcgcatgnnnnnnnnnn

SEQ ID NO: 241200 - DNA, 542 bp, Homo sapiens
  misc_feature: GYAE6OF01BX8A5.35.27.C05.1.454.CMB.1.raw
  modified_base (245)..(245): a, c, t, g, unknown or other
  misc_feature (245)..(245): n is a, c, g, or t
  modified_base (304)..(304): a, c, t, g, unknown or other
  misc_feature (304)..(304): n is a, c, g, or t
  modified_base (492)..(492): a, c, t, g, unknown or other
  misc_feature (492)..(492): n is a, c, g, or t
  modified_base (528)..(528): a, c, t, g, unknown or other
  misc_feature (528)..(528): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggccctagtctgccctgactcagcctgcctccgtgtctgggtctcctggacagtcgagtcaccatctcctgcactggaaccagcagtcgacgttggngctgataactatgtctcctggtaccaacaccaccagcaagcccccaaatcatgatttancgatgtacagtaatcggcctcgtaggggtttctaagtcgtcttctcgtggtctaccgaagtctggctaacgtcgggcccttcccgtgaacctaactcctcgtacgggcctccgggctggacggacgaggtcctaggatttatttacgtgtcagtctacatataccaacagcagcactctcgtgtcggnggacggaccagctagccgtcgtagcacgccgagccncgccccgtggtacc

SEQ ID NO: 241201 - DNA, 712 bp, Homo sapiens
  misc_feature: GYAE6OF01EE59Q.35.27.C05.1.454.CMB.1.raw
  modified_base (215)..(215): a, c, t, g, unknown or other
  misc_feature (215)..(215): n is a, c, g, or t
  modified_base (260)..(260): a, c, t, g, unknown or other
  misc_feature (260)..(260): n is a, c, g, or t
  modified_base (368)..(368): a, c, t, g, unknown or other
  misc_feature (368)..(368): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctncactaggaccagcaggtcgtacggttggtgtctagtaataacttntcgtctccgtacgtaaccaaccacccgaccgagacaaacccgaccccaaaactctatacgttattattgtactgtacgacgttacgaccggtccgttacgttacgggnttttacgtacttcgtccttcgtagtccgtacgtacctaacgtcgtaccgtaccgaacgaccccgtccgttccctacgtaccgtcttcggtacggtcctacggacgtcggacgacgtacggacgaacgttctagttaacttacgtcctagactactaacctaacgtaactaaacctaccgaaccgacgtaccgtacttcgtaccggtcggttaccgggttaccgggtacggggaaccgggtacggtaacccgtaccggttaccggtacccggttacccggtaccggttacggacccggtaaccccgggtaccccggtaccgggttcccccgtccccggttccccg

SEQ ID NO: 241202 - DNA, 787 bp, Homo sapiens
  misc_feature: GYAE6OF01D73SP.35.27.C05.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
tcagtacagatcgtcacgaccggtgctcgatttagacgcgatcgaagggtttggggggggtctcaggaggcagcgctctcgggacgtctccaccatggcctgggctctgctcctcctcacctcctcactcagggcacagggtcctgggcccagtctgccctgactcagcctgcctccgtgtctgggtctcctggacagtcgatcaccatcctcctgcactggaaccngcagtgacgttggngctagataactatgtctcgtgtaccaacaccaccagacaaacgccccaaactcatgatttangatgtnagtaacgtccgtcctacgtagggtttactaactcgtacttctcgtcggcctaccgtaagtcctacgggtaccaaaccgacccgggtccccttccctacggtaaccctattcccgttccggtcggggtcccttacccgaacgggtccgttacgggaaaccgggaacggtacgggttccgtaacgttaaacgtttttaacgtttaaccgtcggtaaccgtacgttaccttaccgtaaactttaaacctaaacccgaaacccgtaacggtaccgtaaaccggtacccctaacctttcccggttaccgggtttacggggtttccccggggaccggggaaaccggggtaaccccgtaaacgggttcccgtaacccgggttaccccggtttaccccggtaaacgggttaccccggtaaacccggtaaccccggtaaaaccggggtcccccgttccccgggtaaccccccccggtttacccgggg

SEQ ID NO: 241203 - DNA, 566 bp, Homo sapiens
  misc_feature: GYAE6OF01DA5CV.35.27.C05.1.454.CMB.1.raw
  modified_base (243)..(243): a, c, t, g, unknown or other
  misc_feature (243)..(243): n is a, c, g, or t
  modified_base (309)..(309): a, c, t, g, unknown or other
  misc_feature (309)..(309): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaagtgacgtttggnctgaataaactatgtctctggtaaccaacaccaccgaggacaaaacgcccccaaatcatgatttangatgtcaagtaactcggcctcgtaggggtttcaatcgtcttctctggctaccaagtctggacaacaccggccctcccgtagaccatcctcgtcgggcctccaggctggaacgacgagggactagtactttattaactgacagctacaataacaacaacccagacagtcactcgttacgtggttcgggacggaagggaaccgaagcgacgtaccgtccgtaaggtcacgacccaaagggccttccgcccccgttccgg

SEQ ID NO: 241204 - DNA, 598 bp, Homo sapiens
  misc_feature: GYAE6OF01A5R58.35.27.C05.1.454.CMB.1.raw
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgtcggagtcgtgggggaggcttggtacagccgtggggggtcccctggagagtctcctgtgcagcctctggagtcaccttgagtagctatggcatgagcgtgggtcccgccgaggcctccgaggggaccggggcgtgggaggtggggtcttcgttcttagttaggtgtcgttaggtgggttggtcctcacgtatacctacgcaacgtctctgtgaacgggtcccggttccaccgtctacccagacgaactaacttaccaagtaaccaccctagtactctagacaaagtgaacacgacctagagacgcccgacgaaccgaccggacgtactattacgtggtagacggtaaagttcggacggtaacgtggggaacggttaggttacttggagttccgg

SEQ ID NO: 241205 - DNA, 790 bp, Homo sapiens
  misc_feature: GYAE6OF01DSJ9T.35.27.C05.1.454.CMB.1.raw
tcagtacagatcgtcacgaccggtgctcgatttagacgcgatcgaagggtttggggggggtctcgaggaggcagcgctcgtcgggacgtctccaccatggcctgggctctgctattcctccaccctcctcactcgagggcacgagggtcctgggcccagtctcgccctgactcagcctgcctccgtgtcgtgggtcctccgtggacagtcgatcacctatcctcctgcacgtcggaaccagccaggtgtacggttggcgcgtagaattaacttagtcgttccttccgtacggtaacccaaaccaccccaacccgaaggtaccaaaaccggaccccccaaactcaatagtaactttagtgtactcgtactaagtaacgtccggtccctacggttacggggtttactaacgtccgtcctttcgttccgtcggtacccttaccgtaagttccgtaggacctaaccgacccggtacccttcccgtacgaccctacttccgtccggtcgggcctaccgacggtcgtacggaacgtaacggtaggtacttttaattaacgtttaccgtcgtacctacgtccttacgtaaattaaccgtaaacctaaaccgacgtaccgtacgtacccgttaaccttccggttccggttacgggttacccggggaccgggtaaccggtaaacccgtaacgggtcccgttacccgggtaacccgtttacccggttaacgggtacccgaacccggtaaccccggtaaccggtcccgtaccccccggtcccccggtaccggttacccccg

SEQ ID NO: 241206 - DNA, 538 bp, Homo sapiens
  misc_feature: GYAE6OF01DL5WK.35.27.C05.1.454.CMB.1.raw
  modified_base (242)..(242): a, c, t, g, unknown or other
  misc_feature (242)..(242): n is a, c, g, or t
  modified_base (441)..(441): a, c, t, g, unknown or other
  misc_feature (441)..(441): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtnctgataactatgtctcctggtaccaacaccaccaggcaaagcccccaaactcatcgatttatgatgtcagtaactcggccctcgtagggttctaatcgcttctctaggctccaagtctggacaacacggcctcctgaccatctctggctccgagctgacgacgaggctgatttatactgcagctcatatacaactgacngcaactctcggttcgttcgggcggtaagggacccaaaggccttaggacccgtaccgtaggtacacggacccaaggtcctccgcccccgttacccggg

SEQ ID NO: 241207 - DNA, 749 bp, Homo sapiens
  misc_feature: GYAE6OF01CVMVU.35.27.C05.1.454.CMB.1.raw
  modified_base (696)..(696): a, c, t, g, unknown or other
  misc_feature (696)..(696): n is a, c, g, or t
tcagtacagatcgtcacgaccggtgctcgatttagacgcgatcgaagggtttgggctcgaactttcttgtcccgccaggctccagggaggggctggtagtgggtctcagttattagtggtagtggtagatactatacactacgcagacttccggtgaaggggccggttctaccatctccagtagacattccaagacacactgaatctggacaaatgaacgagcctgacgagccgagggacacggccgtatattactgtgacgaaagcatactcgcgtattactatgacttcggagtacttaaattgacgtcgtttcgacctaacgtggggtaccgacggggaaccctgggtactaaccgggtccgtccgttccgacggtccctaccgtacccgaaggtcccctaggttccgggtccctttcccccggtgggtcccaacccccgtttccgtaccgaacggtaccgtaccgtaccccgttacggttccggggggacctaccggaaccggtacccgggtccccgtcggggtccctacgggtacccgtaccgggtaccgtaaaccggtacccgttaacccggttacccctaaacccgggtccttacggtttcggtaacccggttgggaaccggtacggggacccttacgggggaacccgttaacgggtccgacggtaacgttaacggccgagtacaccgngagacggaggagtcgaggtaccgagtacgtacgtacgtacgtcgcgtcggtcg

SEQ ID NO: 241208 - DNA, 539 bp, Homo sapiens
  misc_feature: GYAE6OF01CSM7V.35.27.C05.1.454.CMB.1.raw
  modified_base (445)..(445): a, c, t, g, unknown or other
  misc_feature (445)..(445): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccagcaagtgacgtttggtgctgaattaactatcgtctcctggtaaccaacacccaccaggacaaacgccccaaaatcatcgtatttatgatgtcaataactcgcctagacgggtttctaatcgcttactctcggctaccaagtcgtggacaacgtacggccctcccgtgacccatctacgtgggctccgaggctaggacgacgagctagtattattagngtcagtctacataatacacagcagcactgtcgtgtcggacggacgctaaggctacggcccgtccaggtcacgacccagcctccgccccgtacgg

SEQ ID NO: 241209 - DNA, 661 bp, Homo sapiens
  misc_feature: GYAE6OF01EY2L3.35.27.C05.1.454.CMB.1.raw
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctccctccgtgtccgggtctcctggacagtcagtcaccatctcctgcactggaacctgcagtgatgttggaattatgactatgtctcctggtaccaacttcacccagacacacgtacccccaaaccatcgatactacaatgtacaattacttccggacccttcgaggtacgttcccttaaattccgttttctccttggcctaccgaagttctaggcttagtcggccggtccctccgtcgcccctattcctcgtcggacccttccgaggtcctaggacgggtaccgaggcgttagtagtttagtgggacgtcgttagtactttaagtaagtaagaacgtacgtagtcgtacctaacgttacgtaacggtttagtacgtttcgggacgggtaacgggaaccgtaacggtccgtaccggtacccggttccgtaacgggttaccaacggtaccccgtaaagggtcccctacccggtccccccgttgggtaccccc

SEQ ID NO: 241210 - DNA, 650 bp, Homo sapiens
  misc_feature: GYAE6OF01ECCQL.35.27.C05.1.454.CMB.1.raw
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccaggtctgccctgactcagcctgcctcgtgtctgggtctctggacagtcgatcaccatcctctgcactggaaccagcagtgacgttggtgctgataactatgtctctggtaccaacaccaccaggacaaacgccccaaactcactgatttatgtatgtacagtaactcggccctcgtagggtttactaatcgtcttctctggctccaagtctggtcaacaccggtccctccctagaccccccctatcctcgtcgggtcctccgacggcgtacgacgacgaggtcctagtatttacttactgacacgtctctaattaactaacctaaaccgacgactaacgtacctaacgttccgttaccggttacgggtttaccggggaccgggtaaccggggtaacccgaaacggtacccggttaccggtaaccccggttacccgtaaccgggtacccgtaaccgggaccccgaacgggtacccgtcccggtcccccggttacccggg

SEQ ID NO: 241211 - DNA, 559 bp, Homo sapiens
  misc_feature: GYAE6OF01ESXYK.35.27.C05.1.454.CMB.1.raw
  modified_base (408)..(408): a, c, t, g, unknown or other
  misc_feature (408)..(408): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccaggcaaacgcccccaaactcatgatttatgatgtcagtaactcggcccttcgaggggtttctaatcgtcttctctgctcaagtctgcaacaccggcctccctgaccatctcgtgggctcaggtctgacgacgngctgtatttattattgttgtcttacgattatgacgtaaggttagtacgctaacttaagtcgttacttacgggaacttcggggaacctaacgggtcctacccgtcgtacggtccacgaccccgaacggaccccaacccctctcgtctacccg

SEQ ID NO: 241212 - DNA, 628 bp, Homo sapiens
  misc_feature: GYAE6OF01CERE9.35.27.C05.1.454.CMB.1.raw
  modified_base (241)..(241): a, c, t, g, unknown or other
  misc_feature (241)..(241): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcacatctcctgcactggaaccagcagtgacgttggngctgataactatgtctctgtaccaacaccaccaggacaaacgccccaaatacttaaatttataaggacaactaagccgacctagagggtatttacaatcgcttctcgtggctaccaagtctcggactaacgtccggcctccctagactaatctacgtcgggctccgggctggacggacgtaggcttgtaatttagttattgttgtctacgattagtgtacgtaagggtagttacgactaacgttaattcggttacgttacggtaacgtcggggtaacctaagggtccctacccggttacgtaacggtcgaaccgtaccccgaaccgggtaccccaaccccgttaacgtccgtaccaacctttccttcccggttccccctaacccccg

SEQ ID NO: 241213 - DNA, 704 bp, Homo sapiens
  misc_feature: GYAE6OF01B43QT.35.27.C05.1.454.CMB.1.raw
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacgagggtcctgggcccagtctgccctgactcagcctgcctccgtgtctgggtcctccgtggacagtcgatcaccactctcctgcacgtcggaaccagcagtgacggttggtgctagaactaactatgtcctccgtacgtaaccaaacacccaaccgacggaccaaaccgaccccctaaatccaagttacgtaactttatacgtagtacgtacgtaagttaaccgtccggtcccctagggttacgggtttactaacgttcgtaccttcttcgtcgtctactaacgtcgtacgactaaccgaccgtcctcccgtacgacctactcgtcgtcgggtcctaccgaggtccgtacggacggtacggacgtacgtacgttaacgtttacgttacgtcgtaccgtaacgtcttaacctaagttaaactaacgaacggtacacggtacctacgaccttaccgtcggttaccgtcgggttacccgggacgggaaccggacgtacggcgtaccggtaccccggtacggtaccgtacccggaacggtaccccggacgtccccgtcccggtacccccgg

SEQ ID NO: 241214 - DNA, 504 bp, Homo sapiens
  misc_feature: GYAE6OF01CWWKU.35.27.C05.1.454.CMB.1.raw
  modified_base (164)..(164): a, c, t, g, unknown or other
  misc_feature (164)..(164): n is a, c, g, or t
  modified_base (461)..(461): a, c, t, g, unknown or other
  misc_feature (461)..(461): n is a, c, g, or t
  modified_base (489)..(504): a, c, t, g, unknown or other
  misc_feature (489)..(504): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggcccggttnaccatctccagagacaattccaagaacacactgaatctgcaaatgaacagcctgagagccgaggacacggccgtatatactgtgcgaaagcatatcgcgtattactatgcttcggagacttaaattgagctttgactactggggccagggaaccctggtcaccgtctcctcagcctaccaccaaggcccatcggtaccttcccctcggcaccctccgtccaagcgcacctctgggggacacaggtccgcccgtggctacgcctgggtcaaaggtctacttcccgaacgatctgtacngaagcgggctgggacaaggcgccatagnnnnnnnnnnnnnnnn

SEQ ID NO: 241215 - DNA, 550 bp, Homo sapiens
  misc_feature: GYAE6OF01BU7ZQ.35.27.C05.1.454.CMB.1.raw
  modified_base (369)..(369): a, c, t, g, unknown or other
  misc_feature (369)..(369): n is a, c, g, or t
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (537)..(540): a, c, t, g, unknown or other
  misc_feature (537)..(540): n is a, c, g, or t
  modified_base (542)..(550): a, c, t, g, unknown or other
  misc_feature (542)..(550): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacacactgaatctgcaaatgaacagcctgagagccgaggacacggccgtatattactgtgcgaaagacatatcgcgtattactatgcttcggagacttaaattgagctttgactactggggccagggaaccctggtcaccgtctcctcagcctccaccaagggccatcgtctcccctcgcnccctcctccacagcacctcgtcggggcaccagcccgggccctgggtccgtgtcccgtcgggtcaaacgggccttaaccgttcccaaccgacttctacgttaccgttggacggccggggcgtccgggacgaacgggtccgggcaacttacgggatcgngcgcngngngnnnngnnnnnnnnn

SEQ ID NO: 241216 - DNA, 592 bp, Homo sapiens
  misc_feature: GYAE6OF01BWDQA.35.27.C05.1.454.CMB.1.raw
  modified_base (475)..(475): a, c, t, g, unknown or other
  misc_feature (475)..(475): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagctggtctttttcttgtggtcttaattttaaaaggtgtccagtgtgaggtgcagctgttggagtcgtgggggagcttggtacagccgtgggggtccctgagactctcctgtgagcctcgtgattctaccttaggactatcgcatgtgcgtcgggtccgcgaggctccgaggggagggcgtggaggtggtctacgtagttagttaggtggtaggtggtagtaatactatacactacgcagtactcgtaggacggtccgtacaccatcctacagacgaactaataccaagaacacactagtaactcgtagaactaaatacgaaacncgccgtaggaacgacgaccggagaccgacggctaatacgttagtaggtacgaacgaaacactagttcgtacggtacgttaattaccgttaagttcggactttagggaagtttaaacg

SEQ ID NO: 241217 - DNA, 800 bp, Homo sapiens
  misc_feature: GYAE6OF01BR2FF.35.27.C05.1.454.CMB.1.raw
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccagtacaaacgcccccaaactcatcgtatttatgtatgtactagtaactccggccctacgtacggggtttactaagtccgtactttctcgtcggtccttaccgtaacggttccgtacgggacctaaaccgtaccgggtccccttaccccgtacggaaccctaacgttcccttcccggtcggggtcccttaccccggaacggggtccttacgggaaccggaaccgggtaacgggtaccgttacggtaactttttaacgttaaccgttcggtaccgttaggtttaccctaaagtttaaccgtaaacccgtaaaccccgtacggtaacccgtaacgtacccgttaacccgtttacccgttaccgggtttcgggtttacccgggggaccggggtaaaccgggggtaaacccgaacgggtaccgttacccgggtaaccccgggtttacccggttaaccgggtaccgaacccgggtaccccggtaaacgggtccccgttaccccgggtcccccccgttccgggttacccccg

SEQ ID NO: 241218 - DNA, 613 bp, Homo sapiens
  misc_feature: GYAE6OF01CCWV1.35.27.C05.1.454.CMB.1.raw
  modified_base (304)..(304): a, c, t, g, unknown or other
  misc_feature (304)..(304): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcatggaaccagcagtgacgtttggtgctgataactatgtcctctgtaaccaacacccaccaggacaaacgcccccaaatcatgatttangatgtacagtaatccgcctcgagggtttactaatcgtacttctcgtggcctaccgaagtcgtggacaaacctccggtaccctacccgtgaaccctacttccgtaccgtcggggcctaccgacgggtcctacggaacggaccggaacggtcctaggtacttttaagttaccgtagacgacgcttactaataactaaccgaagaccaagccagactaactcgtacgtggttccgggacggtacgggaccaaggtcctcggtaccgtccgtacggtaccaacgacccgtaaaggcccgtaccggtccccccg

SEQ ID NO: 241219 - DNA, 595 bp, Homo sapiens
  misc_feature: GYAE6OF01BPCZN.35.27.C05.1.454.CMB.1.raw
  modified_base (434)..(434): a, c, t, g, unknown or other
  misc_feature (434)..(434): n is a, c, g, or t
  modified_base (455)..(455): a, c, t, g, unknown or other
  misc_feature (455)..(455): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgttggagtcgtgggggaggcttgggtacaggccgtggggggtccctgagactctcctgtgacgcctctggacttcacctttaggaactatgccatgtgcgtcgggtccgcgaggtcctaccgagggggaagggcgtgggaggtgggtctcgtagttagtaggtggtagtggtgatactatacactacgcagaccgtcggtaggaacgggtccgtcaccatctaccaganacaataccaaagacacactanaactctagacaaatcgaaccagccctaggacgacggaccggaaggaccgaacggtcgtaaattacttacgtcgtacgaacgtaaagacaattacgtacgtacgttaacttaactagttacggtctttaggaagttaaacg

SEQ ID NO: 241220 - DNA, 656 bp, Homo sapiens
  misc_feature: GYAE6OF01DOVHG.35.27.C05.1.454.CMB.1.raw
  modified_base (242)..(242): a, c, t, g, unknown or other
  misc_feature (242)..(242): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtnctgataactatgtctctgtaccaacaccaccaggacaaacgcccccaaactcatgatttatgatgtactagtaactccggccctcgtagggttactaagtcgtcttctctcgctccagtctggacaacgccgtccctccgtacgacctactctccgtcgggtcctaccgacggtcctaggaaccggacggacggcttagtaatttacgttaacgtcgacgtacgtctacgtaactactaaacccaacctaagaccgtaacgtcctaaccgttccgttaccggttgggttaccggggaccggggtaaacgggaacccgtaacggtaccgtaccgggtaccccggttacccgtaacggggtacccgaaccggtaccccggaagggttccccgtacccggtccccccggttacccgg

SEQ ID NO: 241221 - DNA, 543 bp, Homo sapiens
  misc_feature: GYAE6OF01CDJ48.35.27.C05.1.454.CMB.1.raw
  modified_base (521)..(521): a, c, t, g, unknown or other
  misc_feature (521)..(521): n is a, c, g, or t
  modified_base (524)..(528): a, c, t, g, unknown or other
  misc_feature (524)..(528): n is a, c, g, or t
  modified_base (530)..(543): a, c, t, g, unknown or other
  misc_feature (530)..(543): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacacactgaatctgcaaatgaacagcctgagagccgaggacacggccgtatatactgtgcgaaagcatatcgcgtattactatgcttcggagacttaaattgagtctttgactacgtggggccacgggaaccctggtcaccgcctcctcacgcctccaccaacggcccactccggtccttccccctcggccacccctcctccaacgacgcaccctcgtcggggccacacggccggccccgtcggggcctcggccctgggtacaacggtactaccttccacgactctcgtactggacggcgggacgtgggaccgaagggtcgaccgtagtacgncgnnnnngnnnnnnnnnnnnnn

SEQ ID NO: 241222 - DNA, 513 bp, Homo sapiens
  misc_feature: GYAE6OF01BBT8T.35.27.C05.1.454.CMB.1.raw
  modified_base (241)..(241): a, c, t, g, unknown or other
  misc_feature (241)..(241): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggnctgatactatgtctcctggtaccaacaccacccaggacaaacgcccccaaactccatgtatttatgatgtcagtaactcggccctgtacggggttttactaagtcgtcttctctggctccaagtctcgacaacaccggcctccgtgaccatctcgtggctccgagctgacgcgagctgattatctgcagctactatactaccaactagcagcactctcgtgtcggcggacggacagctacgccgtcgtacgcacgccagctccgcccgtccg

SEQ ID NO: 241223 - DNA, 536 bp, Homo sapiens
  misc_feature: GYAE6OF01EQ93D.35.27.C05.1.454.CMB.1.raw
  modified_base (411)..(411): a, c, t, g, unknown or other
  misc_feature (411)..(411): n is a, c, g, or t
  modified_base (427)..(428): a, c, t, g, unknown or other
  misc_feature (427)..(428): n is a, c, g, or t
  modified_base (431)..(431): a, c, t, g, unknown or other
  misc_feature (431)..(431): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccaggacaaacgcccccaaactcatgatttatgatgtcagtaactcgccctcaggggtttctaatcgcttctctggctcaagtctggcaacaccggcctcctcgaccatctcgtcgggcctccgaggtctgacgacgnggctgattattctgcnnctnatataacaaccagacacgcactctcgtggttcggcggacgggaccgaagctacggtcccgtaccgtacggacaccgacccgaaggcctcccgcccccgttaccgg

SEQ ID NO: 241224 - DNA, 623 bp, Homo sapiens
  misc_feature: GYAE6OF01DULNC.35.27.C05.1.454.CMB.1.raw
  modified_base (306)..(306): a, c, t, g, unknown or other
  misc_feature (306)..(306): n is a, c, g, or t
  modified_base (371)..(371): a, c, t, g, unknown or other
  misc_feature (371)..(371): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccaggacaaacgcccccaaactcatcgatttangatgtacagtaatcggccctcgtagggtttctaatcgctttctctggctccgaagtctggcaacncggcctcctgaccattctcgtgggcctccgaggctacggaccgacggaggtcctagtaatttacttaacgtcgacctacgcttacaattaactaaccaaaccctaggacctacgaccctaaccttcgtccggttcgggttccgggaccgggtacgggaacccgtaaacggtcgttacggtacccggttaccgtagggttaccccgaacggacccccgtaagggccccttaccgggtcccccccgttaccggg

SEQ ID NO: 241225 - DNA, 548 bp, Homo sapiens
  misc_feature: GYAE6OF01AT28G.35.27.C05.1.454.CMB.1.raw
  modified_base (312)..(312): a, c, t, g, unknown or other
  misc_feature (312)..(312): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (388)..(388): a, c, t, g, unknown or other
  misc_feature (388)..(388): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
  modified_base (490)..(490): a, c, t, g, unknown or other
  misc_feature (490)..(490): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
  modified_base (540)..(540): a, c, t, g, unknown or other
  misc_feature (540)..(540): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagcggtgtcgtttctaggtggctaattttaaaaggtgtcagtgtgaggtgcagctgttggagtctggggagcttggacagccgtgggggtccctgagctctcctgtgaagcctcgtggattccgacctttaggaacttagtgcctagtgtgctggggtcccnccaggtctccgaggcgaagggctggagtggtggctagttgtgtggtatgnttggaaagttanagatactaagcganagacaccgtggaacggcgtatcnctatcaccaggacanaacgttcaaagtaactatttcggtcctagactaatgaaccagcttgagaacgcgtaagccgagngactatacgtacgtggtanacgngaagcgaagtcgggacacccgtaccgnttggaacg

SEQ ID NO: 241226 - DNA, 699 bp, Homo sapiens
  misc_feature: GYAE6OF01CZHWA.35.27.C05.1.454.CMB.1.raw
  modified_base (248)..(248): a, c, t, g, unknown or other
  misc_feature (248)..(248): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcaccatctcctgcactggaaccagcagtgacgttggtgttanactatgtctctgtaccaacaccaccagacaacgaccccaaactcatgtattttgagtcagtacgccggcctcgacgggtccctgactccgtcgttctcgtcggctaccgaagttcacgaccaacgtaccggccttaccccgttaccgtcctcggtcggtcctacgacgacgtaggaggtagtaggtcggacttagtacttaacttacgtacgactaacggtcttactaagttactacggaccgaacgggactaacggttaacccgttaaccgttttacggttacggttttacgggaccggggtaacgggtaaccgttaacgggtttaccggtaacccgttaaccggttaaacgttacccggaaccggtaccccggtaaacggtcccgtacccggttccccccttaccgggttacctacccgtttcccgttcccgttcccccgttacccccg

SEQ ID NO: 241227 - DNA, 689 bp, Homo sapiens
  misc_feature: GYAE6OF01ENGWT.35.27.C05.1.454.CMB.1.raw
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcagtgacgttggngctgaataactatgtctcctggtaccaacaccaccagacaaacgccccaaactcatcgtatttatgatgtcagtaactccggccctcgtacggggtttactaacgtcgtctttctcgtcggtcctcctaacgtcgtacgggaccaaacgtacccgggtcccttccccgtacgaaccctacgttccttccggtcggtacccgtccggacggtccgtacggaaccggaacggagggtacctagttactttaagttaaccgtgacctacgtcctactaacgttaactaaccaaaccgtaagtccaacgtacccgtaccttccggttaccggttccgggttacggggaccggggtaacgggtaaccgaacggtcccgtacgggtacccgttaccggtacggtacccgaaccgtaccccggaaccggtcccgttcccggccccccgttacccgg

SEQ ID NO: 241228 - DNA, 508 bp, Homo sapiens
  misc_feature: GYAE6OF01E1MJY.35.27.C05.1.454.CMB.1.raw
  modified_base (490)..(508): a, c, t, g, unknown or other
  misc_feature (490)..(508): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacacactgaatctgcaaaatgaaacagcctgagagccgaggacacggccgtatattactgtgcgaaagacatatcgcgtattactatgcttcggagacttaaattgagctttgactacgtggggccagggaaccctggtccaccgtctcctcagcctccaccaacggcccatcgtctccccctggcaccctcctccaagacgcacctcgtgggggccacgagccggcccgtgggctggccctcggtcaagggtacctacttccacgactctgtactgaggcgggctggcaagggcgcatgannnnnnnnnnnnnnnnnnn

SEQ ID NO: 241229 - DNA, 547 bp, Homo sapiens
  misc_feature: GYAE6OF01D7XW9.35.27.C05.1.454.CMB.1.raw
  modified_base (357)..(357): a, c, t, g, unknown or other
  misc_feature (357)..(357): n is a, c, g, or t
  modified_base (408)..(408): a, c, t, g, unknown or other
  misc_feature (408)..(408): n is a, c, g, or t
  modified_base (432)..(432): a, c, t, g, unknown or other
  misc_feature (432)..(432): n is a, c, g, or t
  modified_base (508)..(508): a, c, t, g, unknown or other
  misc_feature (508)..(508): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccaggcaaacgcccccaaactcatgatttatgatgtacagtaatcggccctcagggtttctaatcgacttctctgctcaagtcngacaacgacgcctcctcgaccatctacgtcggcctcgcgctaggacgacgnggacctagtatttactacgtgacncgactacataactaacaaccagaccagtacactcgttacgtcggtcggtaccgggacgggaccaggctcggtaccncggttagccctacggacccaaggcctccgccccgtccgg

SEQ ID NO: 241230 - DNA, 509 bp, Homo sapiens
  misc_feature: GYAE6OF01B42XZ.35.27.C05.1.454.CMB.1.raw
  modified_base (198)..(198): a, c, t, g, unknown or other
  misc_feature (198)..(198): n is a, c, g, or t
  modified_base (241)..(241): a, c, t, g, unknown or other
  misc_feature (241)..(241): n is a, c, g, or t
  modified_base (303)..(303): a, c, t, g, unknown or other
  misc_feature (303)..(303): n is a, c, g, or t
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (496)..(496): a, c, t, g, unknown or other
  misc_feature (496)..(496): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccagcagtgacgttggngctgataactatgtctcctggtaccaacaccaccagcaaacgcccccaaactcatgatttangatgtcagtaactcggccctcgtaggggtttctaatcgcttctctgctcaagtcgtgcaacgacgccctcctcgaccactctcgtggcctccgagctagacgacgagctgacttattctncagctcatatacacngcancactgtcgtgtcggcggaggacacgctcgccgtcgacgtcgacgaccgagtccnccgtccccgtcgg

SEQ ID NO: 241231 - DNA, 585 bp, Homo sapiens
  misc_feature: GYAE6OF01DHBE1.35.27.C05.1.454.CMB.1.raw
  modified_base (467)..(467): a, c, t, g, unknown or other
  misc_feature (467)..(467): n is a, c, g, or t
  modified_base (516)..(516): a, c, t, g, unknown or other
  misc_feature (516)..(516): n is a, c, g, or t
  modified_base (526)..(526): a, c, t, g, unknown or other
  misc_feature (526)..(526): n is a, c, g, or t
tcagtacagatcgtcacgaccggtgctcgatttagacgcgatcgaagggtttgggggagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgttggagtcgtgggggaggcttggtacaggccgtggggggtccctgagactctcctgtgacgcctctggattcaccttaggaactatgccatggtgcgtcgggtcccgccgaggcctaccggaggggaaggggcgtgggaggtgggtctcgtagtttagttaggtggtagtggtgattactatacactacgcagactcgagaacgggccgtacactatctcagacacaatccaaagacacactagaactctagacaaaagtcgaaacncgcctagaacgacggacccgaggaaccacgggaccttaattacttacgngacgacaaanactatacgtcgattattactagtcgaccgtttacggaattaaaccttaagttgacgttc

SEQ ID NO: 241232 - DNA, 1022 bp, Homo sapiens
  misc_feature: GYAE6OF01ARZIX.35.27.C05.1.454.CMB.1.raw
  modified_base (214)..(214): a, c, t, g, unknown or other
  misc_feature (214)..(214): n is a, c, g, or t
tcagtacagatcgtcacgaccggtgctcgatttagacgcgatcgaagggtttggggggggtctcaggaggacagcgctctcgggacgtactccaccagtggcctgggctctgctattcctcaccctcctcactcagggtcactagggtcctgggcccagtctgccctgactcagcctgcctccgtgtctgggtctcctggacagtcagtcaacntctcctgcactggaaccacatgacgttgtgttatagtctgtctcatgtaccaacaactaccaggcacgacgcccccaatcatgtacttttgaggtcaagtaggccggcctcgtacgggtccctgactcgtcttactcgtggcctacgaaagttccgtacgtaaccgaaaccgacccggtaccctttacccccttacccggttacccgttacccggtaccggggtacccttaaccccgtaaacggtaacccgttacgggtaaaccgggtaacgttacggggtaacgggtacccggttaaggttaaaccgtttttaaacgtttacccggttaaccgggtaaccgtaacggtacccttttaaccgtaaacgttttaaaccgggtccgggtaaacccggttaaccggggttaacccgttaaaccggggttaacccccgttttaaaaccccggggggtttttttaaccgggtttaaaccggggggtttttttttaaaccccggggggggtaaaccccgggggggtttaaaaacccgggggttaaaaacccccggttttaaaaacgggggttttaaaccccgggttaaaaccccccggggtttttaaacccccggttttaaaaacgggtttaaccccccggttttaaaccccggggttaaacccccccccggtttaaaaacgggggtccccccgtttaaccccccgggggttacccccccccgggttttaccccgggggttaaaccccccgtttaacccccgggttttaacccccggggtttaccccccgggtttttaccccccccccccgggg

SEQ ID NO: 241233 - DNA, 527 bp, Homo sapiens
  misc_feature: GYAE6OF01DKSK2.35.27.C05.1.454.CMB.1.raw
  modified_base (319)..(319): a, c, t, g, unknown or other
  misc_feature (319)..(319): n is a, c, g, or t
  modified_base (367)..(367): a, c, t, g, unknown or other
  misc_feature (367)..(367): n is a, c, g, or t
  modified_base (508)..(508): a, c, t, g, unknown or other
  misc_feature (508)..(508): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcaggacacagggtcctgggcacagtctgccctgactcagcctgcctccgtgtctgggtctcctggacagtcgatcaccatctcctgcactggaaccagcagcgatgttggggtatgaccttgtctcctggtatcaacagcaccaggcaaacgcccccaaatcttaattataaggacactaagcgacctnaggtattctaatcgcttctctggctcaagtctggcaacgtcgcctccngacaatctcgtgggctccgggctgaggacgaggctagtatttacttattgttgctcatagtgactaggtagtagactatagtgttcgttcggacgtgggaacctaggtccaccgtcgtagtacacgcccaacgccaacccntacgtcactctcgtacccc

SEQ ID NO: 241234 - DNA, 674 bp, Homo sapiens
  misc_feature: GYAE6OF01BU2ZC.35.27.C05.1.454.CMB.1.raw
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgatactatgtctctgtaccaacaccaccaggacaaacgcccccaaactcatgtatttatgatgtcagtaatccggccctcgtaggggttttctaagtccgtctttcgtcgtcggtcctaccgtaagttcgtacggaccaaaccgtaccggtccccttaccccgtcgaccctacttccgttacgtcgggtccctccggacggccgtacggaaccgtacggacggtacctacgttaagtttaactttaacgtcggactacgtccgtacttaacgtaaactaaccaacccgaacgtccgaacgtacccacgttccgttcgggtacggttcggggaccgggtaacgggacccgtaaggtccgtacggtaccccgttaccgtacggttaccgaaccggacccgtaacgggtcccgtcccggtccccccggttcgg

SEQ ID NO: 241235 - DNA, 719 bp, Homo sapiens
  misc_feature: GYAE6OF01CF0JI.35.27.C05.1.454.CMB.1.raw
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
  modified_base (327)..(327): a, c, t, g, unknown or other
  misc_feature (327)..(327): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatcctcctgcactggaaccagcagtgtacgttggtncgtagtaataactnttcgtcctccgtacgtaacccaaccacccacccgaggaccaaaaccgacccccaaactcattacgtatttangtaatgtactaagtaactccgtcccgttacgtacgggtttactacgtcgtcctttctcgtcggtctaccgtaagtctacggaccaaaccgccggtcccctaccccgtacgtaaccctacgttccgtcggttcggggaccctccggacggtacgtacggacgggaacggtcggtacttaggtaactttacgtttaccgtggtacctacggtaccttaacgtaacttaacctaaacgaacccctaagggtaccaaccgtacctaaccgttcccggttaggtaccgggttaccgggacgggtaacggtaacccgtacggtaccgttacccggtccggtacccgtacggtacccgacgtacccggtacggccccttcccgggtcccccgttaccgg

SEQ ID NO: 241236 - DNA, 719 bp, Homo sapiens
  misc_feature: GYAE6OF01APCI1.35.27.C05.1.454.CMB.1.raw
tcagtacagatcgtcacgaccggtgctcgatttagacgcgatcgaagggtttggggggggtcgtcgaggaggcagcgctctcgggacgtctccaccatggcctgggctctgctattccctcaccctcctcactcagggcacgagggtcctgggcccagtctgccctgactcagcctgccctccgtgtctgggtctcctggacagtcgatcaccattcctcctgccactcgggaaaccaggcaggtgtacggttggtagacttagaattaacttatgtcctccgtaggtaaccaacacccgaccgacggaccaaacgccccaaactcaatgtaacttatgtatgtacacgtaactacggcctacgtacggggtttactaacgtcgtctttctctggtcctaccgtaagtcgtcggaacctaacgaccggtaccctcccgtcgaccctacttacctcggtacggtcctaccgtaggtcccgtagggaccgaacggtacggccgttagtaacttacgttactcggactacgtactacgtaacgttaactaaccgaaccgtacgtaaccgtacgtaccgttaaccgtcggttccgggttacgggtaccggggtaccgggtaaccgggaaaccgtacggtccgttaaccgggtacccgttacccgtacggttaccggaacccgacccggtaaccgggcccgttccccggcccccggttacccgg

SEQ ID NO: 241237 - DNA, 649 bp, Homo sapiens
  misc_feature: GYAE6OF01ADFLJ.35.27.C05.1.454.CMB.1.raw
  modified_base (212)..(212): a, c, t, g, unknown or other
  misc_feature (212)..(212): n is a, c, g, or t
  modified_base (244)..(244): a, c, t, g, unknown or other
  misc_feature (244)..(244): n is a, c, g, or t
  modified_base (627)..(627): a, c, t, g, unknown or other
  misc_feature (627)..(627): n is a, c, g, or t
  modified_base (629)..(649): a, c, t, g, unknown or other
  misc_feature (629)..(649): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccgttcaccatctccagagacaattccaagaacacactgaatctgacaaatgaacngcctgagacgccgaggacacggctatatacgngtagacgaaagcatacgtacgtactaacttacgtagtcgtacgtacggtaagttaacttaagtagtacgttacgttacggtacgtacggtaccgggaccgtaaccggtacccgtcggtaccgtaccgtcctccgtacgaccgtacccgtacccgaacccggaccggtccctaccggttccccgttccccgtccccgccgtacccctaccccgtaccgtaccgaacgtaccgaccgtaccggtcgggcgggaccaccggtccggtcccggtccggtcggtcgtaccggtaccgtacggtaacccgtaacgttacccttaccgtacgacgtacgtacgtacgtacggacgggtacggcggtacgacgggacgtaggacctagagngnnnnnnnnnnnnnnnnnnnnn

SEQ ID NO: 241238 - DNA, 536 bp, Homo sapiens
  misc_feature: GYAE6OF01DX9XE.35.27.C05.1.454.CMB.1.raw
  modified_base (243)..(243): a, c, t, g, unknown or other
  misc_feature (243)..(243): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggngctgataactatgtctctggtaccaacaccaccaggcaaacgccccaaactcatgatttatgatgtacagtaatccggcctcgtagggtttctaatcgtcttctctgctcagtctgcacacgcctcctgaccatctcgtcggctcgaggctgacgacgacgctgtattatactgcagtctcaatacaaccaacagcagcacgttctcggttggtcggacgggacggaccgaacggtctacggtcccgtacgtaggtcccaacggacccgaacggtcctccgtcccccgtccgg

SEQ ID NO: 241239 - DNA, 553 bp, Homo sapiens
  misc_feature: GYAE6OF01E1MRO.35.27.C05.1.454.CMB.1.raw
  modified_base (242)..(242): a, c, t, g, unknown or other
  misc_feature (242)..(242): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (467)..(467): a, c, t, g, unknown or other
  misc_feature (467)..(467): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggnctgattaactatgtctcctggtacccaacaccacccaggcaaacgccccccaaactcatgatttatgatgtacagtaactccggccctcgtaggggttttctaatcgtcttcgtctcggctaccaagtcgtcggcaacaccggcctccctgaccatctcgnggcctcgnggctgacgagngtcngtattagttactgcagctacgaatatacaagtcaagtcacncactctgtcggtacgggcggtaacgggccaagcgtcggacccgttacgacggtccaacggaccccgaagggcctaccggtcccccg

SEQ ID NO: 241240 - DNA, 573 bp, Homo sapiens
  misc_feature: GYAE6OF01BSW9A.35.27.C05.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (301)..(301): a, c, t, g, unknown or other
  misc_feature (301)..(301): n is a, c, g, or t
  modified_base (393)..(393): a, c, t, g, unknown or other
  misc_feature (393)..(393): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatcctcctgcactggaaccngcagtgacgttggnctgaatactatgtctcctgtaccaacaccaccagacaaacgcccccaaatcatgtattangatgtacagtaactcgcctacgtagggttactaagtctacttctctcgctcaagtctagcacacgcctcctcgacctatctacgtcggtccncgtacgctacgacgtacggacgtctagtacttagtactcgtcagtcctacagttaacaacctaacacgtacactcacttcgtcggtcggtacgggaccggaacgggtaccgaacgtccgtacggtacccgttccggtacgtaccgacgacccgtaccggccgtcccgtccccgtacccgg

SEQ ID NO: 241241 - DNA, 551 bp, Homo sapiens
  misc_feature: GYAE6OF01CAMUQ.35.27.C05.1.454.CMB.1.raw
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (412)..(412): a, c, t, g, unknown or other
  misc_feature (412)..(412): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
  modified_base (447)..(447): a, c, t, g, unknown or other
  misc_feature (447)..(447): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (507)..(507): a, c, t, g, unknown or other
  misc_feature (507)..(507): n is a, c, g, or t
tcagtacagatcgtcacgaccggtgctcgatttagacgcgatcgaagggtttggggagctctgagagaggagcccagccctgggattttcaggttgttttcatttggtgatcaggactgaacagagagaactcaccatggagtttgggctgagcgtgtcgtttctaggtggtctatttaaaggtgtcagtgtgaggngcagcgttgtggagtgtggggacgtcttggacgngccgtgggggcctgagctctcngtagacgcctgaggtactcacgtttagattacgagccatgtcgcgtcggccgccaggccacgagggaacggtgtaggngtggtccngtagtagttagngtgtgtnacgtatntaacacgacgcgtaagcctcgtggacgtacgtcaacctgtcacgaanacgtaactaacgtacaanaacnactagactcgaanacaacanacanacgacgagacgacgacgacgacgacgtactagtagtagtagacgaaganagtacgtacgtacttacttactacgtagtacgtagtaagtaacg

SEQ ID NO: 241242 - DNA, 668 bp, Homo sapiens
  misc_feature: GYAE6OF01CRH8G.35.27.C05.1.454.CMB.1.raw
  modified_base (225)..(226): a, c, t, g, unknown or other
  misc_feature (225)..(226): n is a, c, g, or t
  modified_base (240)..(240): a, c, t, g, unknown or other
  misc_feature (240)..(240): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcatggaaccnncagtgacgtttggngctgactaactatgtctccgtgtaccacaccaccaggacaaacgccccaaatcatcgatttatgtatcgtactagtaacgtccggtccctaggtacgggtttactaacgtcgtacctttctctcgggtctaccgtaacgttcgtggacccaacgtacccggtcccttaccccgtgaaccctacttccgttccggtcgggtccctaccgtacggtcgttaccggaacggaccggtaacgggcttacggtaatttaaacttcgttacgaccggtatacctaactaacgttaaccaaaccgaaccaacggacaacgtacctacttcgtcggttggttaccggggacggaacggaaccgtaacggtaccgttacggtcccgttacgtacggttacaccggaccgaacggtcctcccggcccccgttaccggg

SEQ ID NO: 241243 - DNA, 647 bp, Homo sapiens
  misc_feature: GYAE6OF01BD3X7.35.27.C05.1.454.CMB.1.raw
  modified_base (242)..(242): a, c, t, g, unknown or other
  misc_feature (242)..(242): n is a, c, g, or t
  modified_base (305)..(305): a, c, t, g, unknown or other
  misc_feature (305)..(305): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggngctgataactatgtctctgtaccaacaccaccaggacaaacgccccaaactcatgtactttangatgtactagtaacgtcggccctacgtacgggtttctaacgtcgtcttctctcgtctcctaagtcgtggcaacgaccggcctccctacgacctacttccgtccgtcgggaccttccgaggtcctacggaaccggaacggacgggtccgttagtaacgtttacttaccgtagacctacggtactactaacttaactaacctaaccgacgtaccaacgcctacttcgttaccggttggttaccgggacgggtaacgggacccgtaagtcccgtacggtccccgttacccggttacggttaccgacgaccccggtacggtcccgtccccggtcccccgtacccgg

SEQ ID NO: 241244 - DNA, 597 bp, Homo sapiens
  misc_feature: GYAE6OF01BO65V.35.27.C05.1.454.CMB.1.raw
  modified_base (242)..(242): a, c, t, g, unknown or other
  misc_feature (242)..(242): n is a, c, g, or t
  modified_base (293)..(293): a, c, t, g, unknown or other
  misc_feature (293)..(293): n is a, c, g, or t
  modified_base (447)..(447): a, c, t, g, unknown or other
  misc_feature (447)..(447): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcaatcaccatcctcctgcactggaaccagcagtgacgttggnctgataactatgtctctgtaccaacaccaccagacaacgccccaactcatnattatgatgtacagtactcgcctgtacggttactatcgtcttctctcggcctcgtaacgtcgtgaccaacgaccgccctcccgtcgacctactccgtcgtcggtcctccgacggtctcggaccgacgtacggtctacgtatttagttactgccngtctactaacgtaacttaaccaacctacgacgacgtaccgtaccttaccgttcgtcggtcgggtccggaacggtacccgaacgtccgaccggtcccgtaccgtacggacgtaccggaccgtaacgggtccctcccgtccccggttacccg

SEQ ID NO: 241245 - DNA, 540 bp, Homo sapiens
  misc_feature: GYAE6OF01A5JYL.35.27.C05.1.454.CMB.1.raw
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
  modified_base (395)..(395): a, c, t, g, unknown or other
  misc_feature (395)..(395): n is a, c, g, or t
  modified_base (448)..(448): a, c, t, g, unknown or other
  misc_feature (448)..(448): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacntctcctgcactggaaccagcagtgacgttggnctgatactatgtctctggtaccaacaccaccaggacaaacgcccccaaactccatcgtatttactgatgtcagtaactcggccctcgtaggggttactaagtcgcttctctggctccagtctggacacacgcctcctgaccatctctgggctcgngtctgacgacgaggctagattatcgtgcagctacaatactacaacctagcacnctactctcgtcgttcggacgggaacggactacgcgtacggaccggtcccgttaggacccgacgacccgaggtccctccgtcccccgtaccgg

SEQ ID NO: 241246 - DNA, 721 bp, Homo sapiens
  misc_feature: GYAE6OF01D7QV0.35.27.C05.1.454.CMB.1.raw
  modified_base (205)..(205): a, c, t, g, unknown or other
  misc_feature (205)..(205): n is a, c, g, or t
  modified_base (381)..(381): a, c, t, g, unknown or other
  misc_feature (381)..(381): n is a, c, g, or t
  modified_base (694)..(694): a, c, t, g, unknown or other
  misc_feature (694)..(694): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagtcgtggtctttttcgtgtggtcttaagttttaaaggtgtaccagtgtgaggtncagtcgtggttggagtcggtgggggtacggtcgttacggtacgacggtccggttcggggggtcccctggaacgtcttccgtccgttgtacggaacgtcctcgttcggtaacttccgtaacccgtttaaggaaaccttagtcgtacctagttcggtcggtccggttcgggtaccccnccggtacgggtccgtaccggggaagggggaacgggtcgtaggggacggttcgggtctaggtaggttttagttagggttggtaggttgtagtacgtaactactaccgaacgtcgacgaacgtaccgtcgggaggtacgggtccgttaccacgtactctaccgaagtacaactaactacaacgaacacctagtataactgtagactaaacgtagaacgatccgtagacggtaacgccggaagtaccgtacgacttaacgttacgtcgtacgtagaacgtaaacgtactacgtagttccgtaacgttaacgttacnggttaacgtcggttacgaagttaaacg

SEQ ID NO: 241247 - DNA, 566 bp, Homo sapiens
  misc_feature: GYAE6OF01DJZP8.35.27.C05.1.454.CMB.1.raw
  modified_base (304)..(304): a, c, t, g, unknown or other
  misc_feature (304)..(304): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctaggtaccaacaccaccaggacaaagcccccaaatcatgatttangatgcagtaatcggcctagtagggttctaatcgcttctcgtgctccaagtctggacaacgccggtcctccgtgaccatctcgtcggcctccgaggctagacgacgaggctagtatttacgtacngcagtctanataactacaacctagcagcacttcgtacggttcgtcgggacggtaacgggaccaaaggtccgtacggtaacccggttaccgtaaggttccacgggtaaccccaggtaccctcccggtcccccgttacgg

SEQ ID NO: 241248 - DNA, 687 bp, Homo sapiens
  misc_feature: GYAE6OF01DJE3Y.35.27.C05.1.454.CMB.1.raw
  modified_base (245)..(245): a, c, t, g, unknown or other
  misc_feature (245)..(245): n is a, c, g, or t
  modified_base (486)..(486): a, c, t, g, unknown or other
  misc_feature (486)..(486): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgacactcggaaccagcaagtgtaccgttggngactgaattaacgtatgttctccgtcggtaaccaaccacccaccgaggacaaacgacccccaaatcctatgactttatgatactacaagtaacgtcggtcccttacggtacgggtttactaactcgtaccgttctcgtcggtcctaccgtaagtcgtcgaccaacgaccggtccctcccgtacgacctacttccgtccgtacgggacctccgacggtcgtacggaaccggaccggacggtnttacgtattacgttaacgtgaccgtacgtctactaactaccttaaacccaacgacgtaccacgaccttaccgttccgtacggttcccgggtacgggtacccgggaagggtaccctaacggtcgttaaccggtaccccggttacgacggtaacccgacccggaccggtaacccggtcccgtccccggccccgtttacccggg

SEQ ID NO: 241249 - DNA, 688 bp, Homo sapiens
  misc_feature: GYAE6OF01DK9A2.35.27.C05.1.454.CMB.1.raw
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtccgatcaccatcctcctgcacgtaggaaccngcaggtcgtacggttggnctagaattaactagtcgtcctccgtagtaaccaacacccaccgagaccaaaccgccccaaatcatgtatttangatgtanaacgtactccggtcctggtacggttactacgtcgtcttctacgtgtcctacgtagtcgtacggaccaaaccgtccgtccctaccgtagaccctacttccgtcggtcggtacctccgaggtccgtacggaccgacggtacggtctagttaatttacgttacgcgtactacgtctaactaacttaccgaaacctaccgacgtacctacgtacctaaccgttcgtccggttacgggtcccgggaacgggtaaccggtaacccgtaacggtccggttaacccggtacccggttaccggttaaccggacccgtaacccggacccggtaaccggtccccgttcccggtccccccggtttacgg

SEQ ID NO: 241250 - DNA, 610 bp, Homo sapiens
  misc_feature: GYAE6OF01CIPFV.35.27.C05.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
  modified_base (595)..(595): a, c, t, g, unknown or other
  misc_feature (595)..(595): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctctcactcagggcacgagggtcctgggcccagtctgccctgactcagcctgcctcgtgtctgggtctctggacagtcgatcaccatcnccngcactgaaccagcagtgacgttggtgctagataactntgtctctgaccaacnccacgagacaacgccccaaatcatgtattagcatcgactagtaactcgccctgtagggtttacctaacgtcgtcttcgtcgtacggccttaccgaagtttcctaggtaccaaacgcccggtcccttccgtacgacctacgttcgtccgtcgggtctccgaggtctacgacgacgacgctagactttataccgtgcgtactctactaacttaacaaaccacctaacgtccgaagtcctaaccgttcgttccgtcgggttccgggaacggacggaacccgaaagtccgtcggtacccgtaccgttacggacctacggacccgaaggttccccnccggtccccgttccg

SEQ ID NO: 241251 - DNA, 570 bp, Homo sapiens
  misc_feature: GYAE6OF01BLEXJ.35.27.C05.1.454.CMB.1.raw
  modified_base (276)..(276): a, c, t, g, unknown or other
  misc_feature (276)..(276): n is a, c, g, or t
  modified_base (334)..(334): a, c, t, g, unknown or other
  misc_feature (334)..(334): n is a, c, g, or t
  modified_base (401)..(401): a, c, t, g, unknown or other
  misc_feature (401)..(401): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagcgtagtggttgggggttatggtaccttgtctcctggtactcaacngcacccaggacaaacgcccccaaactcttaatttataaggacacgtaagccgaccctnagggtatttctaatcgacttctctgctcaagtctggcactcgcctcctgacatctcgtggctccggntggagacgaggctaggtattattagttgttgtctacattatgcgtaggtagtacgactaactaagttcgttcgttacggaacgtacggaaccaaggtccaccgtccgtaggtccacgacccgaacggccccaaacccacttcgtaccacttcctcgttccccctacccg

SEQ ID NO: 241252 - DNA, 690 bp, Homo sapiens
  misc_feature: GYAE6OF01A2U90.35.27.C05.1.454.CMB.1.raw
  modified_base (228)..(228): a, c, t, g, unknown or other
  misc_feature (228)..(228): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgctgataatatgtctctggtaccaacaccaccaggacaaacgcccccaaactcatagtatttatgatgtacagttaactccggtcccgtacgtacggggtttactaacgtccgtccttctcgttcggtcctacctaacggttcgtacggtaccaaaccgtaccgggtcccctaccccgtacggaccctattcccgttccggtccgggtccttacccgagggtccgttacggaaccggaaccggaggtaccgttaggtaactttaacgttaccgtcgtacgtacgtccttactaactaacgtaacctaaccgacggtacacgtcctacgttaccgttcgttacgggtccgggacgggaccgggtaaccgaacggtacgtaccggtacccggttacgttacggtaccgtaccggaccccggaaggcccgtcccgtcccccggttcccggg

SEQ ID NO: 241253 - DNA, 682 bp, Homo sapiens
  misc_feature: GYAE6OF01CWPH9.35.27.C05.1.454.CMB.1.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgacactggaaccngcagtgcgttggtnctgataactatgtctcctgtaccaacaccaaccaggacaaacgcccccaaactcagtgtattatgtatcgtctaagtaagtcccggcccttacgtaacggggtttactaacgtccgtcctttctccgttcggtccttaccgtaagttccgtacggacctaaaacccgccccggtacccgttacccccgtacggtaaccctaacgttccttccggtacgggttcccgtacccgtaggccgttacggaccggtaacggtacggtcgttacgttaagtttaacgttacgtacggtcctaacggtcctacgtaacttaacgtaaccaaaccgaagcacgtactacctcgtacgttcggtccggacgggtacggaccgtacgacttaccggtaaccgtcccgtaagtccgtaaccgaccgacggccctccggtccccgttccgg

SEQ ID NO: 241254 - DNA, 884 bp, Homo sapiens
  misc_feature: GYAE6OF01CCOEU.35.27.C05.1.454.CMB.1.raw
  modified_base (333)..(333): a, c, t, g, unknown or other
  misc_feature (333)..(333): n is a, c, g, or t
tcagtacagatcgtcacgaccggtgctcgatttagacgcgatcgaaggggtttgggggggggtctcaggaggcagcgctctcgggacgtctccaccatggcctgggctctgctattcctcaccctcctcactcgaggcacagggtcctgggcccagtctgccctgactcagcctgcctccgtgtcgtggtctcctggacagtcgatcaccatcctcctgccacgtacggaaccagcaagtggtacgttggttagttaactaaactgtgttctccgtagtaaccaacaccaaccgaggtaccaaaccgaccccaaactcattagtaacttttanaggtattacgtacgtaaagtacgttccggaccccgttaggttaacggggtttacctaagtccgttccgttacgtccgtcggtacctaccgtaaggtccgtaccggaacctaaaccggtacccggtccctacccgtacgaacccttacgtccgttcggtaccgtcccgtacccgtaggtccgtaacggaaccggaacgtacgggtaacttagttaaaacgttttaccgttaagcccggtacgtaacgtacccttaaacgtaaacgtttaaaacctaacccggaaaaccgttacgggaacccttaaacggtaccccgttaaacgtttccccgggttacggggttttaccgggtaaacccgggggaaaccggggttaacccgggaaaaccgttaacccggtccggttaaaccccggggttaaccccggttacggtttaacccgggaaccccggtaaaccccggttaaaccccgggtaaccccgggtaacccccggtttttcccccgggaccccccccgtttttaaacccggggttccctttaaaccccccgggg

SEQ ID NO: 241255 - DNA, 701 bp, Homo sapiens
  misc_feature: GYAE6OF01CCVUP.35.27.C05.1.454.CMB.1.raw
  modified_base (226)..(226): a, c, t, g, unknown or other
  misc_feature (226)..(226): n is a, c, g, or t
tcagtacagatcgtcacgaccggtgctcgatttagacgcgatcgaagggtttggggggggtctcaggaggcagcgctcgtcggggacgtctccgaccatggcctgggctctgctattcctcaccctcctcactcaggcacagggtcctgggcccagtctgccctgactcagcctgcctccgtgtctgggtctctggacagtcatcacatctctgcactcggaaccngctaggtgtacgttggtgacgtgaattaacttagtcggttccttccgtacggttaaccaacctaccacccgaaggtaccaaaccgcccccaaactcatgtaactttatagactcgtactagtaacgtccggaccctcgtagggtttacctaagtcctcgtttctcgtcgtcccgtacctaacgtcgtacggtacaaccggtccggccctcccgtacgacctactccgtcgtacgggtaccctccgaagtcgtagtaccggacgtaggcctaggtaactttcgtaacgttgactacgtctacgtaactaccgtaaccgaactaggcctacgtacccgtaacgttccgttaccggtacggtttaccggggacggtaccgggtaaacccgacgttccggttacgggtacccgttaccggtaacggtacccgaaccggtacccgtaacgggtcccgtcccggtaaccccgttacccggg

SEQ ID NO: 241256 - DNA, 756 bp, Homo sapiens
  misc_feature: GYAE6OF01DRHW6.35.27.C05.1.454.CMB.1.raw
  modified_base (196)..(196): a, c, t, g, unknown or other
  misc_feature (196)..(196): n is a, c, g, or t
  modified_base (237)..(237): a, c, t, g, unknown or other
  misc_feature (237)..(237): n is a, c, g, or t
tcagtacagatcgtcacgaccggtgctcgatttagacgcgatcgaaggggtttgggggggggtctcaggaggcagcgctctcgggacgtctccaccatggcctgggctctgctattcctcaccctcctcactcgagggcacgagggtcctcgggcccagtctcgccctgactcacgcctgcctcgtgtctgggtcncgtggacagtcgatcactactctcctgctacgtcggaaccngacgtaggtggtacggttgggtctagtagtaacttaactagtcgtcctccggtacggtaaccaaacctaacccgaccgaacggaccaaacccgtaacccctaactacaagtttataactttacacggtacttacgtaccgtaacgttaaccgtcccggttaccgttacggtttaacgggttaccttacggttccggtaccttcgttccgtaccgtactaacgttaacggttcgtacggaaccgtaacccgaccgtccccgttactaccggtaaccttcgttccgtcggtcggtacccgtcgggacggtaccgtacgggaaccgtacgggtacgttactacgttaactttacgtacgctacggcttacatacgtaaccaacaacgctacgactaccgttacgtccgtttacggaccgggttcggaccgggaacgtacgtaccgttcggaccgttacccggtcgttaaccggccgtaaccggtacggaccccgtttccccggtcccggtccccgttaccgg

SEQ ID NO: 241257 - DNA, 597 bp, Homo sapiens
  misc_feature: GYAE6OF01BANJC.35.27.C05.1.454.CMB.1.raw
  modified_base (226)..(226): a, c, t, g, unknown or other
  misc_feature (226)..(226): n is a, c, g, or t
  modified_base (308)..(308): a, c, t, g, unknown or other
  misc_feature (308)..(308): n is a, c, g, or t
  modified_base (508)..(508): a, c, t, g, unknown or other
  misc_feature (508)..(508): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctcgccctgactcagcctgcctcgtgtctgggtctcctggacagtcgatcacatctctgcactggaaccngcagtgtacggttggtgctgaataactatgtctctagtaaccaacaccaccaggacaaacgaccccaaatcaatgtatttangatgtacagtaactccggacctacgtaggactacccttaagttccgtttctacgtggtacctaccgtaagtctacggctaagtcgccggtccttaccgtcgccctatcctcgtacgacctcgaggcctaggaacgggacgagtcgtagtaactttagtggaagtctagttaaccttaagtaagtaagaacgctaaggttnacccttattacgaacgttagtacgttcggacggtagacctaagcttcggaacccttcgaagtcaagacccgaggtccgccgtacccccg

SEQ ID NO: 241258 - DNA, 515 bp, Homo sapiens
  misc_feature: GYAE6OF01AC8LX.35.27.C05.1.454.CMB.1.raw
  modified_base (241)..(241): a, c, t, g, unknown or other
  misc_feature (241)..(241): n is a, c, g, or t
  modified_base (305)..(305): a, c, t, g, unknown or other
  misc_feature (305)..(305): n is a, c, g, or t
  modified_base (437)..(437): a, c, t, g, unknown or other
  misc_feature (437)..(437): n is a, c, g, or t
  modified_base (454)..(454): a, c, t, g, unknown or other
  misc_feature (454)..(454): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgataactatgtctcctggtaccaacaccacccaggcaaacgcccccaaactcatgatttangatgtcagtaactccggccctgtaggggtttctaatcgtcttctctggctccaagtctggcaacaccggccctccctgacctatcctcgtgggcctccaggctgacgacggagctgtattatactgcagctnatactacaaccagacancactctcgtgttcggcggaggacagctggccgtcgtagcacgaccgaagctcgcccctcgg

SEQ ID NO: 241259 - DNA, 685 bp, Homo sapiens
  misc_feature: GYAE6OF01CVO6K.35.27.C05.1.454.CMB.1.raw
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
  modified_base (510)..(510): a, c, t, g, unknown or other
  misc_feature (510)..(510): n is a, c, g, or t
tcagtacagatcgtcacgaccggtgctcgatttagacgcgatcgaagggtttggggggggtctcaggaggcagcgctctcgggacgtctcccaccatggcctgggctctgctattcctcaccctcctcactcagggcacgagggtcctgggcccagtctcgccctgactcagcctgcctccgtgtcgtgggtctccgtggacagtccgatccaccnttcctcctgcacgtcggaaccagctaggtgtacgttggngctagattaactatcgtcctcgtacgtaaccaaccacccaaccgacgaaccaaaccgaccccaaatacatagtattatagatgtactaagtacgtccgtccttaggtaggttactaacgtcgtacttctacgtcggtaccctacgtaagtcgtacgtaccgaaccgacccgtcccttacccgtacgacctactccggtcgtccgggtacctcccggagtcgtacggaaggtaccgaggtcttagtagtttactcngacagactataacactaaaccgacgtaagcctaagtacctaccttcggttaccgggttggttaaccggggacgggaaaccggtaaccgtacggtacccgtaccggttacccggttccggttaacggaccgtacccggaacccggtaacgggcccccttcccggtaccccggtccg

SEQ ID NO: 241260 - DNA, 665 bp, Homo sapiens
  misc_feature: GYAE6OF01CO1FN.35.27.C05.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (455)..(455): a, c, t, g, unknown or other
  misc_feature (455)..(455): n is a, c, g, or t
  modified_base (492)..(492): a, c, t, g, unknown or other
  misc_feature (492)..(492): n is a, c, g, or t
  modified_base (502)..(502): a, c, t, g, unknown or other
  misc_feature (502)..(502): n is a, c, g, or t
  modified_base (512)..(512): a, c, t, g, unknown or other
  misc_feature (512)..(512): n is a, c, g, or t
  modified_base (521)..(521): a, c, t, g, unknown or other
  misc_feature (521)..(521): n is a, c, g, or t
tcagtacagatcgtcacgaccggtgctcgatttagacgcgatcgaaggggtttggggggggtctcaggaggcagcgctcgtcgggacgtctccaccatggcctgggctctgcctattcctcaccctcctcactcagggcacgtagggtcctcgggcccagtctcgccctagcctcagcctgccctcgtgtctgggtctcgtggacngtcatcacntctctgcactgaacngtcagtgacgtgtgactgaatacgtatcgtccgtccgtagaaaccaaccacccgaaccgacggaaccctaaacccgaaccccctaaatacctaaggtattaaattataggtacttcgtaacgtaagtaaccgtcccggttcccgtaggttaacgggttacttagccgttacttcctcgttggacctacgacttacgcgaaccacggaccgtccttaccacgtacnctccgtcgtgccgtcgcgtcgcggaagtacggacgtntacgtaattntacgcgtacntcaacgtanaccgtaacacccgaagtacacgtcctaggtccgttacggtgggttacccgggaaaggaccgtacggtacggtactaacccggtccgtccggtaaccgacggtacccgaacccgttaccggcccgtacccccgtccggttacccg

SEQ ID NO: 241261 - DNA, 713 bp, Homo sapiens
  misc_feature: GYAE6OF01BV16B.35.27.C05.1.454.CMB.1.raw
  modified_base (175)..(175): a, c, t, g, unknown or other
  misc_feature (175)..(175): n is a, c, g, or t
  modified_base (515)..(515): a, c, t, g, unknown or other
  misc_feature (515)..(515): n is a, c, g, or t
  modified_base (635)..(635): a, c, t, g, unknown or other
  misc_feature (635)..(635): n is a, c, g, or t
  modified_base (660)..(660): a, c, t, g, unknown or other
  misc_feature (660)..(660): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcgaggcacgagggtcctcgggccctagtctcggccctagacctcncgcctcgcctccggtgtcgtgggtcctccgtggacagtcatccacctctctcctgctacgtaggaaccagcgtagtgtacggttggcgtctagtaactaactgttcgtcctcgtacggtaaaccaaccgaacccaccgaacggaaccaaacccgacccccctaaatacctaagtagttaattttacgagtacgttacgtacgtaacgttaacgtcccgtaccgttacggttacgggtttctaacgtcgttcttacgtccgtcggtcctaacgtacgtttcacgggacctaaccgtccgtccctaccgtacgaccctcttcctcggtacggtcctaccggngtacccgtaggaaccggtcggtaacggctttaacgggtaacgtttcgggttagacggtttctacggtactttaagtagtaacggagtacgtacgtccgaaccttcgtacgtacgttacgngttaccggacggtacgaccgtaggntacccggacttcggactacgaccgtacccgaggtcctacccggcgttacccgg

SEQ ID NO: 241262 - DNA, 673 bp, Homo sapiens
  misc_feature: GYAE6OF01ACLSX.35.27.C05.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctcgccctgactcagcctgcctccgtgtcgtgggtctcctggacngtcgatcaccntctctgcacgtggaaccngctagtgtacgttggcnctagaattaacgtatcgtctccgtacgtaaccaaccaccaccgaggaccaaccgaccccaactcgatagtattacagtactcgtactaagtaccgtccggtcccgttacggttaacgggttttcctaacgtccgttacttcgtacgtcgtaccctacgtaacggttcgacggtaactaccggtacccgtccttaccgtacaccgtacgtacgtccggtcggtacctaccggacggtccgacggtaaccgacgggtacgttactagggttaactttactacgtcgtacgtctactaacgtaactaaccgaaccaacgactacgacgtactacgtcgtacggttcggtcggaaccgggaagccgtaacgccggttaccgtacggtacacggtacccgacggtacccacggtaccctcccgccgttaccg

SEQ ID NO: 241263 - DNA, 653 bp, Homo sapiens
  misc_feature: GYAE6OF01ELDHO.35.27.C05.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (302)..(302): a, c, t, g, unknown or other
  misc_feature (302)..(302): n is a, c, g, or t
  modified_base (380)..(380): a, c, t, g, unknown or other
  misc_feature (380)..(380): n is a, c, g, or t
  modified_base (425)..(425): a, c, t, g, unknown or other
  misc_feature (425)..(425): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggngctgattactatgtctctgtaccaacaccaccaggacaaacgccccaaactcatgatttangatgtacaagtaatccggcccttcgtacgggtttactaatcgtcttctcgtgcctacagtctggcaacacgcctccgngacctatccgtcgtcgggtcctccgtaggctacggaaccgacggnggtaccgttagtaatttaacgttaccgtgtactacgtccttacaattaaactaaccaaccgtaagaccctaaggtccaaccttccgttacggttcgggttacccgggcggggtaaacccgggtaccgtaaaccgggtccttaccgggtaacccggttaccgttaaccggggaccctaaccggtaacccccggaacggtccccgttcccggtcccccccggttaccggg

SEQ ID NO: 241264 - DNA, 716 bp, Homo sapiens
  misc_feature: GYAE6OF01B0L0W.35.27.C05.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (310)..(310): a, c, t, g, unknown or other
  misc_feature (310)..(310): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacagtcgactcaccatcctcctgcactcggaaccngcagtcgacgttggngctgactaactatgtctctggtaccaacaccaccgaggacaaacgccccaaatcatagtatttancgtagtgtactacgtaacgtccgtacccgtagtagggttactaatccgtctttacgtcgtcgcctactaacgttcgacggtacctaaccgaccgggtccctaccgtacgtaaccgtacttaccgtcgtacgggtcctaccggacggtcgtacggaaccgtacggtacggtaccgttacgtaacgttttaacgtaccgtacgtaccgtacggttacctacgtaaacgttaaccgtaaccgtaaaaccgcgtaaccgacgtacccgtaccgttaccgttaccgggttcgggttacccggggacggggtaaaccgggtaccggtaacgtccggtaaccggtaccgttaccgtaacgggttaccgacggtacccggtaaacggtcccgtacccggtcccccgttaccggg

SEQ ID NO: 241265 - DNA, 698 bp, Homo sapiens
  misc_feature: GYAE6OF01DT2N3.35.27.C05.1.454.CMB.1.raw
  modified_base (241)..(241): a, c, t, g, unknown or other
  misc_feature (241)..(241): n is a, c, g, or t
tcagtacagatcgtcacgaccggtgctcgatttagacgcgatcgaagggtttggggggggtctcaggaggcagcgctctcgggacgtctccaccatgtcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgataactatgtctcctggtaccaacaccaccaggcaaacgcccccaaactcaatgatttatgatgtcagtaactcgcctgtagggttcatcgcttctctcggcttaccaagtcgtcggtacaaacccgaccgggtcccttcccccgtacggaccctaacgttccgttcggttcggggacccttcccgaaggtcccgttaggaccggaaccggacgggtcctaggtaatttaacgtttcgtggaccgtacgtacctactaagtttaaccaaccaacccgaaggtccaagtaccctaccgtttaccggttaccgggttcggtttaccggggaccggggaaaccggggtaacccctaaagggtccctacggggtaaccccgttacccggttaacggggtacccaccgggaacccccgtaagggtcccccgttcccggtcccccccggtttacccggg

SEQ ID NO: 241266 - DNA, 583 bp, Homo sapiens
  misc_feature: GYAE6OF01CU1LM.35.27.C05.1.454.CMB.1.raw
  modified_base (212)..(212): a, c, t, g, unknown or other
  misc_feature (212)..(212): n is a, c, g, or t
  modified_base (507)..(507): a, c, t, g, unknown or other
  misc_feature (507)..(507): n is a, c, g, or t
  modified_base (555)..(555): a, c, t, g, unknown or other
  misc_feature (555)..(555): n is a, c, g, or t
  modified_base (559)..(559): a, c, t, g, unknown or other
  misc_feature (559)..(559): n is a, c, g, or t
  modified_base (561)..(563): a, c, t, g, unknown or other
  misc_feature (561)..(563): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (570)..(571): a, c, t, g, unknown or other
  misc_feature (570)..(571): n is a, c, g, or t
  modified_base (573)..(578): a, c, t, g, unknown or other
  misc_feature (573)..(578): n is a, c, g, or t
  modified_base (580)..(582): a, c, t, g, unknown or other
  misc_feature (580)..(582): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacacactgaatctgcaaatgaacngcctgagagccgaggacacggccgtatatactgtgacgaaagcatatcgcgtattactatgcttcggagtacttaaagttgagttctttagacgtacgtggggaccgtacgggaacccgtggtcctaccgtctcccgtcaacggccctacccgaaccgaacgggcccctagttcccggttacccttttccccccgcggccctaaccccgttcctaccgaacgacgtccacccgtcggtcggggaccacgacggcccggccgtggctcgccgtcggacaacggccttctccacgtntccgtgtacgtggaggtcggacgtgggacgaacggcgaccgagtacgnacgngnnncgngncnncnnnnnncnnnc

SEQ ID NO: 241267 - DNA, 718 bp, Homo sapiens
  misc_feature: GYAE6OF01COMX7.35.27.C05.1.454.CMB.1.raw
  modified_base (242)..(242): a, c, t, g, unknown or other
  misc_feature (242)..(242): n is a, c, g, or t
  modified_base (456)..(456): a, c, t, g, unknown or other
  misc_feature (456)..(456): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggcagtcgatcaccatcctcctgccactggaaccagcagtgacgttgngctgataactatgtctccgtgtaccaacaccaccgagacaaacgccccaactcatacgtatttatcgatgtactaagtaacgtccggacccttacggtacgggtttactaacgttcggtcctttcgtacgtcggtcctaccgtaagttctacggacctaaccgaccggtcccttacccgtacgacctacttccgtcgtccgggtacctaccggngtaccgtacggaccgacggacggtaccgttagtaacgtttacgttaccgtcgaaccgtacgttcctaactaattaacccgtaaaccgaacccgagtaccgactacccgtacccttcggttaccgggttacgggttccggggaacgggtaccgggaacccgtaacggtccgttaacccgggtaacccggttcccgggttaaccggtacgaacccgggaccccgtaacgggttccccgaccccgggtccccccgtttacccggg

SEQ ID NO: 241268 - DNA, 758 bp, Homo sapiens
  misc_feature: GYAE6OF01A3MSA.35.27.C05.1.454.CMB.1.raw
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (292)..(292): a, c, t, g, unknown or other
  misc_feature (292)..(292): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccacatcctcngcactgaaccngcagtgacgttggcntgaatactatcgtctcgtagtaccaacaccaccagacaaacgccccaaancatgtattatgactgtacagtaactcggacctgtacgggtttctaagtccgtacttacgtcgtcggtactaccgtaacgttcgtacggtaaccgtaaaccgtacccgggtacccttaccccgtaacgtaacccctaacggttcccgtttaccggtccggggtacccttccccggtaacgggtcccgttaacgggaaaccgggtaacggtaaccgggttaccgttaacgttaacgttttaaacgttaccgttacgtaaccgtaccggtaccttaaccgttaagtaacccgttaaaccgaaaccctacgggtaaccgaaccgttacgtaacccctttccggtaccggttacgggttaccgggcccggttaaaccgggacccgtaaggtaccccgtacgtaacccggtccgttaacggccggaacccgtacccggaaccgggtccctccccgggtaccccccgtacggg

SEQ ID NO: 241269 - DNA, 812 bp, Homo sapiens
  misc_feature: GYAE6OF01A2RA2.35.27.C05.1.454.CMB.1.raw
tcagtacagatcgtcacgaccggtgctcgatttagacgcgatcgaagggtttgggggggggtctcaggaggcagcgctcgtcgggacgtctccaccatggcctgggctctgctattcctcaccctcctcactcgacgggcacgagggtcctcgggcccagtctcgccctgactcacgcctgcctccgtgtcgtgggtctctggacagtcgactcaccatcctcctgcacgtcggaaccagcacgcgtagttgggttaggggttactgtaccttgtcgttccgtaggttactacaacgtacgaccaaccgaggaaccaaaccgaccccctaaattacttaaatttacgaaacgactaacgtaacgaccgacctaggtaacggtactttactaacgttccgtacctttaccgtcgtacggtaccttaccgtaaacgttccgtacggacctaaccggtacccgtcccgtaacccgtagtaaacctaacgttcccggtcgtccggggtacccgtccgggtaagtacgggtaacgggaaccgggtagtaaccgttaggtttaactttaagtttacgttcggttacgtactacgtaacgtcgtacggtacggttaagggttaacgtaacgtaccgtttaacgttaggtttaccggttaccgtttaacgggtaaccgggttaccgggaaccgttaaccggggtccttaacccgggttacgtaacggtacccgacccggaaccccgtaaacccgggaccccctaaacccgtcggtttaccgaccttaccccgttacgttccccggttcccccgtaccccg

SEQ ID NO: 241270 - DNA, 705 bp, Homo sapiens
  misc_feature: GYAE6OF01CY811.35.27.C05.1.454.CMB.1.raw
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
  modified_base (311)..(311): a, c, t, g, unknown or other
  misc_feature (311)..(311): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgaatccaccatctcctgcacgtggaaaccngcagtgtacgttggngctgataactatgtctcctagtaaccaacaccaccgagacaaacgcccccaaatcatgtattangatgtacagtacgtccgtcctagtacggtttctaactcgtcttctcgtcgtctaccgtaagtctcggacctaaaccgccggtccctacccgtagaaccctacttcgtccgtcgggaccttacccggacggtccgtacggaaccggtaacggtacggtcttaaggttaactttacttaccgtcgtaccgtacgtaccttacgtaacttaaccgtaaccgaaaccgtacgtccgaacgttcccgtaacctttcggtaccgggttacgggttacccgggacgggtaaccggtaacccgtaacggtacccgttacccggtaaacccgttacccggttaacggacctaccccggtaacccggtaacggtaccccgtccccggtccccccggttaaccgg

SEQ ID NO: 241271 - DNA, 655 bp, Homo sapiens
  misc_feature: GYAE6OF01BZ6KT.35.27.C05.1.454.CMB.1.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (314)..(314): a, c, t, g, unknown or other
  misc_feature (314)..(314): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcaccatctcctgcactggaaccngacagtgacgttggnctgaataactatgtctcgtacgtaacaacaccaccaggacaaaccgccccaaaatcatacgtatttacgngtactgtacctaagtaactcccggccttacggttagggttacctaacgtcgttccttctcgtcgtaccgtacgtacgtcgtacggacctaaaccgaccggtccctaccgtacgacctactccgttccggtcggtaccttaccgacggtaccgttacggaaccggtaacggacggtactttacgtaacgtttaacttacgcgactacgtacctaataacgtactaaaccaccgatacccgactaccgtactcgtcggtacggttccgggacgggtaacgaaccgtgccgtacggcccgtacgtacgtaccgacgacctaacgggccttcccgccccgttcgg

SEQ ID NO: 241272 - DNA, 716 bp, Homo sapiens
  misc_feature: GYAE6OF01DQT13.35.27.C05.1.454.CMB.1.raw
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtggaaccagcagcgtagtggtttgggggtatcgtccttgtctcctggtatacaacagaccaccaggaccaaacgacccccctaaacttaccttttaaatttaactaaacgggaacctaaccgtaacggacccgtaaccccttacggaacgggttaacttttactaaattccgttcctttccgttcgttcggaccttacccgtaacgttccgtacggaccaaaccgtacccgggtccccttccccgtaccgtaaccctacgttccttccggttcgggtccctaccggacggtcccgtacgggtaccggaacgggacggtccttaaggttactttaactttaccgtagaccgtacgtacttctaagtaactaacgaacgtacacgacaacgtcctacttcgtcggttcggtcgggacggacggaccaagtcgtacgtacccgttagtaccggtacgaccgacccgacgggaccctccgtaccccgtcggtctacccg

SEQ ID NO: 241273 - DNA, 630 bp, Homo sapiens
  misc_feature: GYAE6OF01AXCD6.35.27.C05.1.454.CMB.1.raw
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (363)..(363): a, c, t, g, unknown or other
  misc_feature (363)..(363): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcgagggcacagggtcctgggcccagtctgccctgactcagcctgcctccgtgtctgggtctccgtggacagtcgatcaccntctctgcactggaacngcagtgacgttgngactgatactntcgtctcgtacgtaccaacacccaccgacggacaaaccgcccctaaatcactagtatttatgtatgtactaagtacgtccgccttacgtgggttactaagtcctcgttcgtntcggtactacgtacgtcgtacgacctaaccgccgtccctaccgtaccgacctacttccgtgttaccggtcctacgacggtcgacgtacgacggtagtctagtacttaactcgngtacncgtctactactaactaaccacgacgtacacgtactacgttcgttcggttacggtcgggtaaccggacgtaccgtacggtccgaccggtacccgttacgtacggtacccgaccgacccgtaaagtcccctcccggtaccccgttacccgg

SEQ ID NO: 241274 - DNA, 618 bp, Homo sapiens
  misc_feature: GYAE6OF01DXUAD.35.27.C05.1.454.CMB.1.raw
  modified_base (274)..(274): a, c, t, g, unknown or other
  misc_feature (274)..(274): n is a, c, g, or t
  modified_base (310)..(310): a, c, t, g, unknown or other
  misc_feature (310)..(310): n is a, c, g, or t
  modified_base (421)..(421): a, c, t, g, unknown or other
  misc_feature (421)..(421): n is a, c, g, or t
tcagtacagatcgtcacgaccggtgctcgatttagacgcgatcgaagggtttggggggggtctcaggaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatcctcctgcactggaaccagcagcgagtggttgggggtatgaccttgtctcctggtatccgaacngccaccgaggaccaaacgcccccaaatcttaattanaaggacaactacgccgaccctgaggtattacaatcgcttactcgtggctaccgaagtccgtggactaaccgtcggccctcctagactaacttcctcgtcgggactccgggntggacggacgacggtctagtactttagtttagttgttcgccttacgtatacgtcgtaagtaagggttacgtagaccgttaacttagttacgtaccgttacggaacggtcgggaaacctacgggtaccgtacccgtacgtaggtcccgaaccgtacccgaaccggtaccccaacccgtactcggtcctaccgttcccg

SEQ ID NO: 241275 - DNA, 733 bp, Homo sapiens
  misc_feature: GYAE6OF01A8U6B.35.27.C05.1.454.CMB.1.raw
  modified_base (242)..(242): a, c, t, g, unknown or other
  misc_feature (242)..(242): n is a, c, g, or t
  modified_base (263)..(263): a, c, t, g, unknown or other
  misc_feature (263)..(263): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcaggcacagggtcctgggcccagtctcgccctgactcacgcctgccctcgtgtcgtgggtctccgtaggacagtcgactccaaccattcctcctgcctacgtaggaaacccngcgtagtggtaccggtttggngtctagtaacttaacttatcgttcctccgttacggtaacccaaccgacccaccaggaccaaaacccgacccccaaacttcaagttgtaatttacgtgtacgttagtacgtaacggtaaccgttccgggtaccccttggttacgggttttactacgttccgtccgtttctcgtacggtacccttaccgtaacggtttccgtacggacccaaccggtacccggtccccttaccccgtacgaacccttcgtcccgtcgtccggtcctacgaccggtcgtacggaccgtaacggtcgtacgtagtaacgtttactaccggtcgaccgtcgtacgtacctaaactacgtaaaccaccgtacgacgacctctaccgttcgtcggtacggtaccgggacggaccggtacgtaccgtctcggtacccgtcgtaacgaccgaccggaccgtaccggtccgtccccgtcccggttacccg

SEQ ID NO: 241276 - DNA, 711 bp, Homo sapiens
  misc_feature: GYAE6OF01AK5PL.35.27.C05.1.454.CMB.1.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (324)..(324): a, c, t, g, unknown or other
  misc_feature (324)..(324): n is a, c, g, or t
  modified_base (447)..(447): a, c, t, g, unknown or other
  misc_feature (447)..(447): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggaccagtcgatcaccatctcctgcacgtggaaccngcagtgacgttggngctgaataactatgtcttccgtcgtaacccaacgacccacccgaggaccaaaccgacccccaaactccatgtaactttangtatgtacagttaactccggtccctcggtacgggtttactaacgtccgttccttcttccgtggtaccctaccgtaacgtccgtacggacaacccgtaccggtcccttcccgacgtaacccctnttcccgtacgtcgggtacccttaccggacgtcgtaacgtaccggacggacggtcgtagtaacgtttaattccgcgtaccgtacgtccttaacctaacgtaactacccgaacgtacgacccgacgtaccctaccgttaccgttcgggttaccggttacggggaaccggtaccgggtacccgtacggttcccggaccggtccccgttaacgtacggtaccgacccggtaacccggaccggtcccttccccggtcccccgttaccgg

SEQ ID NO: 241277 - DNA, 778 bp, Homo sapiens
  misc_feature: GYAE6OF01EM4Y0.35.27.C05.1.454.CMB.1.raw
  modified_base (230)..(230): a, c, t, g, unknown or other
  misc_feature (230)..(230): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgccttccgtgtctgggtctcctggacagtcgatcaccatctcctgcactcggaaccngcaggtgacggttggggtatgtaccttgtctcgtggtactacaacagccaccaggacaaacgccccctaaactactttaattaagtaaggaaccacgtaacgcgaaccctcgagggtacttttactaatccgtctttacctcgtcggtacctaccaaggttcgtacggacctaaccgtccgtccctccctagtaacctaacgttcgtaccgtacggggccgtcccggggtacgttacgggaacgggtacggtacgggtacgttaggttaaacgtttattttaacgtttggttacgtccgttactagttatggtaccgtaagggttacgtacgtactaacttaacgttcggttaccgtttacgggtaaacgtaccggggtaacccggtaacggttacctacccgggttaaccgttacggggttacccgtaaacccgggtaccccgtaaacccggggtaacccccaaacccccggtaccgtttaacggtacccccgttaaccttaaccccgttttaccccgttacccccccgtaaccccgttaacccccg

SEQ ID NO: 241278 - DNA, 683 bp, Homo sapiens
  misc_feature: GYAE6OF01DBK41.35.27.C05.1.454.CMB.1.raw
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
tcagtacagatcgtcacgaccggtgctcgatttagacgcgatcgaaggggtttgggggggggtctcaggaggcagcgctctcgggacgtctccaccatggcctgggctctgctattcctccaccctcctcactcagggcacgaggggtcctgggcccagtctggccctgactcagcctgcctcgtgtccgtggtcctccgtggacagtcatcacatctcctgcatcggaacngactaggtgacgtttggngcgtataaacttaatatcgtctccgtacggaaccaaccacccgaaccgaggaaccaaaccgaccccaaactactagtataagttatagatgtacgaagtaacgtccggtcccgttacggtacggggtttactaacgtcgtaccttcgtccgtggtacctacgtaaacgtcgtacggacgtaacgtaccggtcccctacgtacgacctacttaccgcgttcggcctacggacgtcgtaacggacgaacggcgtacgttagtaacgtttacgtaacgtcgaccgtacgtacttaacaacgtttaacaaaccaaccgacgaacacgtacctacggtacgtcggttacggtacgggacgggtaaacggacgtacgtcgacgttaccggtacgtaggtaccaaccgggactaaccgcgtacccggtcccgtaacccgg

SEQ ID NO: 241279 - DNA, 649 bp, Homo sapiens
  misc_feature: GYAE6OF01DTO6N.35.27.C05.1.454.CMB.1.raw
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (391)..(391): a, c, t, g, unknown or other
  misc_feature (391)..(391): n is a, c, g, or t
  modified_base (427)..(427): a, c, t, g, unknown or other
  misc_feature (427)..(427): n is a, c, g, or t
  modified_base (453)..(453): a, c, t, g, unknown or other
  misc_feature (453)..(453): n is a, c, g, or t
  modified_base (538)..(538): a, c, t, g, unknown or other
  misc_feature (538)..(538): n is a, c, g, or t
tcagtacagatcgtcacgaccggtgctcgatttagacgcgatcgaagggtttggggggggtctcaggaggcagcgctctcgggacgtctccaccatggcctgggctctgctattcctccaccctcctcactcagggcacgagggtcctgggcccagtctcgccctgactcagcctgccttccgtgtctgggtcctcctggacagtcgatcacctatcctcctgcacgtggaaccngacagtgacgttggngctagaattaacgtatcgttcctccgtacgtaaccaaccaccaccgacggaccaaaccgacccccaaatcaagtagtatttagagtatcgtacaacgtaacgtccgtccttacggtacggtttactacgtcgtacttcgtntcggtactactagtctacgacgtacaccgtccctcncgacctctctcgtcggtacctaccgnggtcgtacggtaccggaagcggtactagtaactttaacgtcgtcgtacacgtactacgtataacctaaccgaacgtcgacgtacnccgttactcggtccgtgggttaccggcgggaaaccgacgtaccggtctaacggcccgttacgacgttcgaacccggtacccgtaaccggcccttcccgaccccggttaccg

SEQ ID NO: 241280 - DNA, 652 bp, Homo sapiens
  misc_feature: GYAE6OF01B242C.35.27.C05.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggngctgataactatgtctcctgtaccaacaccaccaggacaacgccccaatcatagtattatgatgtactagtaactccggccctaggtacgggtttactaacgtccgtctttctcgtcgtacctacccgtaagtcgtaggaccaaccgtacccggtcccttcccgaccgtacctacttccgtccgtcggtccctaccgacggtcctacggaccgacggacgtacgttacgtaattttacgtacgtcgactacgtacctacgtaacttactaaccgtaccaacgtaccacgtaccctacgttccgttcggtacggtccgggacggtacgggaacctaccggcgttaccgggtcccgttacggtaaccggaccgtaccggaccccgaacggcccgtcccggtcccccgttacgg

SEQ ID NO: 241281 - DNA, 658 bp, Homo sapiens
  misc_feature: GYAE6OF01CUKAH.35.27.C05.1.454.CMB.1.raw
  modified_base (150)..(150): a, c, t, g, unknown or other
  misc_feature (150)..(150): n is a, c, g, or t
  modified_base (199)..(199): a, c, t, g, unknown or other
  misc_feature (199)..(199): n is a, c, g, or t
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (342)..(342): a, c, t, g, unknown or other
  misc_feature (342)..(342): n is a, c, g, or t
  modified_base (645)..(645): a, c, t, g, unknown or other
  misc_feature (645)..(645): n is a, c, g, or t
tcagtacagatcgtcacgaccggtgctcgatttagacgcgatcgaagggtttgggggggggtctcaggaggcagcgctcgtcgggacgtctccaccatggcctgggctctgctattcctcaccctctcactcgagggcacgacgggtccncgggccctagtctcgacctgactcgacgcctgcctcgtgtctgggtccnctggacagtcactcactntctcngacacgtacggaaccagacgtagtcggtacggttaggcgactagtaattaactgtcgtacctcgtacgaaccaacaccaacgacgaacctaaacccgaccccaatcagttacgtatacgntatacgtacaacgtactccggtacctaggttacggttactaacggtccttactcgttacgacggtcctaacgtagttaccgcgggaaaccacgggtaccctcccgtactaacgactaccttcgaccgtacggtcctacggtcggaacggtacggaacggtaccgtaggtactagttaacgttcttacgcgactacggtactactaacgttaacacgaaccaaggactacgtctacgtcgtcggtacgcgggacggacgacgtacgacgtacgcccgtagtacgacctacgacccgagttcccncccgtccgtaccg

SEQ ID NO: 241282 - DNA, 927 bp, Homo sapiens
  misc_feature: GYAE6OF01EBJI3.35.27.C05.1.454.CMB.1.raw
  modified_base (203)..(203): a, c, t, g, unknown or other
  misc_feature (203)..(203): n is a, c, g, or t
tcagtacagatcgtcacgaccggtgctcgatttagacgcgatcgaagggtttggggagctctgagagacggagcccagccctgggattttcaggtgttttcatttggtgatcaggactgaacagagagaactcaccatggagtttgggctgagcgtggtctttttctaggtggcttaattttaaaggtgtccagtgtgaggtncagctgttggagtcggtgggggagtcgttggtacaggtccggtcggggggtccctggagaccttccttccgtgtacgaacgtccttcgtacggtactttaccgtaaccgttttaacggaaaccttagtcgcctagttcggtcgtccggttcggggtccccgaccggacgggtcccgttacccggggaagggggggtaacggggtccggttaggggtacgggtttcggggttaccttaacggttaggttttaaggtttaacggtggggtttaaggttgggtaacgtaaactttaaccgtaaacgttaacccgtaaccgttaaccggaccgtaaaccggttaccccggttacccgggtaaacggggtaaaccccgggggtttaccccggtttaacccgtaaacccgtactttacccggtaaccccgaaagggtaacgtaaacccttaaaacgtttaaccccggaaaaagaaaccctaaccgtaacgttacgtaaaacttcccgtaagaaacctaaacgttacggaaacccgacggtcccgtaagggaacggaacccgggtacccggggaaacgtaacccgttccggggtaaccctttaaagttaaacgtttccggtaacgggtaacgtaaaacccgtaaaggtaaccttaaacggtttcggaacccggttatttaaacggttacctaagggttacccgtaaccgtttaggggaaaccttttaaacg

SEQ ID NO: 241283 - DNA, 652 bp, Homo sapiens
  misc_feature: GYAE6OF01CX7SG.35.27.C05.1.454.CMB.1.raw
  modified_base (270)..(270): a, c, t, g, unknown or other
  misc_feature (270)..(270): n is a, c, g, or t
  modified_base (621)..(621): a, c, t, g, unknown or other
  misc_feature (621)..(621): n is a, c, g, or t
  modified_base (627)..(627): a, c, t, g, unknown or other
  misc_feature (627)..(627): n is a, c, g, or t
  modified_base (631)..(634): a, c, t, g, unknown or other
  misc_feature (631)..(634): n is a, c, g, or t
  modified_base (636)..(637): a, c, t, g, unknown or other
  misc_feature (636)..(637): n is a, c, g, or t
  modified_base (639)..(639): a, c, t, g, unknown or other
  misc_feature (639)..(639): n is a, c, g, or t
  modified_base (643)..(644): a, c, t, g, unknown or other
  misc_feature (643)..(644): n is a, c, g, or t
  modified_base (646)..(646): a, c, t, g, unknown or other
  misc_feature (646)..(646): n is a, c, g, or t
  modified_base (648)..(648): a, c, t, g, unknown or other
  misc_feature (648)..(648): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaaagaacacactgaatctgcaaatgaacagcctgagacgccgaggacacggaccgtatattactgtgacgaaagcagtacgtacgngtagttactatggcttcgagtacttaagtgagtcttgactacgtcgggccaggaccctcggtccaccgtctccgtacacgccctcccgtaccgaaccggcccctacgttaccggtacccttcccccgtacggcccttacccctacccggtccgtaaacggaccgaccggtaccccgtcgggttacgggggccctaaccggtaccggtcccgggacccgttcggggtaccttccggtacccgttacggtacgtaacggtaccttacccgtccgtaacggcgttaccgttaggttaaccgtcggacggtcgggtaacgttcgggacgtaacgaccgtcgaagtaccgtagcanctgacngtcnnnncnncncacnncngngtcg

SEQ ID NO: 241284 - DNA, 664 bp, Homo sapiens
  misc_feature: GYAE6OF01AUCU1.35.27.C05.1.454.CMB.1.raw
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (370)..(370): a, c, t, g, unknown or other
  misc_feature (370)..(370): n is a, c, g, or t
tcagtacagatcgtcacgaccggtgctcgatttagacgcgatcgaagggtttggggagctctgagagaggagcccagccctgggattttcaggttgttttcagttttggtgatcaggactgaacagagagaactcaccagtggagtttggctgagcgtgtcgttttcgtgtggtacttaagttttaaaggtgtcagtgtgaggtgcagntggtggagtcggnggggngtcgttggacgcggtccggttggggccctgagtacctcgtcgtgtacgacgtcctacgtgtacttctaccgttagactatcncangtcgngtcgccgcgngcgcgaggaggngaggnggtcggtcgaccgtagtaagtaaagngtagtaggagcgggagaacgaacgcgtacgtactccgttacgcccgttaacggagtacgacgtaccgttactacccgtaccgtacgacgtaacgactacgtactaccggtatacgtacgttaacgtccgttactacccttactaactaaaccgtagtaaccgaacgacgtaaccgaaccgtaaccgaagacccgtaaccgtacgtacgttaacctagttaccccgtgtaaccctaccgtcctaacccgaccttccgaacgttcgacgttacccttaacgacgttacggtaacgg

SEQ ID NO: 241285 - DNA, 821 bp, Homo sapiens
  misc_feature: GYAE6OF01AMD2J.35.27.C05.1.454.CMB.1.raw
tcagtacagatcgtcacgaccggtgctcgatttagacgcgatcgaaggggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatccaccatcctcctgcacgtggaaccagcagtgacgttggcgctagaattaactattgtcctccgtacggtaccaaccacccaccgacggaccaaaccgacccctaaacttacttaaatttagtaacgacacgtaacgccgacctcaagggtactttactacgtcgtcttctcgtggcctaccgtaacgtcgtacggacctaaccgtcccggtaccctcccgtacgtaacgtaacttccgtccggtacgggccgtccggggtaccgtacggaccggaccggtacgggtacccgttaggttaactttaacgttaccgtacgtaaccggtacctaccgttaacctaacggttaaacctaacccgtaaacccgaacggttacccgaacggttaccctaaccccggtttccgtttaaccgggggtttccgggttacccggggggaaccgggtaaccgggggaaaccgtaaccgggttacccggtacccgggttacccggtttacccggtaaccggggttaccaaaccccgggtacccccgggtacggttcccccggtacccccggttacccccggttaaccggttcccgttaccccgtttccccgggtttaccccccggg

SEQ ID NO: 241286 - DNA, 936 bp, Homo sapiens
  misc_feature: GYAE6OF01CF2C0.35.27.C05.1.454.CMB.1.raw
  modified_base (260)..(260): a, c, t, g, unknown or other
  misc_feature (260)..(260): n is a, c, g, or t
tcagtacagatcgtcacgaccggtgctcgatttagacgcgatcgaaggggtttggggggggtctcaggaggcagcgctctcgggacgtctccaccagtggcctgggctctgctattcctccacccttcctcactcgagggcacgagggtcctgggcccagtctgccctgactcacgcctgccttcgtgtcgtcgggtctccgtagggacacgtcgactccgtacctacttccgtacctggccaaccgttacggaaaccgngaccgtaggttcggtacggttggtcgaccgtagtaacttaacgttgtccgttaccgtccgtaaccggtaacccaaaccctaacccgaccgaacggtaacccaaaacccgtacccctaaactcgtagttacgttacgtttagtagtacgttacggtactaacggtaccgtacccggttaccgttacgggtttacggtttacgtaaccgttccgttaccgttccgttcgtacgttaccgtaccggttaacgtaccggtaccggaacccgtaaccggtacccggtaccccttaccgttaccggtaaccctttaccgggttcccggtaccggtaccggttacccgtaccggtaccgggtacgtaccgggaaaccggttaccgggacggtttaaccgttacggtttaacgttttacgggtacccgtttcggaccgttaaacgtccggtttaaactaaccgttaaccggtaacggtaacccggacgggttaacccgtacggttaccccgtaccgtttacgggtttcccgggtaaccgggtttacccgggggtaccgggaaaccccggggttacggtaacccgtacccggttacggttaacccggtcccggtaaccggttaacccgggacccgttacccggaccccgggttaccgttaccccgggtccccggttaacccccgg

SEQ ID NO: 241287 - DNA, 998 bp, Homo sapiens
  misc_feature: GYAE6OF01DEC4M.35.27.C05.1.454.CMB.1.raw
  modified_base (196)..(196): a, c, t, g, unknown or other
  misc_feature (196)..(196): n is a, c, g, or t
tcagtacagatcgtcacgaccggtgctcgatttagacgcgatcgaagggtttggggagctctgagagaggagcccagccctgggtattttcaggttgttttcatttggtgatcaggactgaacagagagaactcaccatggagttggctgagcgtggtcttttctgtgcttaagtttaaagtgtcagtgtgaggtncagctggttggaggtcgtgggggagtcgttggtacacggtcccgggttaggggggtcccctggacgtacccgttccgttccgtaggtaccgtaacggtccttacggttgggtaacctttacccgttaaaccgttttaaacgggaaaccttagtccgtacccgtaagttcgggttcggcccgggtttcgggggtccccccgaccggtaagggtaccccgttaaccgggggaagggggggtaaacgggggtccggttaagggggtcgggtttccgggtttaccgttacggttttaaaggttttaacggttttaaggggtttagggtaggggtttccggggtttaagtaaaacttttaaacccggtaaacttaacccggtaaaccgttacccgggaacctaaccgggttacccgtcccggggtaaacggggtaaacccggggttcccccgtttaaccaacccgtacctttaacccgtaccgtaaaccggaacgtaaaccctaaaacccgtttaaccgaaaaccgtaaaccctaacccgtaaccttaaacgggtaaaaccgttccctaaacggtaaacctaaaacgtaccggaaaccgtacggtaacccggtaacgaaacgggcccggtaaacggaacggaccccgtaacgggtacccgttaaagtttaaccgtttaaccggacgttaaacggaacggaaaaacggtaacttaaacggttaaccctacgttttaacccggttaaattaccccggtttaaggttaccgggtttaaccccgttagggttaaacgttttaaaaacccgg

SEQ ID NO: 241288 - DNA, 815 bp, Homo sapiens
  misc_feature: GYAE6OF01ATSET.35.27.C05.1.454.CMB.1.raw
  modified_base (234)..(234): a, c, t, g, unknown or other
  misc_feature (234)..(234): n is a, c, g, or t
  modified_base (290)..(290): a, c, t, g, unknown or other
  misc_feature (290)..(290): n is a, c, g, or t
  modified_base (619)..(619): a, c, t, g, unknown or other
  misc_feature (619)..(619): n is a, c, g, or t
tcagtacagatcgtcacgaccggtgctcgatttagacgcgatcgaagggtttggggggggtcgtcgaggaggcgagcgctcgtcgggacgtctccaccatggcctgggctcgtgcttattcctcaccctcctccactcagggcacgaggggtcctgggccctaggtctcgccctagacctcacgcctgtcctccgtgtcgtcgggtcctccgtggactaggtccatccctaacnttcctcccgtgacctacgtaggaaaccccaggccaaggttccggtacgtttgggcnccgttaagacttaactacgttgtccttaccgtcggttaaccaaccgtaccccgacccgtaacggaccaaacccgaccccaacctaccgtactaggttacttatcgtatcgtaccgtaagtaaccgtccggtacctttacgggtacggtttaacgttactcggtttacctccgtcgtacgtcccgtacgttaacgccgttacggtaaccgaccgtaccggtaccctcccccgtaacgacccgttatacccgtcggttaaccggtccgtccgtacgggtacttaacccggaccgtacgacggtccgttacgttaacgtttcgagttcgtcncgtacttcggaactaacggaccctaagtaccaacgtaccgtacctcgtacccgtttacgggcggtttaacgggccggtaaccgggtaccgtaaacgtcccgggttaacccctaaacgggttcccgggttaaccgaccccgttaaccggtaaccggtacccggaaccccgggttcccgtaccccccgggttaaccgg

SEQ ID NO: 241289 - DNA, 633 bp, Homo sapiens
  misc_feature: GYAE6OF01DS014.35.27.C05.1.454.CMB.1.raw
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (308)..(308): a, c, t, g, unknown or other
  misc_feature (308)..(308): n is a, c, g, or t
  modified_base (410)..(410): a, c, t, g, unknown or other
  misc_feature (410)..(410): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatcctctgcnctaggaaccngcagtcgagttggngctgataactatgtctcgtcgtaccaacaccaccaggaccaacaccccaactcatagtactttancgtatgactagtactccgctacggtacggttactaactcgtccttcgttcgtcgtacctcgtaggtctacggacacccgacgtccctcctacgacctactcncgtacgctcgagcagacgacgtagtntagtacttagttacncgactagtacctataacgtactaaccgaacgtacgactaccgtacctaccgtaccgtttggttaccggtccggggtacggtaacgggaacccgtaacggtcccgttaacgggtaccccgtttacgtaccggtaaccgtcccggaacccgtaggttcccgtaccccgttccccgtaaacccgg

SEQ ID NO: 241290 - DNA, 699 bp, Homo sapiens
  misc_feature: GYAE6OF01BX4BD.35.27.C05.1.454.CMB.1.raw
  modified_base (590)..(590): a, c, t, g, unknown or other
  misc_feature (590)..(590): n is a, c, g, or t
tcagtacagatcgtcacgaccggtgctcgatttagacgcgatcgaagggtttgggggggggtctcaggaggcagcgctctcgggacgtctccaccatggcctgggctctgctattcctccaccctcctcactcagggcacgagggtcctgggcccaggtctcgccctgactcacgcctgcctccgtgtcgtggtctcgtggacagtcatcaccatctctgcactacggaaccagcgagtcgtacgtggtgctagtaactaactatcgttcctccgtacggtaaccaacaccctaccgaggaaccaaacccgacccccaaactctagtagttattatacgtgtacgtacgtaacgtacgtccgtacccgttacggttacgggtttactaacgtcgttccttacctcgtacgtcctacgtaagtccgtacggacctaaccgcccgtccctacccgtaccaccttacgttccgttacggtcccggtactacccggtacggacgtaacgggaaccggtacgggtaacggttctaagtttaacgttaccgttacgtcgaacgtcgtacctaataacgtactaaccaacgcgtacncgtacctccgttacgtcggtacgggtccggacgggacgaccgtagtaccgtacggtccgtacggtacgaccgtacgtacccgaccgtcccgtacccgtccccgttaccg

SEQ ID NO: 241291 - DNA, 679 bp, Homo sapiens
  misc_feature: GYAE6OF01CK3Y0.35.27.C05.1.454.CMB.1.raw
  modified_base (402)..(402): a, c, t, g, unknown or other
  misc_feature (402)..(402): n is a, c, g, or t
  modified_base (489)..(489): a, c, t, g, unknown or other
  misc_feature (489)..(489): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcgagggcacacgggtcctggcccagtctgccctgactcgacgtctcgcctcgtgtcgtggtctcgtaggacagtcatccacatcctcgtgacacgtacggaccagcagtagtcgttggtcagtacgaataactgttcgtaccttcgtaacgaacaaccgacccacgtaggtaaccaaccccgttaccccaagttactagtagtttatttaagcggttactacggtaagagtaccgtccggtactacgggttagttacactcgtacttcacgnggtacctaagtacgtcacgacctaaccgcccgccttacagtaaccctgttcgcgtacggtctacgacgtacacggtaccgagtacgnttacgttaagtacgtttcaggtactagacctaacttaacgtaaaccaactaaccgacgtaccgtacgtcctaacgtccgtttagggtcccggttaacgggacgggttaaccgggacccgtaaggtccgtacccggttaccgttacgtacggtaccaccggtaaccgcgtaccccggtccgtccccgtacg

SEQ ID NO: 241292 - DNA, 1199 bp, Homo sapiens
  misc_feature: GYAE6OF01B665C.35.27.C05.1.454.CMB.1.raw
tcagtacagatcgtcacgaccggtgctcgatttagacgcgatcgaaggggtttgggggggggtctcaggaggcagcgctctcgggacgtctccaccatggcctggggctctcgtacttaccttcctaccctacccctcctacctacctacgggacgggaccaacgggtaccggggttccgggtcgggacctaacgtcgttcgtcccggtccctacgtacctcgaccgtcctccgtcccgttcggtcgttcggtcggtccgtccggtacggacgtacgtcgtactaccaaccttccttcctcgtacgacctacggtaaccgtaacgcgacgacggtacgttagggttcgggggtttaggggttactccgtttccggttcgtttcccgtaacggtttacggtaacccaaccgaaaccgtcccggaccctaaacccgggaaaccggtaaaaccccctaaacccccggttaaaacccccttaacgttttttaaaacttttaaaaccgggtttaaaacgtaaaccccggggtaaaaacccttaaggggtaacccccggttaaacccctttaccggttaaacggggggtttattttttaaaccttttaaaccccggtaacgttcccccgttttcgttttcccccggtaagggtttacccccggaaccccctttaaagggtttaacccgggttaccccggggttaacgtaaaacccccccgttaccccggggtttccccccgtttacccccttaaccccggggttaaaaagttaacctttccccccgggtttttccgggggtttaaccccgggggggttcccgggggttaccccgggtttaaccccggggggaacgggtaacccggggggttaaaccgggtacccgggggtaacggtttaaaccgggtttaacgggttttttaaaacgttttggttttttaacccgggtttccggtttccggtttaaccgtttaaacgttaacggttaccgggttaaacggggtaacgggtttaacggttaaacccggttaacgttaaacccggtttaaacggtttaaccggttttaccggggtttaacccggggtaacccgggtttaaaaccgggggtacccgggttaaacggttacccccggtttaaaccccgggttaaccggtttaaccccgggggttaccgttaaacccgggaaaccccccggttaaaccgg

SEQ ID NO: 241293 - DNA, 1002 bp, Homo sapiens
  misc_feature: GYAE6OF01DK3TN.35.27.C05.1.454.CMB.1.raw
  modified_base (386)..(386): a, c, t, g, unknown or other
  misc_feature (386)..(386): n is a, c, g, or t
  modified_base (818)..(818): a, c, t, g, unknown or other
  misc_feature (818)..(818): n is a, c, g, or t
tcagtacagatcgtcacgaccggtgctcgatttagacgcgatcgaagggtttggggggggtcgtcgaggaggcgaggcgctcgtcgggtacgtcgtaccacctagtcggcctggggcccttcgtccgtccttactttcccgtaccctaccccccttcccgtaccaccgttcggacggggaccaaccggtacgggggttcccctggggacccctaggttcctacggtaccccttggaaccttccgaacggtcccttacggcccgttcccggttcggtaccggttggggttcccttccggttaacggggaacctacgggttaccgtaaacctaccgaaacccgtcttcccgttaccgtcggtaacccgtaacggtacggaaaacccgnggtaacccgtaaagggttacggttaaaaccggttttagggtccgttaacgtttaacggaaacctttaaacgttcggtaccgttccttaccggggttaaaccgtaacccgaaacccgaaccccgacccggtaaccggtacccgtaaaacccggtacccccctaaaacggtacttaacggtttacgttaactttacggtacgtaggttaccgtaggtaaacggtacccggtccggttacccgttacgggtacggtttacctacgttcccgttcttaccgtcggttaccgtaacccttacggaacgttacggttccgaacccgttaaccgacccggtcccttaaccgtacgtacctacgttccggtacggtcgggtacccgtaccggtaggtcggacgtaaccggacggtacggtacctagttacttacggtacncgacgtacgtacgttaccagttaaccgtacaaccggtcggtaccgacgttacccgaaccggttcggtacgggtaccggtcgggaaccggtccggtaaccggtaccgtccgggtacccggtaacggttcccgtaacggacccgtacggtaacccgccggttacccttcccgtacccggttacccg

SEQ ID NO: 241294 - DNA, 717 bp, Homo sapiens
  misc_feature: GYAE6OF01DVM63.35.27.C05.1.454.CMB.1.raw
  modified_base (199)..(199): a, c, t, g, unknown or other
  misc_feature (199)..(199): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctcgtgtcgtggtctccgtggacngtcgactccaccatcctctgcctacgtcggaaccagtcaggtcgtacgttggtcgactagaatacgtagttcgttcctccgtacggtaacccaacctacccgaaccgacggaccaaaaccgtacccccctaaactccgtaagtttcgtttagtttttacgggacggttacgtaacggtaaccggtcccggtcccgttacggtaccggggttccctagtaccgtccgtcttccgtcgtcgtcctactacgtcacgaccgaaccgtaccgtcccttcccgttaccgtcgtccgtacggtcctacgacgtactacggtagtacgtggacgtacgtagtactttagtcgtacgtacgctacgtacgtatacgtcgaacgtagcgacgacgacgtccgtacgttccggtcgttcgggtccgggaaccgggaccggaccgtaacggttccgtaccggtaccggttaccgtaacggttcccgaaccggtcccggtaacggtccccggtcccgtccccggttaccg

SEQ ID NO: 241295 - DNA, 634 bp, Homo sapiens
  misc_feature: GYAE6OF01DSXCH.35.27.C05.1.454.CMB.1.raw
  modified_base (250)..(250): a, c, t, g, unknown or other
  misc_feature (250)..(250): n is a, c, g, or t
  modified_base (579)..(579): a, c, t, g, unknown or other
  misc_feature (579)..(579): n is a, c, g, or t
  modified_base (614)..(634): a, c, t, g, unknown or other
  misc_feature (614)..(634): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccgttcaccatctccagagacaattccaagaacacatgaaatctgacaaatagaaacagcctgaagagccgaaggacacggccgtatattacgngtacgacgaaagacaatactacgacgtaatttaacctaagtgtaccgtttacggaacgttaaactttaaataggtacgttctttagaaccgtaacggttcgggggacccgtaacggggaacccgttcggtaccgtaccgttccctccttacgacgtcccctacccaaccggaacggaccccgtaacgttcccggttcccttccccccgtggaccctaccccgtaccctaccgaaacgacgtccctaccgtcggtacggggacctacgacggtccgacccgtggctcgtccgtcgaacgaacgtactaccgttccaagtactctagtacnggaacgcgggcgtaggacgacggcgactagtacgnnnnnnnnnnnnnnnnnnnnn

SEQ ID NO: 241296 - DNA, 831 bp, Homo sapiens
  misc_feature: GYAE6OF01D2KV7.35.27.C05.1.454.CMB.1.raw
  modified_base (179)..(179): a, c, t, g, unknown or other
  misc_feature (179)..(179): n is a, c, g, or t
  modified_base (201)..(201): a, c, t, g, unknown or other
  misc_feature (201)..(201): n is a, c, g, or t
  modified_base (278)..(278): a, c, t, g, unknown or other
  misc_feature (278)..(278): n is a, c, g, or t
  modified_base (705)..(705): a, c, t, g, unknown or other
  misc_feature (705)..(705): n is a, c, g, or t
tcagtacagatcgtcacgaccggtgctcgatttagacgcgatcgaagggtttgggggggtctcgaggaggcagcgctcgtcgggacgtctccaccatggcctgggctctgctattcctcaccctctcactcacgggcacagggtcctgggcccagtctgcctgatcagcctgcctcgtntcgttcgggtctccgtaggacngttcgactcaccatcctcctagctacgtcggaaccagtctaggtcgtacgttggtgtactagaaactttaaccgttnttacgtaccttaccgttacggtaaccctaaacacccaacccgacggaacccaaacccgaaccccctaaaacgtctaagttacgttactttaacgtaggacttacggtaactacgttaaaccgtccgggtacccttaaggtttacgggtttactaaccgttccgtaccgtttccgttccggtaacgtcctaacccggtaagttcccggtacgggtaacccgtaaccggtaccggtccccgttaccggtaccgacttacgtttcccgacggttccgggaacccttcggaacgggtccgtaaggaaacccggtcggggttcgttaaccgtagtttaaaccggtttttaccttaaccggtagtaacccgtacttaccttacctaagtaacccgttaaccaaccggtaaccgcgttaaccgactttacccgnggtttaaccggtcgggtaccgggtaccgggtaccggaaacccttggacccgttaaccgggtacccggttcgtaaccgggacctccgggttaacccaaggggtcccctaacccgtcccgttaacccg

SEQ ID NO: 241297 - DNA, 682 bp, Homo sapiens
  misc_feature: GYAE6OF01CE70L.35.27.C05.1.454.CMB.1.raw
  modified_base (69)..(69): a, c, t, g, unknown or other
  misc_feature (69)..(69): n is a, c, g, or t
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
  modified_base (312)..(312): a, c, t, g, unknown or other
  misc_feature (312)..(312): n is a, c, g, or t
tcagtacagatcgtcacgaccggtgctcgatttagacgcgatcgaagggtttgggggggggtctcaggnggcagcgctcgtcgggacgtctccaccatggcctgggctctgctattcctcaccctcctcactcgagggcacagggtcctgggcccagtctgccctgactcagcctgcctccgtgtcgtgggtctcgtggacagtcgatcactatctcngcacgtcggaaccngcagtgtacgttggnctagatactntgtctcgtagtaccaacaccaccgagacaaaccgccccaaatctaagtgtattangacgtgtactagtacgtccgtccgtacggtacggttactacgtcgtcttactcgtgtactacgaacgttcgacggaccaaccggtaccggacccttccgtagtaccctagtccgtcggtcggtacctaccgaggtccgtacggaacggacgtacggtacgtagttactttactacgtcgaccgtgtacttaactaacgtaactaacccaacgacgtactaacggacccttaccggtacgttacggggtccgttacggggaaccgggtaccggtaaaccgtaccggtacgttaccccgggtacccgtaacggtaaggtacccgtaccggaacccgtaccgggccccttacccccgggtcccggttacccgg

SEQ ID NO: 241298 - DNA, 505 bp, Homo sapiens
  misc_feature: GYAE6OF02HHRBG.35.27.C05.1.454.CMB.1.raw
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaagcccccaaactcatgatttatgatgtcagtaatcggccctcaggggtttctaatcgcttctctggctccaagtctggcaacacggcctccctgaccatctctgggctccaggctgacgacgaggctgattattactgcagctcatatacaaccagcagcactctcgtgttcggcggaggaccaagctgaccgtcctaggtcagcccaaggcctcgcccctcgg

SEQ ID NO: 241299 - DNA, 499 bp, Homo sapiens
  misc_feature: GYAE6OF02H4R5Z.35.27.C05.1.454.CMB.1.raw
  modified_base (302)..(302): a, c, t, g, unknown or other
  misc_feature (302)..(302): n is a, c, g, or t
tcagtacagatcgtcacgaccggtgctcgatttagacgcgatcgaagggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaagcccccaaaatcatgatttangatgtcagtaatcggcctgagggtttcaatcgcttctctgctccaagtctggcaacacggcctccctgaccatctctggctccaggctgacgacgaggctgaattattactgcagctacatactacaccagcagcactctcgtgttcggcggaggaccaagctgaccgtccaggtcagcccaaggctcgcccctcgg

SEQ ID NO: 241300 - DNA, 498 bp, Homo sapiens
  misc_feature: GYAE6OF02FWYUL.35.27.C05.1.454.CMB.1.raw
tcagtacagatcgtcacgaccggtgctcgatttagacgcgatcgaagggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaagcccccaaactcatgatttatgatgtcagtaatcggccctcaggggtttctaatcgcttctctggctccaagtctggcaacacggcctccctgaccatctctgggctccagctgacgacgaggctgattatactgcagctcatatacaaccagcagcaactctcgtgttcgcgaggaccaagctgaccgtctaggtcagcccaggctcgcccctcgg

SEQ ID NO: 241301 - DNA, 503 bp, Homo sapiens
  misc_feature: GYAE6OF02ILSDA.35.27.C05.1.454.CMB.1.raw
tcagtacagatcgtcacgaccggtgctcgatttagacgcgatcgaagggtttggggggtctcgggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaagccccaaactcatgatttatgatgtcagtaatcggcctcagggtttctaatcgcttctctggctcaagtctggcaacacggcctcctgaccatctctgggctccagctgacgacgagctgattattactgcagctcatatacaaccagcagcactctcgtgttcgcggaggaccaagctgaccgtccgtaggtccacgcccaaggcctcgccccctaggtcc

SEQ ID NO: 241302 - DNA, 521 bp, Homo sapiens
  misc_feature: GYAE6OF02I48O7.35.27.C05.1.454.CMB.1.raw
  modified_base (361)..(361): a, c, t, g, unknown or other
  misc_feature (361)..(361): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaagcccccaaaactcatgatttatgatgtcaagtaatcggccctcgagggtttctaatcgtcttctctggtctccaagtcnggacaacacggcctccctgaccattctctgggctccgaggctagacgacgaggcctagactttattactgcagctacgatatacaaccagacacgctactcgtcgtgttcggcggaggaccagctgacctccgtagtcacgccaggctcgccccgtacgg

SEQ ID NO: 241303 - DNA, 606 bp, Homo sapiens
  misc_feature: GYAE6OF02IUHMA.35.27.C05.1.454.CMB.1.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (309)..(309): a, c, t, g, unknown or other
  misc_feature (309)..(309): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggtcgatcaccatctcctgcactggaaccngcagtgacgttggngctgataactatgtctcctggtaccaacaccacccaggcaaacgcccccaaaatcactgatttagngtatgtcagtaatcggccctgtagggtttctaagtcgcttctctggctccaagtctggacaacaccggcctccctgaccctatctccgtgggcctccgaggtctggaggacgaggctgatttattagttgttgcctcatagtgactaggtagtagcgtaacttaatgtttacgttaccggtaacgtcggggtaacctaacggggttcctaacccgggtttccgtaagggttcccgaaaccggtacccccgtaaacgggtaccccctaaaccccccgtagttccggtaccctaacccg

SEQ ID NO: 241304 - DNA, 504 bp, Homo sapiens
  misc_feature: GYAE6OF02IAAWZ.35.27.C05.1.454.CMB.1.raw
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaagcccccaaaactcatgatttatgatgtcagtaatcggccctctagggtttctaatcgcttctctgctccagtctggcaacacgcctccctgaccatctctgggcctcgaggctgacgacgaggctgattatactgcngctcatatacacngcagcactctcgtgttcggacggacggacaggcctgacccgtctaggtcacgcccaggctccgcccctcgg

SEQ ID NO: 241305 - DNA, 510 bp, Homo sapiens
  misc_feature: GYAE6OF02IJJSD.35.27.C05.1.454.CMB.1.raw
  modified_base (239)..(239): a, c, t, g, unknown or other
  misc_feature (239)..(239): n is a, c, g, or t
  modified_base (301)..(301): a, c, t, g, unknown or other
  misc_feature (301)..(301): n is a, c, g, or t
  modified_base (340)..(340): a, c, t, g, unknown or other
  misc_feature (340)..(340): n is a, c, g, or t
  modified_base (445)..(445): a, c, t, g, unknown or other
  misc_feature (445)..(445): n is a, c, g, or t
tcagtacagatcgtcacgaccggtgctcgatttagacgcgatcgaagggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcctggacagtcgatcaccatctcctgcactggaaccagcagtgacgttggngctgataactatgtctctggtaccaacaccacccaggcaaacgccccaaatcaatgatttangatgtcagtaatcggcctcaggggtttctaatcgcttcnctggctccaagtctggcaacacggccctcctcgacatctctcgggctccaggctgacgcgagcttgattatactgctagctcattacacaaccagcacgacactntacgtgttcgggcggtaaggaccaagctacgaccgtcgtaggtcacggacccaacggctacccgg

SEQ ID NO: 241306 - DNA, 487 bp, Homo sapiens
  misc_feature: GYAE6OF02JHHYO.35.27.C05.1.454.CMB.1.raw
  modified_base (478)..(487): a, c, t, g, unknown or other
  misc_feature (478)..(487): n is a, c, g, or t
tcagtacagatcgtcacgaccggtgctcgatttagacgcgatcgaagggtttgggcgtcaactttcttgtccgccaggctccagggaaggggctggagtgggtctcagttattagtggtagtggtgatactatacactacgcagactccgtgaagggccggttcaccatctccagagacaattccaagaacacactgaatctgcaaatgaacagcctgagagccgaggacacggccgtatattactgtgcgaaaagacatatcgcgtattactatgcttcggagacttaaattgagcttttgactactggggccagggaaccctggtcaccgtctcctcagcctccaccaagggcccatcggtcttccccctggccaccctcctccaagagcaccctctgggggcacagcggccctgggctgcctggtcaaggactacttccacgatctgtactgagcgggctggcaaggcgcatagnnnnnnnnnn

SEQ ID NO: 241307 - DNA, 521 bp, Homo sapiens
  misc_feature: GYAE6OF02GZ35W.35.27.C05.1.454.CMB.1.raw
  modified_base (242)..(242): a, c, t, g, unknown or other
  misc_feature (242)..(242): n is a, c, g, or t
  modified_base (468)..(468): a, c, t, g, unknown or other
  misc_feature (468)..(468): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgataactatgtctcctggtaccaacaccacccaggcaaacgcccccaaactcatgatttatgatgtcagtaatcggccctcgtaggggtttctaatcgtcttctctggctccaagtctggacaacgaccgcctccctgaccatcctcgtgggcctccgaggctgacgacgagctgtattatactgcagctacatactacaaccagcagcactctcgtgtcggnggacggaccaagctagcccgtcgtaggtcacggcccaggcctccgcccctcgg

SEQ ID NO: 241308 - DNA, 480 bp, Homo sapiens
  misc_feature: GYAE6OF02FHUH0.35.27.C05.1.454.CMB.1.raw
  modified_base (471)..(480): a, c, t, g, unknown or other
  misc_feature (471)..(480): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacacactgaatctgcaaatgaacagcctgagagccgaggacacggccgtatattactgtgcgaaagacatatcgcgtattactatgcttcggagacttaaattgagctttgactactgggccagggaaccctggtcaccgtctcctcagcctccaccaagggcccatcggtcttccccctggcaccctcctccaagagcacctctggggcacagcggccctgggctgcctggtcaaggactacttccacgatctgtactgagcgggctggcaaggcgcatagnnnnnnnnnn

SEQ ID NO: 241309 - DNA, 516 bp, Homo sapiens
  misc_feature: GYAE6OF02HOXDZ.35.27.C05.1.454.CMB.1.raw
  modified_base (242)..(242): a, c, t, g, unknown or other
  misc_feature (242)..(242): n is a, c, g, or t
  modified_base (436)..(436): a, c, t, g, unknown or other
  misc_feature (436)..(436): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgataactatgtctcctggtaccaacaccaccaggcaaacgccccaaactcatgatttatgatgtcagtaatcgcctcgtagggtttctaatcgcttctctgctcaagtctggcaacacgcctcctgaccatcctcgtgggcctcgaggctgacgacgaggctgattatactgcagctacatactacaacancagcactctcgtgttcggacggaggaccgaagcgtacgaccgtccgtaggtcacgcccaaggtcctaccgccccgtacgg

SEQ ID NO: 241310 - DNA, 512 bp, Homo sapiens
  misc_feature: GYAE6OF02HMU7W.35.27.C05.1.454.CMB.1.raw
  modified_base (325)..(325): a, c, t, g, unknown or other
  misc_feature (325)..(325): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaagccccccaaaactcatgatttatgatgtcagtaatcggccctnaggggtttctaatcgcttctctggctccaagtctggcaacacgcctccctgaccatctctgggctccaggctgacgacgaggctgattattactgcagctcatactaacaaccagcagcactctcgtgttcgggcgaggaccaagcctagaccgtccgtaggtcacggcccaaggctcgcccctcgg

SEQ ID NO: 241311 - DNA, 528 bp, Homo sapiens
  misc_feature: GYAE6OF02HPXMM.35.27.C05.1.454.CMB.1.raw
  modified_base (240)..(240): a, c, t, g, unknown or other
  misc_feature (240)..(240): n is a, c, g, or t
  modified_base (323)..(323): a, c, t, g, unknown or other
  misc_feature (323)..(323): n is a, c, g, or t
  modified_base (423)..(423): a, c, t, g, unknown or other
  misc_feature (423)..(423): n is a, c, g, or t
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgataactatgtctcctggtaccaacaccacccaggcaaacgcccccaaactcatgatttatgatgtcagtaatcgccctnagggtttctaatcgcttctctgctccaagtctgcaacacggtcctcctgaccatcctcgtcgggctccgaggctggacgacggaggctagtattattacngtcagctacataactaccaaccagacagaccactcgtcgttgttccgggacggaggaccaagctgacccgtccgtaggtcacgcccgaaggcctccgcccctcgg

SEQ ID NO: 241312 - DNA, 509 bp, Homo sapiens
  misc_feature: GYAE6OF02G4NI9.35.27.C05.1.454.CMB.1.raw
  modified_base (323)..(323): a, c, t, g, unknown or other
  misc_feature (323)..(323): n is a, c, g, or t
  modified_base (373)..(373): a, c, t, g, unknown or other
  misc_feature (373)..(373): n is a, c, g, or t
  modified_base (426)..(426): a, c, t, g, unknown or other
  misc_feature (426)..(426): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccaggcaaagcccccaaactcatgatttatgatgtcagtaatcggccctnaggggtttctaatcgcttctctggctccaagtctggcaacacgcctcccngaccatctcgtggcctccgaggctgacgacgaggctgattattactgcagctnatatacaaccagcagcactctcgtgttcggcggaggaccaaggctggacccgtcgtaggtcacgcccaaggctcgcccctcgg

SEQ ID NO: 241313 - DNA, 504 bp, Homo sapiens
  misc_feature: GYAE6OF02F84OA.35.27.C05.1.454.CMB.1.raw
  modified_base (364)..(364): a, c, t, g, unknown or other
  misc_feature (364)..(364): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctctggtaccaacaccaccaggcaaacgcccccaaactcatgatttatgatgtcagtaatcggccctcgagggtttctaatcgtcttctctggctcaagtctggcaacncgcctccctgaccatctcgtcgggctccgaggctgacgacgaggctgattatactgcagctcatactacaaccagcagcactctcgtgtcggcggaggaccagctcgaccgtcgtagcacgaccgagcctccgcccgtcg

SEQ ID NO: 241314 - DNA, 608 bp, Homo sapiens
  misc_feature: GYAE6OF02F9TUH.35.27.C05.1.454.CMB.1.raw
  modified_base (242)..(242): a, c, t, g, unknown or other
  misc_feature (242)..(242): n is a, c, g, or t
  modified_base (302)..(302): a, c, t, g, unknown or other
  misc_feature (302)..(302): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgataactatgtctctgtaccaacaccaccaggcaacgcccccaaactcatgatttangtatgtcagtaatcggccctcgtagggtttctaatcgcttctctggctccaagtctggacaacgacggccctccctgacctactctcgtcgggcctcgacggtctaggaccgacggaggcctaggtatttacttactgcacgtctacaattaactaacctaacgacgccacgcctaacgttccgttcgttcggttaccgggacgggtaacgggaacccgtaggtacccgttaacggtaccccggttaccgtacgggtaccaccgggaccccgtaacgggcccgttacccggcccccgttacccggg

SEQ ID NO: 241315 - DNA, 659 bp, Homo sapiens
  misc_feature: GYAE6OF02HMSFZ.35.27.C05.1.454.CMB.1.raw
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagcgtgtcgtttctaggtggctatttaaaggtgtcagtgtgaggtgcagctgtttggagtcgtgggggaggcttgggtacagccgttggggggtccctgagactctcctgtgaagcctctggattctacctttaggaactatgccatgtgctgggtcccgccgaggctccgaggggaagggctgggagttgggctcagttattaggtggtagtggtgatactatacactacgcagtacctccggtgaacggggtccgttacacctatcctaccaggacgaactaaattcccaaaagaaccaactacctagtaaacttcgtagacctaaaagtcgaaacaggacccttaggaacgacgacccgggaaggaaccgaccgggtaccttaattaacgtttaaccgttgggtacggaaccgtaaaaacggtacctaaagttaccgttaccggtacgttttaactttaaacgttaggttaccgttacccggttttaccgggaattttaaaacccg

SEQ ID NO: 241316 - DNA, 175 bp, Homo sapiens
  misc_feature: GYAE6OF02HA9YX.35.27.C05.1.454.CMB.1.raw
  modified_base (173)..(175): a, c, t, g, unknown or other
  misc_feature (173)..(175): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagcgggctggcaaggcgcatagnnn

SEQ ID NO: 241317 - DNA, 508 bp, Homo sapiens
  misc_feature: GYAE6OF02F7IHY.35.27.C05.1.454.CMB.1.raw
  modified_base (242)..(242): a, c, t, g, unknown or other
  misc_feature (242)..(242): n is a, c, g, or t
  modified_base (425)..(425): a, c, t, g, unknown or other
  misc_feature (425)..(425): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtnctgataactatgtctctggtaccaacaccaccaggcaaagcccccaaactcatgatttatgatgtcagtaatcgccctcaggggttttctaatcgcttctctggctccaagtctggcaacacggcctccctgacccatctcgtgggctccaggctgacgacgaggctgattatactgcagctnatatacaaccagcagcactctcgtgttcggcggacggacaagctacgacccgtcgtagtcacgcccaaggcctcgcccctcgg

SEQ ID NO: 241318 - DNA, 619 bp, Homo sapiens
  misc_feature: GYAE6OF02HOMXE.35.27.C05.1.454.CMB.1.raw
  modified_base (182)..(182): a, c, t, g, unknown or other
  misc_feature (182)..(182): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
tcagtacagatcgtcacgaccggtgctcgatttagacgcgatcgaagggtttgggagctctgagagaggagcccagccctgggattttcaggtgttttcatttggtgatcaggactgaacagagagaactcaccatggagtttgggctgagcggtcgtgttctaggtcggctatttaaaggngtcagtgtgaggtgcagctgttggagtcgtgggggagcttggacagcctgggggtccctgagactctccgtgtgaagcctcgtggacttcacctttaggaactngcatgtgcgtcggccgcgngctacgagggacggtcgtgggaggtggtcgtgtagttagttagtggtaggtggtgtagtactatacgtacgtacgacgtacgtacgtcgtacggtacgggtaccggttccgtaccgtactccgtaccgtacgagactaactacaaacgaacacactagtaactacgtacgtaactaaagtacgaacgacgacgtacgacgacgaccggacggaccgaccggtacgtaatacgttacgttagtacgtaacggtaacgaacgtagtaagtacgtacgttacgttacttatacggttacgttacggtaacgttaacg

SEQ ID NO: 241319 - DNA, 481 bp, Homo sapiens
  misc_feature: GYAE6OF02FH98A.35.27.C05.1.454.CMB.1.raw
  modified_base (473)..(481): a, c, t, g, unknown or other
  misc_feature (473)..(481): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacacactgaatctgcaaatgaacagcctgagagccgaggacacggccgtatattactgtgcgaaagacatatcgcgtattactatgcttcggagacttaaattgagctttgactactggggccagggaaccctggtcaccgtctcctcagcctccaccaagggcccatcggtcttccccctggccaccctcctccaagagcacctctgggggcacagcgccctgggctgcctggtcaaggactacttccacgatctgtactgagcgggctggcaagggcgcatgnnnnnnnnn

SEQ ID NO: 241320 - DNA, 505 bp, Homo sapiens
  misc_feature: GYAE6OF02IBA62.35.27.C05.1.454.CMB.1.raw
  modified_base (304)..(304): a, c, t, g, unknown or other
  misc_feature (304)..(304): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccaggcaaacgccccaaactcatgatttangatgtcagtaatcggcctgaggggtttctaatcgcttctctggctcaagtctggacacacgcctcctgaccatctctgggctcgagctgacgacgagctgattattactgcagctacatactaacaccagcacgcactctcgttgtcggcgacggacaagctcgaccgtctaggccagacccaaggctccggacccctcgg

SEQ ID NO: 241321 - DNA, 523 bp, Homo sapiens
  misc_feature: GYAE6OF02HMVB0.35.27.C05.1.454.CMB.1.raw
  modified_base (423)..(423): a, c, t, g, unknown or other
  misc_feature (423)..(423): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaacgcccccaaaactcatgatttatgatgtcagtaatcggcctcgaggggtttcaatcgcttctcgtgctcaagtctggcaacacgcctcctgacctatctcgtcgggctccgaggctgacgacggagctgatttattacngcagctacataactaacacagcagcactctcgtgttcgggacgagggaccaagcctacggaccgtcgtaggcacggacccgaaggcctccggcccctcgg

SEQ ID NO: 241322 - DNA, 527 bp, Homo sapiens
  misc_feature: GYAE6OF02HHHIN.35.27.C05.1.454.CMB.1.raw
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgataactatgtctcctggtaccaacaccaccaggcaaagcccccaaaatcatgatttangatgtcagtaatcggccctcgagggtttctaatcgcttctctggctccaagtctggcaacacggccctcctgaccatctctgggctccaggctgacgacgaggctagattattacngcagtctanatataccaacagcagcactctcgtagttcggcggacggtaccgaaggcctaggacccgtcgtacggtcacggcccgaaggcctccgtccccgtaccgg

SEQ ID NO: 241323 - DNA, 515 bp, Homo sapiens
  misc_feature: GYAE6OF02FQGT0.35.27.C05.1.454.CMB.1.raw
  modified_base (428)..(428): a, c, t, g, unknown or other
  misc_feature (428)..(428): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaagccccccaaactcatgatttatgatgtcagtaatcggccctcaggggtttctaatcgcttctctggctccaagtctggcaacacggcctccctgaccatctctgggcctccaggctgacgacgaggctgattatactgcagctnatatacaaccagcagcactctcgtgttcggcggacggaccaagctcggacccgttcctaggtcaggcccaaggcctcgccccctcgg

SEQ ID NO: 241324 - DNA, 516 bp, Homo sapiens
  misc_feature: GYAE6OF02FK0AR.35.27.C05.1.454.CMB.1.raw
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctctggtaccaacaccacccaggcaaacgcccccaaatcatgatttatgatgtcagtaatcggccctgaggggtttctaatcgcttctctggctccaagtctggcaacgacggccctccctgaccatctctggctcaggctgacgacgagctgtattattactgcagctacatactacaaccagcagccactctcgtgtcggcggacggacaagctcgaccgttaccgtaggcacgcccgaaggcctccgcccccgtcgg

SEQ ID NO: 241325 - DNA, 546 bp, Homo sapiens
  misc_feature: GYAE6OF02FE3OS.35.27.C05.1.454.CMB.1.raw
  modified_base (241)..(241): a, c, t, g, unknown or other
  misc_feature (241)..(241): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggngctgataactatgtctctggtaccaacaccacccaggacaaacgcccccaaactcatgatttatgatgtcagtaactccggcctcgaggggttttctaatcgtcttctctggctaccaagtctaggcaacgaccggccctccctagaccatcctcgttgggcctccgaggctaggaccgacgacgctgtattatactgcagctacatacacaaccagcagcactcgtcgtggttcggcggacggaccgaagtcgtacgaccgttccgacggtccacggacccgaggccctccgtccccgttacgg

SEQ ID NO: 241326 - DNA, 579 bp, Homo sapiens
  misc_feature: GYAE6OF02JV3LB.35.27.C05.1.454.CMB.1.raw
  modified_base (241)..(241): a, c, t, g, unknown or other
  misc_feature (241)..(241): n is a, c, g, or t
  modified_base (483)..(483): a, c, t, g, unknown or other
  misc_feature (483)..(483): n is a, c, g, or t
  modified_base (486)..(486): a, c, t, g, unknown or other
  misc_feature (486)..(486): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggngctgataactatgtctctggtaccaacaccaccaggacaaacgccccaaactcatgatttatgaatgtacagtaactccggcctacgtacgggtttctaacgtcgtcttcgtactcggtctacctaagtctcggaccaacgtaccgccctccctagacctacgtccgtcgtacgggcctaccgacggtctcggacgtacgacgtctagtattactactcgctacgctactatactaacacancanccagtctcgtcgttcggcggacggaccaacggtcgtacgtaccgttaccgacggtacgacggtacccgacggtaccctcccgtcccgtaccgg

SEQ ID NO: 241327 - DNA, 661 bp, Homo sapiens
  misc_feature: GYAE6OF02GSEBI.35.27.C05.1.454.CMB.1.raw
  modified_base (493)..(493): a, c, t, g, unknown or other
  misc_feature (493)..(493): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagcgtgtgttctaggtgctatttaaaggtgtcagtgtgaggtgcagctgttggagtcgtgggggaggcttggtacagccgtgggggtccctgagactctcctgtgagcctctggattcacctttaggaactatcgcctatgtgcgtgggtcccgcaggtctccgaggggaacgggctgggagtcgggtctgtagttagtagtggtagtggtgatactatacactacgcagactccggtagaacgggtcccggttacaccgtatcccgtaccgagacgtaaactaacttaccaaacggaaccacacttacgtaaactccgtagaacctaaaagttcgaaaaccncggtacccgtaggaacgaccgaccggtaagggaacctaccggggtacctttaaagtaccttacgttcgggtaacggtaacggaaaacgtaactaacgttaacggttaccggtaacgtttaaactttaccgttaacggcgtttaacccggtttagggaaacgtttaaac

SEQ ID NO: 241328 - DNA, 544 bp, Homo sapiens
  misc_feature: GYAE6OF02IZK91.35.27.C05.1.454.CMB.1.raw
  modified_base (517)..(517): a, c, t, g, unknown or other
  misc_feature (517)..(517): n is a, c, g, or t
tcagtacagatcgtcacgaccggtgctcgatttagacgcgatcgaagggttggggagctctgagagaggagcccagccctgggatttccaggtgtttcatttggtgatcaggactgaaccagagagaacctcaccactggagtttgggctgagctgggcttttctgtggctatttaaaggtgtccagtgtgaggtgcagctgttggagtcgtgggggaggcttgggtacaggccgtggggggtccctggagactctcctgtgaagcctctggattcacctttaggaactatgccatgtgctgggtccgccaggctccgaggggaacggggctgggagtgggtctcgtagttattagtggtagtggtgatactatacactacgcagactccgtgaagggccggtttcaccgtatcctccagagacaattccaagaacacactgaatctgacaaatgaacagcctagagagtccgaggacctacgggcctaatacgttactgtgacgaaagaccagtancgacgttattctatgacttggattaac

SEQ ID NO: 241329 - DNA, 539 bp, Homo sapiens
  misc_feature: GYAE6OF02IWHHE.35.27.C05.1.454.CMB.1.raw
  modified_base (426)..(426): a, c, t, g, unknown or other
  misc_feature (426)..(426): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaatacccaggcagagcccccaaactcatgatttttgaggtcagtaagcggccctcaggggtccctgatcgcttctctggctccaagtctgacaacacggcctcccttaccgtctctgggctccagactgaggatgaggctgattattactgcagctnatatgcaggcagcaaccgtttgacgttttcggacgggtagggacctaaggttcgaccgtacctaagtcaagcccgaaaggcctcgcccctgccactcctcgttcccaccctcc

SEQ ID NO: 241330 - DNA, 658 bp, Homo sapiens
  misc_feature: GYAE6OF02F7JMC.35.27.C05.1.454.CMB.1.raw
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctctggtaccaacaccacccaggcaaacgcccccaaaatccatgatttatgatgtcagtaatcggcccttgagggttttctaatcgctttctctcggctccaagttctggacaacgacggtccctccctgacccaattctcgtcgggccttccgagggtctggaaccgacgacggtctaggttaactttattacctgacctagccttacgaattaactaaccctaacccgaagtaccaacgtcctaaccctttccgttccggtttagggtttacccgggacggggttacgggaaaccccgtaaaggtcccgttacggtaacccccggtttaccggttaacgggtacccacgggtaacccccgaacgggtccccgttaccccggaccccccccgtttaccggg

SEQ ID NO: 241331 - DNA, 619 bp, Homo sapiens
  misc_feature: GYAE6OF02HRWOP.35.27.C05.1.454.CMB.1.raw
  modified_base (242)..(242): a, c, t, g, unknown or other
  misc_feature (242)..(242): n is a, c, g, or t
  modified_base (435)..(435): a, c, t, g, unknown or other
  misc_feature (435)..(435): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgataactatgtctcctggtaccaacacccacccaggacaaacgcccccaaactccatgatttatgatgtcagtaatcggcctgagggtttctaatcgcttctctgctcaagtctgacacacgcctccctgaccatcctcgtcggctccgagcgtgaccggtacgagggtcctagtaacttacgtttacgngacgtacgtctacctaattaaacgtaacccaaaccgaacgtaccaacggtaccctacctacgttccggttacgggtttccgggaccgggaacgggtaacccaaggtcccgttacggtacccgttccgtaacgggttccaaccggtacccgaacggggtcctacccgggtccccccgttaccggg

SEQ ID NO: 241332 - DNA, 582 bp, Homo sapiens
  misc_feature: GYAE6OF02H7XS9.35.27.C05.1.454.CMB.1.raw
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactcggaaccagcagtgacgttggtgctgaataactatgtctcctggtaccaacaccaccccaggcaaacgcccccaaactcatgattttatgatgtcagttaactccggccctgtagggtttctaagtcgcttctctggctccgaagtctggacaacgacgcctccctagaccatctctcggctcgagctgacgacgagctgattattactgcagctacattaactaaccaacctagaccagacctacctctcggttcgttaccgggacggacgggtaccgaacggtaccgtacggtacccgttaccgtacggttaccgacggtaccccgaacgggtcccgtaccggtccccccgttaccgg

SEQ ID NO: 241333 - DNA, 518 bp, Homo sapiens
  misc_feature: GYAE6OF02H3LFJ.35.27.C05.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (302)..(302): a, c, t, g, unknown or other
  misc_feature (302)..(302): n is a, c, g, or t
  modified_base (431)..(431): a, c, t, g, unknown or other
  misc_feature (431)..(431): n is a, c, g, or t
  modified_base (475)..(475): a, c, t, g, unknown or other
  misc_feature (475)..(475): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggnctgataactatgtctcctggtaccaacaccaccaggcaaagccccaaactcatgatttangatgtcagtaatcggcctcgagggtttcaatcgcttctctgctcagtctggcaacgcgcctcctgaccatctcgtgggcttccgaggtctgacgacgaggctagaattacttactgcagctcatactanaagcagcagctactcgtcgtcgtcggcggtagggaccaaggtcngtaccgtcgtacggtcaccgacccgaaggtccgtcgtccccgg

SEQ ID NO: 241334 - DNA, 555 bp, Homo sapiens
  misc_feature: GYAE6OF02INXL6.35.27.C05.1.454.CMB.1.raw
  modified_base (249)..(249): a, c, t, g, unknown or other
  misc_feature (249)..(249): n is a, c, g, or t
  modified_base (446)..(446): a, c, t, g, unknown or other
  misc_feature (446)..(446): n is a, c, g, or t
  modified_base (509)..(509): a, c, t, g, unknown or other
  misc_feature (509)..(509): n is a, c, g, or t
  modified_base (518)..(518): a, c, t, g, unknown or other
  misc_feature (518)..(518): n is a, c, g, or t
  modified_base (521)..(521): a, c, t, g, unknown or other
  misc_feature (521)..(521): n is a, c, g, or t
  modified_base (530)..(530): a, c, t, g, unknown or other
  misc_feature (530)..(530): n is a, c, g, or t
  modified_base (542)..(542): a, c, t, g, unknown or other
  misc_feature (542)..(542): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacagccgtggggggtccctgngactctctgtgaacgcctctggattcacctttaggactatgccatgtgctggggtccgccaggctccgagggacggggctggggagtgggtctcgtagttagttaggtggtaggtggtgatactatacacttacgcagtactcgtggaacggggtccgtacaccgattccaccgagacgactaactccaaagaaccncactagatcctagacaaagtgaacagcctaggacgacgccggagacgacggtactatattcgngtcaggaanacngtactacgngttaattcagtncgttaggattaac

SEQ ID NO: 241335 - DNA, 578 bp, Homo sapiens
  misc_feature: GYAE6OF02HMTNQ.35.27.C05.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (477)..(477): a, c, t, g, unknown or other
  misc_feature (477)..(477): n is a, c, g, or t
tcagtacagatcgtcacgaccggtgctcgatttagacgcgatcgaagggttttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggngctgataactatgtctcctggtaccaacaccaccaggacaaacgcccccaaatcatgatttatgattgtactagtaactccggcccttgtacgggttttctaattccgtcttcgtctggcctccaagtctaggacaacacggtccctccctacgaccattcctcgtacgggcctaccgaggtctcggaacgacggaggctagtatttattacagctacgtctacatactacaaccngccaagctactctcggtacgttcgggacggacggacctaaggcctacggacccgtaccgtaggtccacggacccgaagggtccctccgtcccccgttacgg

SEQ ID NO: 241336 - DNA, 487 bp, Homo sapiens
  misc_feature: GYAE6OF02I5MEB.35.27.C05.1.454.CMB.1.raw
  modified_base (453)..(453): a, c, t, g, unknown or other
  misc_feature (453)..(453): n is a, c, g, or t
  modified_base (469)..(469): a, c, t, g, unknown or other
  misc_feature (469)..(469): n is a, c, g, or t
  modified_base (475)..(487): a, c, t, g, unknown or other
  misc_feature (475)..(487): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacacactgaatctgcaaatgaacagcctgagagccgaggacacggccgtatattactgtgcgaaagacatatcgcgtattactatgcttcggagacttaaattgagctttgactactggggccagggaaccctggtcaccgtctcctcagcctcaccaagggcccatcggtcttccccctggccacccctcctccaacgacgcacctcgtcggggcacagcggccctgggctgcctggtcaaggactacttccacgatctgtacngagcggctggcaggcncatagnnnnnnnnnnnnn

SEQ ID NO: 241337 - DNA, 522 bp, Homo sapiens
  misc_feature: GYAE6OF02GGAGO.35.27.C05.1.454.CMB.1.raw
  modified_base (379)..(379): a, c, t, g, unknown or other
  misc_feature (379)..(379): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaacgcccccaaactcatgatttatgatgtcagtaactcggccctcgtagggtttctaatcgcttctctgctcagtctggcaacgcgcctcctgaccntctcgtcgggctccgaggctgacgacgagtctgtattatacngcagctanatactacaccagcacgctactctcgtgtcggcggacggaccgagtctacggaccgtcgtacggtcgacgcccgaaggcctccgccccgttcgg

SEQ ID NO: 241338 - DNA, 655 bp, Homo sapiens
  misc_feature: GYAE6OF02JY4L0.35.27.C05.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
tcagtacagatcgtcacgaccggtgctcgatttagacgcgatcgaagggtttggggggggtcgtcgaggaggcagcgctctcgggacgtctccaccatggcctgggctctgctattcctcaccctcctcactcaggcacagggtcctgggcccagtctcgccctgactcagcctgcctccgtgtctgggtctccgtggacngtcgatcaccatcctcctgcactggaaccagcagtgacgtttggctgatactatgtctcgtggtaccaacaccaccgaggcaaacgcccccaaatcaatgatttangatgtacaagtaactccggacctgtacgggttttacaacgttcgtctttccgtatcggtcctaccgtaaggttctacggacctaaaccgcccgggtcccctacccgttacggaccctaacttccgtaccggtcgggacccttccgaagggtcccttaagggaccgtaacgggtcggtcgtaagtaacgttttacgtaacccgtgacctagtccgtactaattacgaaaccaaacgtagctaactccgaaccttcgtacgtccgttagggcccggaaggtaccgaacgtccaggtaaccccgtgttacggaccaccggtaccaaggtccgttcccggaccccccgtagg

SEQ ID NO: 241339 - DNA, 582 bp, Homo sapiens
  misc_feature: GYAE6OF02IHOD0.35.27.C05.1.454.CMB.1.raw
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (312)..(312): a, c, t, g, unknown or other
  misc_feature (312)..(312): n is a, c, g, or t
  modified_base (334)..(334): a, c, t, g, unknown or other
  misc_feature (334)..(334): n is a, c, g, or t
  modified_base (376)..(376): a, c, t, g, unknown or other
  misc_feature (376)..(376): n is a, c, g, or t
tcagtacagatcgtcacgaccggtgctcgatttagacgcgatcgaagggtttggggggggggtctcaggaggcagcgctctcgggacgtctccaccatggcctgggctctgctattcctcaccctcctcactcagggcacagggtcctgggcccagtctgcccctgactcagcctgccctccgtgtctgggtctcctggacagtcgatcaccatctcctgcactggaaccngcagtgacgttggnctgataactatgtctctgtaccaacaccaccagacaaacgaccccaaactcatgtatttatgatgtnagtaactccgcctgtagggttntaatcgtcttctcgtgctccaagtctgacacgaccgcctccncgacctatctcgtggcctccgagctagacgacgaggctagtattacttacgtcgacacgctactacttaactaaccaacagccgtacgcctacttccgtggttcggttccgggacgggtacgggaaccgaacggtccgtaccggtacccgttaccgtacgggtaccaccggacccgtaacggtcctccccggtccccgtaccccgg

SEQ ID NO: 241340 - DNA, 730 bp, Homo sapiens
  misc_feature: GYAE6OF02F4M7S.35.27.C05.1.454.CMB.1.raw
tcagtacagatcgtcacgaccggtgctcgatttagacgcgatcgaagggtttgggggagagaggagcccagccctgggattttcaggtgttttcatttggtgatcaggactgaacagagagaactcaccatggagtttgggctgagctggtcttttcttgtggctattttaaaaggtgtccagtgtgaggtgcagctgttggagtcgtggggggagtgttggtacgagccggtcgggggtccctgacgtactctccgtgtagaacgtcctcgtggtacttacctaccgttaacggaacttagtcgactagtggtcgtcggtcggggtccccgccgacggtcccgtacccgggaaggggggaacggggtcgtaggggtaggttcgggtcctaggtaagtttaagttagggttagggttaggttgggtagtaacgttacttaacgtaacaccgtacgacgaacgtaccgttccggtagggtaacgggtcccgtaccaaccgtactcccgtaccgagaaccgaacttaactaaccgaaagaaacccaccgtactaaagtaacctgtacggaaactaaaagtacgaaaccggactaccggtaggaacggaccgacgggaacggaccgtaccgggtacttagttacttaacgtggacgaacaaacggtcaagttccgtacgttattaccttaatcgtgtaccgtaggtaaattactttaaggtcgtatttaccgg

SEQ ID NO: 241341 - DNA, 573 bp, Homo sapiens
  misc_feature: GYAE6OF02F4ZAM.35.27.C05.1.454.CMB.1.raw
  modified_base (227)..(227): a, c, t, g, unknown or other
  misc_feature (227)..(227): n is a, c, g, or t
  modified_base (364)..(364): a, c, t, g, unknown or other
  misc_feature (364)..(364): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcagtgacgttggtgctgataactatgtctctggtaccaacaccaccaggcaaagcccccaaactcatgatttatgatgtcagtaatcggccctcgaggggtttctaatcgcttctctggctccaattctggcaacnccggcctccctgaccatcctctgggctccgagctgacgacgagctgtatttatactgcagtctacataactaaccaaccgagacaacgcctaacttccgtcggttcgttaccgggcgggaacgggacccaacggccttacggaacccggttccgtagggttacccaacggacccccgaaggtcccgttccggacccccccgttaccggg

SEQ ID NO: 241342 - DNA, 517 bp, Homo sapiens
  misc_feature: GYAE6OF02HER52.35.27.C05.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (462)..(462): a, c, t, g, unknown or other
  misc_feature (462)..(462): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggnctgataactatgtctctggtaccaacaccaccaggcaaagcccccaaaatcatgatttatgatgtcagtaattggccctcgaggggtttctaatcgcttctcgtgctcaagtctggcacacggcctccctgaccatctcgtcggctccgaggctgacgacgaggctgaacttattacgtgcagcctactatactacaccagcagcactctcgtgtccggngacggaccaagcgtacgaccgtcgtaggtcacgacccgaggcctccgcccctcgg

SEQ ID NO: 241343 - DNA, 562 bp, Homo sapiens
  misc_feature: GYAE6OF02JDADR.35.27.C05.1.454.CMB.1.raw
  modified_base (354)..(354): a, c, t, g, unknown or other
  misc_feature (354)..(354): n is a, c, g, or t
  modified_base (468)..(468): a, c, t, g, unknown or other
  misc_feature (468)..(468): n is a, c, g, or t
  modified_base (502)..(502): a, c, t, g, unknown or other
  misc_feature (502)..(502): n is a, c, g, or t
  modified_base (510)..(510): a, c, t, g, unknown or other
  misc_feature (510)..(510): n is a, c, g, or t
tcagtacagatcgtcacgaccggtgctcgatttagacgcgatcgaagggtttgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacagccgtggggggtccctgagactctcctgtgaagcctctggattcacctttaggaactatgccatgtgctgggtccgcaggctccgaggggagggctggagtgggtctcgagttattagtggtagtggtnatactatacactacgcagtactcggtggaacgggtccgttacacccgatccgtaccaggaacgaacctaaacttccaaaagtaaccaacactagaactctagacaaatgaaacngcctagagacgcgacgacgacggctatattacgngtgagaancatagtcgacttattactagtcgtcgttacggaatactttaaagttgattcg

SEQ ID NO: 241344 - DNA, 614 bp, Homo sapiens
  misc_feature: GYAE6OF02HZOVJ.35.27.C05.1.454.CMB.1.raw
tcagtacagatcgtcacgaccggtgctcgatttagacgcgatcgaagggtttgggggggggtcacaagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgtatggttgggggttatgaccttgtctcctggtactcaacagccacccaggaccaaacgccccctaaacgtctttaaactttaataaacggaccaactaacgccgaccctcgagggtactttctaatccgtctttctcgtcggtactaccgaagtctggacctaacgtccgccctaccctagaacctaactctacgtcgggacctccggggctaggaggacgacggctaggtatttattacgttgttcgactctatagtgaccgtaggttacgtagactaacttaagttcgttcgttaccggaacgtcgggacctaggtcctaacggttcctagggtccaacgcccgaacggaccctaacccgagtacgtcctaccttccg

SEQ ID NO: 241345 - DNA, 595 bp, Homo sapiens
  misc_feature: GYAE6OF02HPTJ1.35.27.C05.1.454.CMB.1.raw
  modified_base (229)..(229): a, c, t, g, unknown or other
  misc_feature (229)..(229): n is a, c, g, or t
  modified_base (434)..(434): a, c, t, g, unknown or other
  misc_feature (434)..(434): n is a, c, g, or t
tcagtacagatcgtcacgaccggtgctcgatttagacgcgatcgaagggtttggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgctgataactatgtctctggtaccaacaccaccaggacaaacgcccccaaaactcaatcgatttatgatgtctaagtaatccggccctcgtaggggtttactaatccgtcttctctcggtctcaacgtctggacaaccgacggccctcccgtcgaccgtactctacgtcggcctccgaggctagacgacgnggacgtgtattaatactgcgagtctacagtactaaccaacagcagcctactctcggttcgtcgggacgggacggaaccgaacggccgtaccggtacccggttaccgtaacggtcctaaccggaccccgtaaacgggtccgttccccgccccggttacccgg

SEQ ID NO: 241346 - DNA, 589 bp, Homo sapiens
  misc_feature: GYAE6OF02FGU7A.35.27.C05.1.454.CMB.1.raw
tcagtacagatcgtcacgaccggtgctcgatttagacgcgatcgaagggtttggggggggtctcaggaggcagcgctctcgggacgtctccaccatggcctgggctctgctattcctcaccctcctcactcaggacacagggtcctgggcacagtctgccctgactcagcctgcctccgtgtctgggtctcctggacagtcgatcaccatctcctgcactggaaccagcagcgatgttgggggttatgaccttgtctcctggtatcaactagcacccaggcaaacgcccccaaactcttaattataaggacactaagcgacctcagggatttcaatcgcttctctggctccaagtctggcaactcggcctccctgacaatctcgtgggcctccgggctggaggacgaggctgtattattattgttgctacatagtgactaggtagtagactaacttaaagtcgttacgttacggaaacgttcggggaaccctaagggttccaacccggttccgttaagggtccacggtaccccgaagggaccccaaccccgtacgttccgtaccaccgttaccttccggttaccccccg

SEQ ID NO: 241347 - DNA, 517 bp, Homo sapiens
  misc_feature: GYAE6OF02FRYPS.35.27.C05.1.454.CMB.1.raw
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaagcccccaaactcatgatttatgatgtcagtaatcggccctcgtagggtttctaatcgcttctctggctcaagtctggcaacacgcctcctgaccatctctgggctccgaggctgacgacgaggctgtattattactgcatctcatanacaccancagcactctcgtcgtcggcggacggacgaagctacgaccgttccgtaggtcacggacccgaaggcctcgccccgtccgg

SEQ ID NO: 241348 - DNA, 655 bp, Homo sapiens
  misc_feature: GYAE6OF02FVF2H.35.27.C05.1.454.CMB.1.raw
  modified_base (266)..(266): a, c, t, g, unknown or other
  misc_feature (266)..(266): n is a, c, g, or t
  modified_base (330)..(330): a, c, t, g, unknown or other
  misc_feature (330)..(330): n is a, c, g, or t
  modified_base (464)..(464): a, c, t, g, unknown or other
  misc_feature (464)..(464): n is a, c, g, or t
tcagtacagatcgtcacgaccggtgctcgatttagacgcgatcgaagggtttggggggggggtcctcaggaggccagcgctctccgggacgtctccaccatggcctgggctcgtgcgtattccgtcaccctcctcacttcagggcacagggtcctgggcccaggtctgccctgactcagcctgcctccgtgtctgggtctccgtggacagtcgatcgaccatcctcctaggtccacgtgggaacccagtccaggtgaccgttggtncctgataactatgtctctggtaccaacaccaccgagcaaacgcccccgaaatcagtgatttagngtatgtcaagtaactccggcccttggtaacgggtttactaagtcgccgttctcgtggcctaccaagttcgtggacctaacgaccggccctcccgtgaccctagtcctcgtcgggctccgaggtctcgacgacgnggtctagattactactcggcagtcctagactactaacgaacccgtgtacgtacgtccaaccgttcgtcgggttaccggttcgggaccggggtacggaaccgaacggtccggtcccggaacccggtttaccgtaccggggtaccgaaccggtacccggtaacggtccggttacccggcccccggttaccggg

SEQ ID NO: 241349 - DNA, 659 bp, Homo sapiens
  misc_feature: GYAE6OF02H2I28.35.27.C05.1.454.CMB.1.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (306)..(306): a, c, t, g, unknown or other
  misc_feature (306)..(306): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccngcagtgacgttggtnctgattaactatgtctcctggtaccaacaccaccagacaacgccccaaactcatgactttangatgtacagtaacgtccggccctacgtagggtttactaatcgtcttctcgtgctcaagtctgacacgcgtcctccctcgacctactctacgtcgggcctcgacggctaggacggacggtacggcgtagtaagttagttaggagtcgttagtcttaacgttaagtaacggaaagtaccgtaaggtaccgtacccgttaactttaccgtaaacggtttaacggttacggttaccggggacgggaacggggtaaccgaacgggttaccgtaccgggtaccccggttaccggttaacgggtccgtaccggaaccccggtaacgggtcccgttacccgggtaccccccgttacccggg

SEQ ID NO: 241350 - DNA, 536 bp, Homo sapiens
  misc_feature: GYAE6OF02FWGQI.35.27.C05.1.454.CMB.1.raw
tcagtacagatcgtcacgaccggtgctcgatttagacgcgatcgaagggtttggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctctggtaccaacaccaccaggcaaagcccccaaactcatgatttatgatgtcaagtaactcggccctacgtaggggtttactaagtcgtcttctctggctccaagtctggacaacgaccggccctccctgaccatcctcgtcgggctccgaggcctgaccgacgaggctagtatttattactgcagtcctacaatacacaaccagcagcactctcgtgtcggcggaggaccaagctacgaccgtccgtaggtcacgcccaaggcctccgccccgtcgg

SEQ ID NO: 241351 - DNA, 559 bp, Homo sapiens
  misc_feature: GYAE6OF02I06JZ.35.27.C05.1.454.CMB.1.raw
  modified_base (242)..(242): a, c, t, g, unknown or other
  misc_feature (242)..(242): n is a, c, g, or t
  modified_base (302)..(302): a, c, t, g, unknown or other
  misc_feature (302)..(302): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgataactatgtctctgtaccacaccaccaggcaaacgcccccaaactcatgatttangatgtacagtaactccggccctcgtagggtttctaagtcgtctttctctggcctaccgtaacgtctcggacaacgaccggcccttcccgtcgacctatcctcgtcgggcctccgaggtcctaggacgacgaggtctagatttactacgtgacncgtctanatacaaccaccagcagcctacgtctcgtcgttcgggcggacggaccagtcctacgaccgttacgtagaccacggaccgaggcctcccgtcccgtccg

SEQ ID NO: 241352 - DNA, 574 bp, Homo sapiens
  misc_feature: GYAE6OF02H86LI.35.27.C05.1.454.CMB.1.raw
  modified_base (315)..(315): a, c, t, g, unknown or other
  misc_feature (315)..(315): n is a, c, g, or t
tcagtacagatcgtcacgaccggtgctcgatttagacgcgatcgaagggtttgggggggggggtctcaggaggcagcgctctcgggacgtctccaccatggcctgggctctgctattcctcaccctcctcactcagggcacagggtcctgggcccagtctgcccctgactcagcctgcctccgtgtctgggtctcctggacagtcgatcaccatctcctgcactggaaccagcagtgacggttgtgctgataactatgtctcctcggtaaccaaccaccaacccaggacaaacgcccccaaactcatgtatttangatgtactaagtactccggtccctgtacgggttactaagtcgtcttctctcgtctccgaagtctgaccaacgaccggccctacctcgacctactccgtcgtcgggtcctccgacggctacggacgacgaggtctagtatttaattactgacacgtctatatactaaccaacagcagcctactcgtcgtggtccgggacggacggaccgagcgtccggtacgtaccgtacggcgacggaccacggcctccgccccgtccg

SEQ ID NO: 241353 - DNA, 719 bp, Homo sapiens
  misc_feature: GYAE6OF02ISLU7.35.27.C05.1.454.CMB.1.raw
  modified_base (244)..(244): a, c, t, g, unknown or other
  misc_feature (244)..(244): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggtnctgaataactatgtctccgtggtaccaacaccacccgaggaccaaaacgcccccaaactcatagtatttatagatgtacagtaactccggaccctgtagggtttactaatcgtacttctcgtcgtcctaccgaagttcgtaggaccaacgacccggtcccttaccccgtcgaacctacgttccgtaccgtcggggtccctacccgtagggtacccttacggaccggaaccggtacgggtaccgttagttaactttaacgtttaccgacggtacctacggtccttaacgtaacttaacgtaacctaacgactaacggtaccaactccggtaactccgttacggttaccgggtccgggacgggtaaccgggtaaccgtaaaccggtccgttaaccggtaccccgtttaccggttaaccgggtcccgaacccgggttaccccggaacgggttacccccgtccccggttaaccccccgg

SEQ ID NO: 241354 - DNA, 733 bp, Homo sapiens
  misc_feature: GYAE6OF02HHYLG.35.27.C05.1.454.CMB.1.raw
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
tcagtacagatcgtcacgaccggtgctcgatttagacgcgatcgaagggtttggggggggggtctcgaggaggcagcgctctcgggacgtctccaccatggccgtgggctctagcttattcctcaccctcctcactcagggcacagggtcctgggtcccaggtctgcccgtgaacgtccaggcctagcctaccgtgtctgggtctccgtggacagtcgatcaccatctcctgcnctaggaaccagcagtgacgtggngctgactaacgtatgtactcgtaggtaccaacaccaccaggacaaacgaccccaaactcatgtatttagtagatgtacagtaacgtcggccctacggacggggtccctggtactcggtctttctcgttggaccttcctaaaggtctacgaaaccaaccgaccggtacccttcccttaaccgtcttaccgtcgggacccttacccgaggtaccgtacgggacggtatacgggaacgggtccttaggtaactttaacgttaaacgtcggacctacgtacctaaccgtaattaacgtcggaccgtaacggcgaaccggttaccttaaacccgggttttgttaaccgttttaccgggggacggtaccggggtaaccgttaacggttaccggtaacccggttaaccgtaacggttaccgaacgggtacccggtaacggtcccgtaccccggtacccccggttaccggtaccgttaaccccg

SEQ ID NO: 241355 - DNA, 604 bp, Homo sapiens
  misc_feature: GYAE6OF02JK6GK.35.27.C05.1.454.CMB.1.raw
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
  modified_base (391)..(391): a, c, t, g, unknown or other
  misc_feature (391)..(391): n is a, c, g, or t
  modified_base (423)..(423): a, c, t, g, unknown or other
  misc_feature (423)..(423): n is a, c, g, or t
  modified_base (482)..(482): a, c, t, g, unknown or other
  misc_feature (482)..(482): n is a, c, g, or t
  modified_base (528)..(528): a, c, t, g, unknown or other
  misc_feature (528)..(528): n is a, c, g, or t
tcagtacagatcgtcacgaccggtgctcgatttagacgcgatcgaagggtttgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcgttggtacagccgtgggggggtccctggagactctcctgtgagcctngattccaccgtttaggaactntcgccatgtgcgtgggtcccgccgaggcctccgaagggggacgggcgtgggaggtcgggtctcgaggtttagttaggtgggtagtggtagatactatacacgtacnacgtactccggtagaacgggccgttcaacctntcctaccagacactaacttccaaagaacacaactagaactcgagactaaagtcgaaacncgactgaacgacgaccggacgaccgacggtccgttaatacttacgngtacgaacgaaacgacaagtacgtaccgtagttaattaactagtcgtcgttacggattaaattaacgttgacgttc

SEQ ID NO: 241356 - DNA, 572 bp, Homo sapiens
  misc_feature: GYAE6OF02FFWCD.35.27.C05.1.454.CMB.1.raw
  modified_base (547)..(547): a, c, t, g, unknown or other
  misc_feature (547)..(547): n is a, c, g, or t
  modified_base (551)..(553): a, c, t, g, unknown or other
  misc_feature (551)..(553): n is a, c, g, or t
  modified_base (555)..(556): a, c, t, g, unknown or other
  misc_feature (555)..(556): n is a, c, g, or t
  modified_base (559)..(561): a, c, t, g, unknown or other
  misc_feature (559)..(561): n is a, c, g, or t
  modified_base (563)..(563): a, c, t, g, unknown or other
  misc_feature (563)..(563): n is a, c, g, or t
  modified_base (567)..(568): a, c, t, g, unknown or other
  misc_feature (567)..(568): n is a, c, g, or t
  modified_base (570)..(572): a, c, t, g, unknown or other
  misc_feature (570)..(572): n is a, c, g, or t
tcagtacagatcgtcacgaccggtgctcgatttagacgcgatcgaagggtttgggctcaactttcttgtccgccaggctccagggaagggctggagtgggtctcagttattagtggtagtggtgatactatacactacgcagactccgtgaagggccggttcaccatctccagagacaattccaagaacacactgaatctgcaaatgaacagcctgagagccgaggacacggccgtatattactgtgcgtaaagcatatcgcgtattactatgctttcggagacttaaaattgagtctttgactacgtgggaccgacgggaaccctggtcaccgtcctcctcacgcctaccaaccgaacgggcccagtccggtaccttccccgtcggcctacccctcctaccgaacgacggacctaccgtcggtcggggcacgtacggccggcccgtgggctcggccgtgggtaccaagggtacctacgttccagtacttcgtacggtactcggacgggcgggacgtgggacaacgggtacgcgtaacgtagcgacngtcnnngnnctnnncncgcnngnnn

SEQ ID NO: 241357 - DNA, 522 bp, Homo sapiens
  misc_feature: GYAE6OF02FOS19.35.27.C05.1.454.CMB.1.raw
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctctggtaccaacaccaccaggacaaacgccccccaaaactcaatgatttatgatgtacagtaactcggcctcgtagggtttctaatcgcttctcgtgctcagtctcgcaacncgccctccngaccatcnctggcncnggcngacgacgcgctgtaattatatgcagctacattacacaaccgnacanctactcgtcgtcgttcggacgacggacagtctcggtaccgtaccgtaggtcacggaccgaggcctcccgcccgtccgg

SEQ ID NO: 241358 - DNA, 567 bp, Homo sapiens
  misc_feature: GYAE6OF02GXBB8.35.27.C05.1.454.CMB.1.raw
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgataactatgtctcctggtaccaacaccaccaggcaaacgccccaaactcatgatttangatgtcagtaactcggcctcgtagggttctaatcgcttctgtcggctccgaagttctaggaccaacgtaccggccctccgtcgacctatctcgtacgggcctccgaggctacggacgacgaggctagtatttacgtactcgcagtctacactaactaccaacagcaacgctaacgtcttacgtcggttaccggcggacggaaccgaaggtccgtacgtaccgtccgtaggtaccacggacccgtaggccctccggcccctcgg

SEQ ID NO: 241359 - DNA, 572 bp, Homo sapiens
  misc_feature: GYAE6OF02GPBOA.35.27.C05.1.454.CMB.1.raw
  modified_base (242)..(242): a, c, t, g, unknown or other
  misc_feature (242)..(242): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccagcagtgacgttggngctgataactatgtctcctggtaccaacaccacccaggcaaagcccccaaactcatgatttatgatgtcagtaatcggccctcaggggtttcaatcgcttctctggctcaagtctggcaacacggcctccctgaccatctctgggctccaggctgacgtacgaggctagatttacttactgcagctcgaatataccaaccagtcagaccactcctacgttcgttccgggcggacggggtaacccaacggtacctcggaacccggttcccgttaagggttacccgacggacccccgtaaagggcccgttaccggcccccccgttacccggg

SEQ ID NO: 241360 - DNA, 698 bp, Homo sapiens
  misc_feature: GYAE6OF02IANMF.35.27.C05.1.454.CMB.1.raw
  modified_base (254)..(254): a, c, t, g, unknown or other
  misc_feature (254)..(254): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (381)..(381): a, c, t, g, unknown or other
  misc_feature (381)..(381): n is a, c, g, or t
  modified_base (544)..(544): a, c, t, g, unknown or other
  misc_feature (544)..(544): n is a, c, g, or t
  modified_base (556)..(556): a, c, t, g, unknown or other
  misc_feature (556)..(556): n is a, c, g, or t
tcagtacagatcgtcacgaccggtgctcgatttagacgcgatcgaagggtttggggggggggtctcaggaggcagcgctctcgggacgtctccgaccatggcctgggctctgctattcctcaccctcctcactcagggcacgagggtcctgggcccagtctgccctgactcagcctgcctccgtgtctgggtctcctggacagtcgatcacatctctgcactggaacctgcaggtgagtggttagggaattagngtaactatgtctccgtggtaacctaacttcaccctagacacacgtaccccaaaccngtanacttctaactaacgtgtaacaacttacgttcccggcctacgacggtacgtacctaagttccgtttcnccgttcggtcctacctaaggttctacggtacgttactcggtcccgggtcccttaacccgggttcaccccgttagtttaccgtccggtttcgaacccgttcgaacgggtcgtagacgggaacgtcggtattaggttaatttcgtgggattccgtagtactttanaagtaaggaacncgttaacgtgtaacccctagtttaccgaacgggttttaaacgcgtttaccgggggaacggtacgggtaaccaacggtcaaccgggtttacccgccgtaaggttcccaccggtaacccgtaccggtacccttccggtaccccg

SEQ ID NO: 241361 - DNA, 498 bp, Homo sapiens
  misc_feature: GYAE6OF02G434Q.35.27.C05.1.454.CMB.1.raw
  modified_base (305)..(305): a, c, t, g, unknown or other
  misc_feature (305)..(305): n is a, c, g, or t
  modified_base (418)..(418): a, c, t, g, unknown or other
  misc_feature (418)..(418): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaagccccccaaatcatgatttangatgtcagtaatcggccctgaggggtttcaatcgcttctctggctcaagtctcggctacacggctccctgaccatctctggctccaggctgacgacgaggctgatttattacngcagctcatatacacctagccagcactctcgtgtcggcgaggacagctgaccgtcgtagtcagccaaggctcgcccctcg

SEQ ID NO: 241362 - DNA, 798 bp, Homo sapiens
  misc_feature: GYAE6OF02JKIUH.35.27.C05.1.454.CMB.1.raw
tcagtacagatcgtcacgaccggtgctcgatttagacgcgatcgaagggtttggggggggggtctcaggaggcagcgctctcgggacgtctccaccatggcctgggctctgctattcctcaccctcctcactcagggcacaggctcttgggcccagtctgccctgattcagcctccctcgtgtccgggtctcctggacagtcagtcaccatctcctgcactggaacctgccagtgatggttagggaattatgactatgtctcctggtaccaacgttcacccagtacacacgtaccccaaacctattgaacttcctaacgaaacttcggtacctaaaattacgtttaccgggaccccttacggaagggtaaccgttccccgttaaaagtttcccggttttacctacgttcgggtacccttaaccgtaaacggtttccttacgggtaccttaaggttcgggtcccggttaccccgttcccggtcgtaccccgtactttcccgttccgtaacggtacccgttaccccgaacgggttacctacgggtaaacggggtaccggaacgggttccgttaggtaactttaagggttcgggtaactcggttcgttaacttacgttaaagttacggaacgttacgtaggtccgtaaccctacgtttacggtaccggttaaggtacgttacccggggacgggtaacgggtaacccggtaacggtccgtacgggtaaccccgttaccggtacggttacccgaaccggtaccccggtaaaccgggcccttcccgggtacccccttaccgggg

SEQ ID NO: 241363 - DNA, 671 bp, Homo sapiens
  misc_feature: GYAE6OF02JJ596.35.27.C05.1.454.CMB.1.raw
  modified_base (242)..(242): a, c, t, g, unknown or other
  misc_feature (242)..(242): n is a, c, g, or t
  modified_base (313)..(313): a, c, t, g, unknown or other
  misc_feature (313)..(313): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctgactaactatgtctcctggtaccaacgacccaccgagacaaacgaccccaaacgtcactgtatttacngatgtcagtactcggacctcgagggtttactaatcgtacttcgtctacggtctaccaagttctacggacaaccgtacggcccttccgtacgacctacgtcctcgtcggtaccgtccgtacggcgttacgaccgacgacggcttagtattacgttactcggactacgtacctactaactaacttaccaaaccacgaccacgacctaaccgtcgttaccgttcggttaccgggaccgggtaacggtaacccgtaacgggtaccggttaccggtaccccggtttaacccggtacggttacccgaccgggttaaccccgtaacgggtaccccggttaccgtacccccccggtttaacccggg

SEQ ID NO: 241364 - DNA, 691 bp, Homo sapiens
  misc_feature: GYAE6OF02G7MDO.35.27.C05.1.454.CMB.1.raw
  modified_base (226)..(226): a, c, t, g, unknown or other
  misc_feature (226)..(226): n is a, c, g, or t
  modified_base (540)..(540): a, c, t, g, unknown or other
  misc_feature (540)..(540): n is a, c, g, or t
tcagtacagatcgtcacgaccggtgctcgatttagacgcgatcgaagggtttgggggagagaggagcccagccctgggattttcaggtgttttcatttggtgatcaggactgaacagagagaactcaccatggagtttgggctgagcgtggctttttctgtggctattttaaaggtgtccagtgtgaggtgcagctgttggagtcgtggggggagtcgttggtacnggccggttcgggggtccctggacgactctccgtgtagacgtcctgtgtattcctacgttaacggaatagtcgcctagtggtcgtcggtcgggtcccgacgtcggtcctaccggaaggggacggggtcgtagggtagggttcgggtacctcgttaaggtttaagttgggttgggtagttgggtacgtattaactaacgttaccgaccgtacgactacggtacccgttacggtacgggaacgggttcccgttacaccgtactccgtacgaagggacaactacgttaaccgaaagaacctagactagaactcgtaanaactaagtacaacgtcgtcgagacgaccgaccggaagaccgacgtcttaatagtccgtggaacgaacgaagtactacgtaccgtaacgtacgtttaactagtacgttaccgtaacggttacggtaaatttaacggtttagtcgtaacttcg

SEQ ID NO: 241365 - DNA, 630 bp, Homo sapiens
  misc_feature: GYAE6OF02F0WFQ.35.27.C05.1.454.CMB.1.raw
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaccaccaggcaaacgcccccaaactcatgatttatgatgtcagtaatcgcctcgaggggtttctaatcgcttctctggctcaagtctggcaacgacgtcctccctgacctatcctcgtcgggtcctccgacggcgtcgacggacgacggcttaggtaatttacgttacgtgacctagtcctactaattaactaacgaagtaccaacgtacacgaccttaaccgttccgttccggttacggttaccggggaccggggtacgggaacccgaaggtcccgttacggaccccggttaccgttacgggtaccgacggtaccccggtaacgggtcccgtcccggtaccccccgttcggttaccccg

SEQ ID NO: 241366 - DNA, 767 bp, Homo sapiens
  misc_feature: GYAE6OF02IN3YM.35.27.C05.1.454.CMB.1.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtcctgccctgactcagcctgctcgtgtctggtctctggacagtcgatcgacctatctcctancacttggaaccngtccaaggtgaaccggttttggngtaccgttagaactaacgttactggttaccctaccgttacggtaccctaaaccgacccgaaccccgacggtaacccgaaccgtaccccccaaacgtacctaacgtaggtaatttacgtagtaacgtcgttacctaacggttaaacgtcccggtacccgttacgggtttacggtttaacgttaccgtcgtttaccttccgttcggtaccgttccgtaccggttaacgttcggtaccgtaaccgtaaccggtacccgtccccgttaccgtacccggtactaccgtacgttcggtccgtccgacggacgtcgtaccgacggtagtaccggtctaacgttagttaactccgtacgtagtactaccggtataacgtaacctaacggacgtactaacgtctaacggtcctacggttcccgtagtttacccgggcggtaacgggtaccgaacggtaccgtaacggtcccgacgttcccgtaaggtcccaacggtacccgtacggtccccgtcccggtaccccg

SEQ ID NO: 241367 - DNA, 641 bp, Homo sapiens
  misc_feature: GYAE6OF02I9THT.35.27.C05.1.454.CMB.1.raw
  modified_base (327)..(327): a, c, t, g, unknown or other
  misc_feature (327)..(327): n is a, c, g, or t
  modified_base (373)..(373): a, c, t, g, unknown or other
  misc_feature (373)..(373): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtcctcgtggacagtcgatccaccatcctcctgcacgtcggaaccagcaggtgacgttggtgctagaactaactatcgtctccgtacggtaaccaaccaccacccgagaccaaaccgaccccctaactcatagtatttangatgtacagtactccgtcctaggtacggttactatcgtcttctcgngtcctacagtcgcgacaacgtccgtccctcctcgacctagtcctacgtcggtacctccgaacggtcctacggaccggtaacgacgggtaccttagttaactttaacgtttacgtcggtacctacgtacctactaaacttaactaaccgaacctaggtaccacgtactccgttacgtcggtccggttacgggacggtaacgaccgtaacgtcgtaaccgtccgtaccgtaggaccctacggacccgtacggcctcccggaccccgtcgg

SEQ ID NO: 241368 - DNA, 539 bp, Homo sapiens
  misc_feature: GYAE6OF02FYN8Y.35.27.C05.1.454.CMB.1.raw
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaccaccaggcaaacgcccccaaatcatgatttatgatgtcagtaactcggccctcaggggttttcaatcgcttctctgctcaagtctggcacacggcctcctgaccatctcgtcgggctccgaggtctgacgacgaggctagattatactgctagctcattatacaancgagcagctaccttntcggttgtcgggcgagggaccaaggctacggaccgttccgtaaggtccaacggccccgtaagcccgttcccgaccccgtcggtaccc

SEQ ID NO: 241369 - DNA, 802 bp, Homo sapiens
  misc_feature: GYAE6OF02FVBU6.35.27.C05.1.454.CMB.1.raw
  modified_base (184)..(184): a, c, t, g, unknown or other
  misc_feature (184)..(184): n is a, c, g, or t
  modified_base (260)..(260): a, c, t, g, unknown or other
  misc_feature (260)..(260): n is a, c, g, or t
tcagtacagatcgtcacgaccggtgctcgatttagacgcgatcgaagggtttggggggggtcgtcgaggaggcagcgctctcgggacgtctccaccatggcctgggctctgctattcctcaccctctcactcaggcacagggtcctgggcccagtcctgccctgactcagcctgcctcgtgtcngggtctcctaggcaggtcatcacctatcctcctgaccactgggaaccagcagtgacgtttggcgctgataactatntctctggtaccaactaccacccaggaccaaagccccccaaaatccatcgaatttagtcgaattcgactaagttaacgtaccggcccttacgtacggggttttccttaaacgttccgtccgtttcgttaccgttcggggacctttacccggaaaaggtttccgttccggggtaaacctaaacccgtaacccgggtcccttttcccccgtaggtaaaccccctagtttaccccgtttccgttacgggggtaccccttaccggaccggggtaaccgtttacggaacccgggtaacggttaaaccggggccgtttaacggttaacgttttaactaacccggttcggtacttaacgcccgtttacgtaaccttaaataacccgttaaacccaggtacctaagtcccgtaaacctttccggttacggttcggtttaccgggaccggggaacgggtaacccaagggttaccgttaacccgggtacccgttaccgttacggggtacaccggttaaccccgaggacccggtttcccgaccccccgtttcgg

SEQ ID NO: 241370 - DNA, 599 bp, Homo sapiens
  misc_feature: GYAE6OF02F7I1R.35.27.C05.1.454.CMB.1.raw
tcagtacagatcgtcacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactggaacccagccagtgacgttggtgcctgataactatgtctcctggtaccacaccacccaggcaaacgccccccaaactcatgatttatgatgtcagtaactcggacctcgagggtttcaatcgtcttctctggctccaagtctacggcaacaccggtccctccctgaccctatcgtctgggcctccgaaggtcctggaccgacggaggcctaggtactttatactgccagtcctcaacttaactaaccaaaccagcctaacgcctaaccgttcgtacgttcggttaccgggacgggacgggaccctaaggccgttacggacccgttccgtaacgggtccacggaccccgtaagggcccttaccggccccccttaccggg

SEQ ID NO: 241371 - DNA, 662 bp, Homo sapiens
  misc_feature: GYAE6OF02FMUC6.35.27.C05.1.454.CMB.1.raw
  modified_base (601)..(601): a, c, t, g, unknown or other
  misc_feature (601)..(601): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacagccgtggggggtccctgagactctcctgtgcagtttctggtacttccctttcaatgtcgcctggatgaactcgggtcccgccgaggcctaccgagggacggactgggaggtgggttcgcccgagtaacgttaaaaggagtaagtttcggagttcggggacgggtaacaacgagactacgcttaccgacccgttcgacgggctagacttccgaacccgttctacccgaagtacgtaacgttcggtaactttcccaagttcggaagttaccttcccgtaggtttcctaccgtaaactaaacgttgaaaccgtcgaccttacgaacccgtaaaccgacggaaccacgacggtcctacttattacacgtaaccnctaccgtacgaaccctaccgactcggccctaaccgttccgacgtaaccgtagttacccggg

SEQ ID NO: 241372 - DNA, 684 bp, Homo sapiens
  misc_feature: GYAE6OF02IAKUJ.35.27.C05.1.454.CMB.1.raw
  modified_base (242)..(242): a, c, t, g, unknown or other
  misc_feature (242)..(242): n is a, c, g, or t
tcagtacagatcgtcacgaccggtgctcgatttagacgcgatcgaagggtttggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccgcagtgacgttggngctgataactatgtctcctgtaccaacaccaccaggacaacgcccccaaactcatgtaatttatgatgtcagtatccgtcctcgtagggtttctaatcgtactttctcgtggtcctaccgtaacgtcgtcgacctaaccgtacccggtacccctcccgtacgtaaccctacttccgttccgtcgggtccctcccggacggccgttacggaccggaacggtacgggtcctaggttaactttacgtttaacctgggtacctacggtcctactaacttaactaacccgaaaccacgtaccaacgtacccgttccttacgttcgggtccggttaccggggtaccgggaccgggtaacgtaaccggtccgttaccggtacccgttacgtaccgggtccgaaccggaccccggtacggtacccggttaccccggccccggttacccgg

SEQ ID NO: 241373 - DNA, 654 bp, Homo sapiens
  misc_feature: GYAE6OF02IDSKS.35.27.C05.1.454.CMB.1.raw
  modified_base (231)..(231): a, c, t, g, unknown or other
  misc_feature (231)..(231): n is a, c, g, or t
  modified_base (328)..(328): a, c, t, g, unknown or other
  misc_feature (328)..(328): n is a, c, g, or t
tcagtacagatcgtcacgaccggtgctcgatttagacgcgatcgaagggtttggggggggggtctcaggaggcagcgctctcgggacgtctccaccatggcctgggctctgctattcctcaccctcctcactcagggcacagggtcctgggcccagtctgccctgactcagcctgccctccgtgtctgggtctcctggacagtcgatcaccatctcctgcactcggaaccngacagtcgacgttggtagctagaattaactatcgtctaccgtagtaaccaacaacccaccgaagacaaaccgacccccaaaactcaattgtatttangatcgtataagtaactccggccctaggtaagggtttactaatcgtcttactcgtgtacctacaagtcgtaggaaccaaccgtacgtcccttcccgagaaccctacgttctccgtcgggtccctaccgagccgtaggaccgacggaggacttagtaactttaagttacaggctacgtacactaataactaaccgaacacgtacacgtacctacttccggtacgttacgggtcgggaccgggtaacgggaaccctaacggaccgtaccgtaaccccggttacgtacggaccgacgacccggtaacggccttaccccggcccggtaccg

SEQ ID NO: 241374 - DNA, 611 bp, Homo sapiens
  misc_feature: GYAE6OF02F3MAQ.35.27.C05.1.454.CMB.1.raw
  modified_base (242)..(242): a, c, t, g, unknown or other
  misc_feature (242)..(242): n is a, c, g, or t
  modified_base (306)..(307): a, c, t, g, unknown or other
  misc_feature (306)..(307): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngctagataactatgtctctggtaccaacaccacccaggacaaacgcccccaaatcatgtattannatgtacagtaacgtccggcctacgtagggtttactaatcgcttcctgtcgctaccaagtcgtgaccaacgaccggtccctacccgtgaaccctattccgtacgtcgggcctaccggaggtccctaggaccggtaacggcggtaccgtagttaactttacttacctaggccagtctacgtataactaacacgtcaagtaccagacctacgtcgtcggtcggttacgggacggaacgggtaaccaaggccgtacgacccgttacgtacggtaccaccggacccgtacggtcctcccggtacccccg

SEQ ID NO: 241375 - DNA, 632 bp, Homo sapiens
  misc_feature: GYAE6OF02IQOFH.35.27.C05.1.454.CMB.1.raw
  modified_base (227)..(227): a, c, t, g, unknown or other
  misc_feature (227)..(227): n is a, c, g, or t
  modified_base (417)..(417): a, c, t, g, unknown or other
  misc_feature (417)..(417): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccngcagtgacgttgtgctgactaatatcgtctcctggtaccaacaccaacctacggacaaacgaccccaaactcatcgtacttatgatcgtctagtaactcggtcctacgtacgggttactaacgtctcgtcttcgtcggtcctaccgtaagtctacggactaaccgaccgtcccgttccctcgaacccgtnttaccgtcgtacgggtcctccgtaacggccgttacggaacgacgggtacgcggttagtacgttaacgttacgtcgacgtcgaccgtactaatacgttaacgacgtacacgtacgatcctaacgtcgtcgttcggtacgggtcggacgggtaacgacgcgtacggtccgttacgacgttaccgaccgaaccggacgtacccggtccgtacccccgg

SEQ ID NO: 241376 - DNA, 530 bp, Homo sapiens
  misc_feature: GYAE6OF02F6G3O.35.27.C05.1.454.CMB.1.raw
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaccacccaggccaaagcccccaaatcatgatttatgatgtcagtaactcggccctgaaggggtttctaagtcgacttctctggtctccaagtcgtggacaacgacggcctccgtgaccattctctgggctccgaggtctggacgacgagctgacttatactgctagctcgatatacagcagcagcactctcgtgtcggcggacggacaaggtcaggaccgtcgtacggaccacgcccaaggcctaccgccccgtgtaccc

SEQ ID NO: 241377 - DNA, 551 bp, Homo sapiens
  misc_feature: GYAE6OF02G7VI8.35.27.C05.1.454.CMB.1.raw
  modified_base (313)..(313): a, c, t, g, unknown or other
  misc_feature (313)..(313): n is a, c, g, or t
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (423)..(423): a, c, t, g, unknown or other
  misc_feature (423)..(423): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (500)..(500): a, c, t, g, unknown or other
  misc_feature (500)..(500): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctcctgcactggaaccaggcagtgacgttggtgctgattaactatgtctcctcggtaccaactacccacccaggccaaacgccccccaaactcatgatttangactgtcagtaactccggccctcgaggggttttctaagtctcttcctctggctcaacgttctcggcaacacggccttccctggaccntctctgggcctcgngctgaccgngacggtctagatttactacgngacngctcatacacaccagcagcactctcgtcgttccgacgggacggaccagtccncgaaccgtcgtacggtcaccggtacccgaggtcctccgtaccccgtaccgg

SEQ ID NO: 241378 - DNA, 663 bp, Homo sapiens
  misc_feature: GYAE6OF02IENPM.35.27.C05.1.454.CMB.1.raw
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (458)..(458): a, c, t, g, unknown or other
  misc_feature (458)..(458): n is a, c, g, or t
  modified_base (517)..(517): a, c, t, g, unknown or other
  misc_feature (517)..(517): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagctggtcttttctgtcggcttaattttaaaaggtntccagtgtacgnggtncgagctgttggagtcgtgggggngtcgtggtacagccggtgggggtcctaggacnctctctgtgaacgcctcgtaggtacttactacctttaggaactgtacgcctatggtgtcgttagggcccaccgtggcccgttcggaaggggtacggtcgtaggcggttggtaacttcgttaagtttagtggtggtaggttggatntaacgtntanaccgtncgtanactcgtaggaacgtccgttacacgtatccgtaacngtaacacctaagttaccaaagaacctacacgttacgaacctgtacgaaactaacggtanaacccgattcccgaaggtaccgacgacggttaacgcgaaccggtcgtaattacgtactcgtacgtaacgtaaccgaagttgtaacgttaccggttaacttaacgttacttaccgtcgggttaaccttacgggtaaattttaaaccg

SEQ ID NO: 241379 - DNA, 1198 bp, Homo sapiens
  misc_feature: GYAE6OF02HJ3RB.35.27.C05.1.454.CMB.1.raw
  modified_base (344)..(344): a, c, t, g, unknown or other
  misc_feature (344)..(344): n is a, c, g, or t
tcagtacagatcgtcacgaccggtgctcgatttagacgcgatcgaaagggtttgggggggggtctcggaggaggctagcgctcgtcgggacgtcgtccaccatggccgtgggctacgtaagctaattccctacctacccgttccgttcctaccttccgaggggcctacggagggggtcccgtcgggacccccaaggtccttcgggccccttggaccctcgacgccgtgcccgttcccggtggtccgtggggggttcccttcccggtacgggaaccgacggttcggaagtacccaccccgttaagtcccttccccgttggacccctaccgttaccgggaaacccncggtaccgtaggttccggtaccgggtttgggggtccgtacccttaggtaaacttaaccgtaagttccgttaccgttcccgttaacgggttaacccctaaacccgtacccggtaaccccgggtaagggtaacccgtaaaacccggccccccccgtaaaactcccggaacccgttaggggtaacgttttacgacgggtaagttacgggtaacgttaacgggttaacgtttaccccgggtaccccgttaacggggttaacggggggttttacctaaacggttacccgtacccgttttaaccgttacccggttaacccgggtaccccttaaaccggtaaaacgggttttcccggaaacgggtaacccctaaaccggtacccgggttacccctttaccccggtaaggtaacccctaaccgtttacccgtaacccgggttaaccggttaccccgttaaccccggtacgggtaccgttaaccgggtacccgggtaaaacggttaccgggtacccgtttacgggttaacgttttaaacccggttacccgtacggtaacccgtaacgggtttaccccgtaacggttaaaccttaacccgtttaaaaccccgtaaacccggtaaccgttaccggtaaccggtacccgttaacccccgggttcccggtttaacccgggggttcccgggttaacccggggtaacgggggttaacccgggtttaaccccgttaacgggtacccggtttaccccggttaaacccgggtttacccggttaaacggggttacccgggtaaccccgggggttaacccccggggttaaaaccgggttccccgggttaacccccggttacccccggggtttaa

SEQ ID NO: 241380 - DNA, 603 bp, Homo sapiens
  misc_feature: GYAE6OF02GHRPG.35.27.C05.1.454.CMB.1.raw
  modified_base (244)..(244): a, c, t, g, unknown or other
  misc_feature (244)..(244): n is a, c, g, or t
  modified_base (373)..(373): a, c, t, g, unknown or other
  misc_feature (373)..(373): n is a, c, g, or t
  modified_base (454)..(454): a, c, t, g, unknown or other
  misc_feature (454)..(454): n is a, c, g, or t
tcagtacagatcgtcacgaccggtgctcgatttagacgcgatcgaagggtttggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtnctgataactatgtctctggtaccaacaccaccagcaaacgaccccaaactcatgatttatagatgtacagtaacgtccggccctcgtagggtttactaatcgtccttctcgtcgtctccaagtttttcngcaacgcgtcctcctcgaccatctcgtcggcctcgagcgtagacggacgacggctagtacttattacgtcgtcacgtcctntacttaataaccaacgacgccagtaccacttcctacgttcggtcgggacgggtaaccgggaaccgtaacggacgttaccggtacccggttacccgttaggtacccgaccggtaacccggacggtacccttcccggccccgttaccccgg

SEQ ID NO: 241381 - DNA, 698 bp, Homo sapiens
  misc_feature: GYAE6OF02GFSPY.35.27.C05.1.454.CMB.1.raw
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
tcagtacagatcgtcacgaccggtgctcgatttagacgcgatcgaagggtttggggggggggtctcaggaggcagcgctctcgggacgtctccaccatggcctgggctctgctattcctcaccctcctcactcagggcacagggtcctgggcccagtctgccctgactcagccctgcctcgtgtctgggtctccgtggacagtcgatcaccatcctcctgctacgtcggaaccngacagtcgacggttggtncctagaactaacttagtctccttccgtaggtaacccaaaccacccacccgaaggaccaaaacccggaccccccaaactcaagttacgtaatttagcgtatcgtactaaggtaactccggaccctaggttacgggttttacaacttccggtactttcgtacgtccggtactaccgtaagttccgtaggacctaacgtacccggtccctacccggtaactaccctacgtaccttccggtacggtcctaccggaggtcgtaacggacgacggtacggtactcgttaaattatacgttcgactacgtacctataactacgtaacacgtacgctacgacgttacctcgttcgtcgggtaccgagggtaacccggtacgaacgtccggtacgtaacccggttaccggtactaccggaccgtacccgaacgtccgttacccgtaccccggtcg

SEQ ID NO: 241382 - DNA, 653 bp, Homo sapiens
  misc_feature: GYAE6OF02H1P8Y.35.27.C05.1.454.CMB.1.raw
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcgagggcacaggggtcctgggcccagtctcgccctgactcagcctgccctccggtgtcgtcgggtccttccgnggaccnggtcgatccaacctatcctccgtgaccacgtaggaacccagcaggttgacggttggtgactgaactaactagtgtctccgtcgtaaccaacacccaccgaggaccaaacgaccccctaaaactcagtatatttatgactgtacagtactcggccctgtacgggttctactcgtacttctctcggctcagtctcggactaccgaccgtcctccganaccncttcgtcgtcgggcctcggtacgctacggacgacgaccggtgtacgtaagttaactaaccgtgacctaacgcctatacgtaaacttaacccaaccggaacgtacaacgtctaacccgtgttcccgttaagggttcccggacggacggtaaccgaacgtcgaccgtaccgttaccggtaggtaccgaccggacccgttacgggccctccccggtaccccgtcccgg

SEQ ID NO: 241383 - DNA, 720 bp, Homo sapiens
  misc_feature: GYAE6OF02G6GSD.35.27.C05.1.454.CMB.1.raw
  modified_base (244)..(244): a, c, t, g, unknown or other
  misc_feature (244)..(244): n is a, c, g, or t
tcagtacagatcgtcacgaccggtgctcgatttagacgcgatcgaagggtttgggggggggtctcaggaggcagcgctctcgggacgtctccaccatggcctgggctctgctattccctcaccctcctcactcagggcacagggtcctgggcccagtctgccctgactcagcctgcctccgtgtctgggtctcctggacagtcgatcaccatcctcctgcactggaaccagcagtgacgttggngctgaataactatcgtctctcggtaccaacaccaccgacgacaacgccccaaactctatgtatttatgtatgtactagtaacgtccggcccttaggtacggggtttcctaagtccgtcttcgtcgtcggtcctacctaacgtcgtacgaccaaccggacccgtccctaccctcggaaccctacgttccgtaccgtcgggtccttaccggacgggtccgtacggacggaaccgggaggtaccgtaggtactttaacgttaccgttacgtaccgacgtacctactaacgtaacctaaccgaaccgtacgtaccgtacgtaccctaccgttcgttaccggttcgggttacccgggaccggggtaaccgggtaccgtaacggtaccgttacccgggtacccggttacccggttacgggtacccgtaccgggtaaccccgtaaccgggtccccgttaccccgggtcccccggttacccggg

SEQ ID NO: 241384 - DNA, 678 bp, Homo sapiens
  misc_feature: GYAE6OF02IZKF2.35.27.C05.1.454.CMB.1.raw
  modified_base (333)..(333): a, c, t, g, unknown or other
  misc_feature (333)..(333): n is a, c, g, or t
  modified_base (505)..(505): a, c, t, g, unknown or other
  misc_feature (505)..(505): n is a, c, g, or t
tcagtacagatcgtcacgaccggtgctcgatttagacgcgatcgaagggtttgggggggggtctcaggaggcagcgctcgtcgggacgtctccaccatggcctgggctctgctattcctccaccctcctcactcgagggcacgagggtcctgggcccagtctgcccttgactcacgcctgcctccgtggtctgggtctcctaggactagtcgatccaccatcctcctgactacgtggaaccagcgtagtcggtagttggtagctagataactatcgtctcgtagtaccaacaccaccgagacgtaaccgaccccaactcagtagtactttagngtatagacgtagtacgtcgaccgtacggttacgggttactagtaccgtctttccgtacgtacgaccttacgaacgtcgtacgtaacgaaccgtaccgtaccctcccgtacgtacctaccgttctaccggtcggtaccgtccgtacggtccgaccggaaccgacggtaacggntttaacgtactttagtacctgtaccgagtactactaagtacctaaccgaacgacgtacgtacgacccttacgtcgttaacggtccggttacggacgggtacgaccggacgtaccgaccgtaccggtacgttaccggcgaccggtaaccgccgtaccgtcccgacccgttaccg

SEQ ID NO: 241385 - DNA, 797 bp, Homo sapiens
  misc_feature: GYAE6OF02J3HBL.35.27.C05.1.454.CMB.1.raw
  modified_base (139)..(139): a, c, t, g, unknown or other
  misc_feature (139)..(139): n is a, c, g, or t
  modified_base (568)..(568): a, c, t, g, unknown or other
  misc_feature (568)..(568): n is a, c, g, or t
  modified_base (578)..(578): a, c, t, g, unknown or other
  misc_feature (578)..(578): n is a, c, g, or t
tcagtacagatcgtcacgaccggtgctcgatttagacgcgatcgaagggtttggggggggtctcaggaggcagcgctctcgggacgtctccaccatggcctgggctctgctattcctcacctcctcactcagggcaacngggtcctgggaccctagtctgccctgactcagcctgcctcgcgtcggtctctggactgtcacgtcactactctcctgccacgtacgaccaactagtggtacgtttggtagttaactacgttcgacgtcctacgaagttaccggaccaactaacgtaccgagcctacggaccgaccccctaaatgtactgtttactttaggacggtacgtacggtaacggcccggtaccgtacggtaccggtccgtatccgtcgttccttctacgggtcgtacctaacgaacggttcaacggtacccgtaacccgccgtttacccgtaacccgttccgtaaccgtttccgacggtaccctacggtaccggtaagtacggtacgggtacacggtacgtacggttaattaccgtttaacgacgtacgtactcgtactaccgntaaccggtcnccgtaaacgccgtaacggttacgtttaaccgttacggttaccggtaagggacccgttaaacggttaccgtaacgggttcccgtaaaccgttccggaacccgttacccggtacggaacccccggttaccggtacccggttaaccccccgggtttcccgttaacccggtacccgttaccccgtttaccccggttttacccccggtaccccgttaacccggg

SEQ ID NO: 241386 - DNA, 811 bp, Homo sapiens
  misc_feature: GYAE6OF02J0U6Q.35.27.C05.1.454.CMB.1.raw
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggcagtccgatccacatcctcctgcacgtcggaaccaggctagtcgacggtttggtgctgaattaactatgtctcctaggtaccaacaccacctacggaccaaccgacccccaactacgtactagtatttagtacgagtcgtaactacgtaacgtcccggtacccgtcgtaacggggtttaccttaagtccgttaccgtttcttaccgttcgggtcccttaccgtaaacggtttcccgtacggtacctaaacccggtacccggtacccccgtttccccgtacggtaaacccctcgtttacccgttccggttacgggtcccttacccgacggtaccggttaaccgaaccgggtaaccggtacggtcgttacggtaacgtttacttaaccgttcggaccgtacgtacctaaccttaaacgttaacctaaccgtaaacccgacggtaacctaccggtaaccgttaccttaccggttcgtacggggtttcccggggacgggttacccgggtaacccgtaacggtccccgttaacgtaaccccgggttccttaaccgggtaacccgtaccgggaaccccggttaaccggcccggttacccccggtcccccggttaacccgg

SEQ ID NO: 241387 - DNA, 858 bp, Homo sapiens
  misc_feature: GYAE6OF02J136E.35.27.C05.1.454.CMB.1.raw
  modified_base (142)..(142): a, c, t, g, unknown or other
  misc_feature (142)..(142): n is a, c, g, or t
  modified_base (836)..(836): a, c, t, g, unknown or other
  misc_feature (836)..(836): n is a, c, g, or t
  modified_base (856)..(856): a, c, t, g, unknown or other
  misc_feature (856)..(856): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacganagtacgtcgtaggaacgggtccgttacacctactcctacgagacaactaacttaccgaaacgaaccaactacgtaagaacttcgtacgaactaaagtacgaaacgacgtccgtaggaaggacggaccggaagggaccgacccgggttacttaattaacgttaccgtggacggaaacggaaaacgactaagttacgtccggtacgtttaacgtttaacctaagttcgttaccgttaccggaaagttaaacttttaaagttgtaaccgtttgtttacgtaaccgttacgggtaccgggtacccggaaaccgggtaacccggttcggtaccccgtaaccccggttaccccctacgacccgtaccccgtaaccccgaaacccgggtaacccggacccgttaaccggtcccgggtttcccccttccccccggtacgggaccccttaccccctaccccgtaacccggtaaacggaccctacccgttacccggtccggggtacggggacctaacccggaccggggcccggtcccgtacgggtccgaccggtcccgggtacgtaacggtaaccgtaccgtttaaccgtcccaacggttaacttccggttagttaccggcggtacggtaccgggtacgtccgggaacgcggtaacccgacggttaagcggtacgcgtagacgacgcgcgacgtcgacgtgacncgacgacgcacgacgcacgntc

SEQ ID NO: 241388 - DNA, 544 bp, Homo sapiens
  misc_feature: GYAE6OF02HUGG4.35.27.C05.1.454.CMB.1.raw
  modified_base (306)..(306): a, c, t, g, unknown or other
  misc_feature (306)..(306): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (448)..(448): a, c, t, g, unknown or other
  misc_feature (448)..(448): n is a, c, g, or t
  modified_base (467)..(467): a, c, t, g, unknown or other
  misc_feature (467)..(467): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccaggcaaacgcccccaaactcatgtatttangatgtcagtaactcggcctgtagggtttcaatcgcttctcgtgctacagtcnggcaacncgcctcctgacatctcgtcgggctccgaggctgacgacggacggcttgaatttattactgctagctcatactacaaccagcancctacgtctcgtgtccggnggaacggtaccaaggtcctacggacccgttacgtaggtcccaacggacccgtaaggtccctccggcccccgttacgg

SEQ ID NO: 241389 - DNA, 823 bp, Homo sapiens
  misc_feature: GYAE6OF02F163X.35.27.C05.1.454.CMB.1.raw
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagctggtctttttctgtggcttaattttaaaaggtgtccagtgtgaggtgcagctgttggagtcggtgggggaggtcgttggtacacggtccggtcggggggtccctaggacgtaccgttccttccgtggtacgaaccgtccgttacgtggtactttccgtaaccgttttaagggaaaccttagtcgacctagttggttacggtcggttccgggtcccgaccggtaggtcccgtaccgggaagggggtaacggggtcgttaggggacgggttcgggttaccttaggttaacggttttaaggtttagggttaggggttaaggttcgggttaaggtaacgtttaaacgttacgtaaaccgtaacccgttaaccgtaaccgtaacggtaacccggttccgggttaacgggtaaacccgggggttccccggtttaaccaaccggttccttacccgtaacccggaaggtaaccgaaaccttaaccgttaaccaaaacgtaaccacgtacgtagaaactccgtagaaacctaagaccgaacgtcgcgtaaggacgaccggtccggaaacggtaccgaccggtacgttacgtaacgttcggtagaacggaacgtaaacgtactaacgttcgtaactacggttaatttaccggtagtaccgtacgttaaccgtattaaacg

SEQ ID NO: 241390 - DNA, 547 bp, Homo sapiens
  misc_feature: GYAE6OF02HSOZV.35.27.C05.1.454.CMB.1.raw
  modified_base (480)..(480): a, c, t, g, unknown or other
  misc_feature (480)..(480): n is a, c, g, or t
  modified_base (522)..(522): a, c, t, g, unknown or other
  misc_feature (522)..(522): n is a, c, g, or t
  modified_base (525)..(540): a, c, t, g, unknown or other
  misc_feature (525)..(540): n is a, c, g, or t
  modified_base (542)..(547): a, c, t, g, unknown or other
  misc_feature (542)..(547): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacacactgaatctgcaaatgaacagcctgagagccgaggacacggccgtatattactgtgcgaaagttcgagttgtggctggtacgaggtcgggatatgactacgtggggccagggagccctggtcaccgcctcctcacgcctccacgacggcccagtccggtcctccccgtggcctccctcctaccaagcaccacctcggtcggggactacgacggcccggacccgtcggggcctcggcccttgggtaccgaaggacccttaccgttcccgacgtaacttccgtgttaccnggtacggcgggtcgtcgggacacgggcgactacgtagcacgngcnnnnnnnnnnnnnnnncnnnnnn

SEQ ID NO: 241391 - DNA, 574 bp, Homo sapiens
  misc_feature: GYAE6OF02IAO04.35.27.C05.1.454.CMB.1.raw
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
  modified_base (553)..(553): a, c, t, g, unknown or other
  misc_feature (553)..(553): n is a, c, g, or t
  modified_base (557)..(574): a, c, t, g, unknown or other
  misc_feature (557)..(574): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccgttcaccatctccagagacaattccaagaacacactgaatctgcaaaatgaacagcctgagagccgaggaccacggtccgtataattactgtgcgaaaagcatatcgacgtattacatgcttcgagacttaaatganctttgactatgggccaggaaccctggtccaccgtcgttccacgacnccgtaccaccgaacgggcccagtccggtccttacccccgtggccctacccctcctacccaagacgtacccacccgttcgtacgggggccaacgaacggccggccccgtgggccgtcgccgttcggtaccgaacggtacttaacgtccaacggtaactcgtaccgtacgtgaacggccggacgtcgggaccgaaaggtccgaaccgttagagncagnnnnnnnnnnnnnnnnnn

SEQ ID NO: 241392 - DNA, 711 bp, Homo sapiens
  misc_feature: GYAE6OF02GHWLK.35.27.C05.1.454.CMB.1.raw
  modified_base (237)..(237): a, c, t, g, unknown or other
  misc_feature (237)..(237): n is a, c, g, or t
tcagtacagatcgtcacgaccggtgctcgatttagacgcgatcgaaggggtttggggggggggtctcaggaggcagcgctctcgggacgtctccaccatggcctgggctctgctattcctcaccctcctcactcagggcacagggtcctgggcccagtctgccctgactcacgcctgcctccgtgtcgtgggtcctccgtggactagtcgatcaccatcctccgtgcactggaaccngcgagtgtacggttggtcgctagaactaactatgtaccgtcgtaggtaaccaaccgaccacccgaggaccaaaccgacccccaacgtacagttacgtaatttagagtactgtaacgtaagtaaccgtccggtaccccgttacggttaacgggtttactaacgtccgtactttctcgtcggtcctacctaacggtcgtacggacaaccgaccgtcccctaccgacgtacctactcctcgtcggtctccgagtcgtacgacgacgtcggtactagttattacgtacgtcgtacagtacctacgaactaaccgaaccgaaccgacgaccgtaacctccgaaaccgttcgttaccggttcggttaccggggcggaaccggtacggtaacccgtaccgttaaccggtacccgttaccggttaacgtaccgaccccggtaaccgtacccggtacccgtccccggtacccccggtacccgg

SEQ ID NO: 241393 - DNA, 693 bp, Homo sapiens
  misc_feature: GYAE6OF02IN0A0.35.27.C05.1.454.CMB.1.raw
  modified_base (159)..(159): a, c, t, g, unknown or other
  misc_feature (159)..(159): n is a, c, g, or t
  modified_base (272)..(272): a, c, t, g, unknown or other
  misc_feature (272)..(272): n is a, c, g, or t
tcagtacagatcgtcacgaccggtgctcgatttagacgcgatcgaagggtttggggggggggtcacaagaggcagcgctctcgggacgtctccaccatggcctgggctctgctgctcctcactctcctcactcaggacacagggtcctgggcacagtcngccctgactcagcctgcctccgtgtctgggtctcctggacagtcgatcacatctcctgcactggaaccagcagcgatggttggggttatgaccttgtctcctggtactcaacngcaccgaggaccaaaacgcccccaaactcttaatttaactaaaggaaccacgtaaacgcgaacccctagaagggtacttttacaaacgttcgtaccttctcgtacggtcctaccgtaaacggttctcggactaaccgtccggtacccttcccctaggtaacctaacttcctcggttcggggtacccgtaccggggtccgttacggaacgggacgaacggttccgttaaggtattttaagtttagtttaagtttcggtactttaccgtaagttagtcgtacgtaagggttacgtacgacttaacttaacgttcgtaccgtttacgggaacgttacggaacgaacgggttacctaaccggttaccgtacggtacctacggacccgaacggtacccaacccctgtacggttacctacttacccg

SEQ ID NO: 241394 - DNA, 594 bp, Homo sapiens
  misc_feature: GYAE6OF02HUI8O.35.27.C05.1.454.CMB.1.raw
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (326)..(326): a, c, t, g, unknown or other
  misc_feature (326)..(326): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (449)..(449): a, c, t, g, unknown or other
  misc_feature (449)..(449): n is a, c, g, or t
  modified_base (478)..(478): a, c, t, g, unknown or other
  misc_feature (478)..(478): n is a, c, g, or t
tcagtacagatcgtcacgaccggtgctcgatttagacgcgatcgaagggtttgggggggggtctcgaggaggcagcgctctcgggacgtctccaccatggcctgggctctgctattcctcaccctctcactcagggcacgtagggtcctggggacccaggtctcgccctgactcggcctgccctcgtgtctgggtcctccgtggacagtgactcaccagtcctcctgctacnggaaccagctaggtgacgtttggnctagactaactntcgtctctcggtacaacaccacccaggacaaaaccgcccctaaatccatgtactttangatcgtacagtaatcggcctcgtagggttctaatcgcttntcngtctcagtctgctaacgcgctccagacactcgtncggctacgcggtcngacggagacgtctcggtattaacgttcgtacncgcgtactccaattaccgaaacgaacccncgtacacgtactcgttccgtcggtcggttaccgggacggacgggacacgtccggttacgacggtaccgtacggtaccgaccggacccgtacgtcccgtcccggtcccgtacggtcc

SEQ ID NO: 241395 - DNA, 718 bp, Homo sapiens
  misc_feature: GYAE6OF02J3D0G.35.27.C05.1.454.CMB.1.raw
  modified_base (225)..(225): a, c, t, g, unknown or other
  misc_feature (225)..(225): n is a, c, g, or t
  modified_base (256)..(256): a, c, t, g, unknown or other
  misc_feature (256)..(256): n is a, c, g, or t
  modified_base (367)..(367): a, c, t, g, unknown or other
  misc_feature (367)..(367): n is a, c, g, or t
  modified_base (483)..(483): a, c, t, g, unknown or other
  misc_feature (483)..(483): n is a, c, g, or t
  modified_base (550)..(550): a, c, t, g, unknown or other
  misc_feature (550)..(550): n is a, c, g, or t
  modified_base (560)..(560): a, c, t, g, unknown or other
  misc_feature (560)..(560): n is a, c, g, or t
  modified_base (567)..(567): a, c, t, g, unknown or other
  misc_feature (567)..(567): n is a, c, g, or t
  modified_base (587)..(587): a, c, t, g, unknown or other
  misc_feature (587)..(587): n is a, c, g, or t
tcagtacagatcgtcacgaccggtgctcgatttagacgcgatcgaagggtttggggggggtctcaggagcagcgctctcgggacgtcctccaccatcggcctgggctcgtgcctacttcctccacccttccgtcactcgacggctaccgacgggtcctcgggcctagtcctcgcctgactcacgcctcgcctcgtgtaccgtcggtctcgtggactacggtcacncacctcgtcctcgtcgaccgtacgacgaccncgtacgtacgttcgtgttcggtacacctaaggtacctacgttcgtaccgtaccgtacggtacccaaacccaccaccccggaataaccggaacctaacccgacttatacgtnttaggtacttagtcagtacgcgttaccgtaccgtcgttacggtacttccgtactcgccgttactccgtcgaacgcctacgtacgacggtaccacgttcccgacgttccaacgggtntaaccgtgtcccgtaacggtccgttacgcggtacgacggtaccgtacgtacgtacttcgtacgttancgttacaacnccgtaanacctacgaacctacggtacncgtaccgtccgtagtccggtttaagccgggttaggtacccgtaggacccgtcggtaacccgtgtaaccggtacccaacggtaccgacggtacctcccgaaccggtccctaacccggtcgtaccgttacccg

SEQ ID NO: 241396 - DNA, 673 bp, Homo sapiens
  misc_feature: GYAE6OF02IZ883.35.27.C05.1.454.CMB.1.raw
  modified_base (199)..(199): a, c, t, g, unknown or other
  misc_feature (199)..(199): n is a, c, g, or t
  modified_base (242)..(242): a, c, t, g, unknown or other
  misc_feature (242)..(242): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccagcagtgacgttggngctgataactatgtctctgataccaacaccacccgagaccaaacgcccccaaactcatcgtatttatgattgtactagtaactccggcccttcgtacggggtttactaacgtcgtctttcgtactcggtcctaccaagttcgtcggacctaacgaccggtcccttacccgtacgacctacgttccgtacgtcggtcctaccgtacggtcgtacggaacggtacgacgggtaccttagttaactttacttaacgtcgtaccgacgtacttacctaagtaaccctaaccaaccgtacgaccgtacgtacctaccgttcgttacggttacggtacggggaccgggtaagggtaaccctaaccggtccgtaaccggtacccggttacgtacggtaccgacccggacccgtacgggtcccgtccccggtcccccgg

SEQ ID NO: 241397 - DNA, 782 bp, Homo sapiens
  misc_feature: GYAE6OF02H70F8.35.27.C05.1.454.CMB.1.raw
  modified_base (197)..(197): a, c, t, g, unknown or other
  misc_feature (197)..(197): n is a, c, g, or t
  modified_base (627)..(627): a, c, t, g, unknown or other
  misc_feature (627)..(627): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaaccatggagtttgggctgagctggtctttttctgtgctaatttaaaggtgtcagtgtgagtgcngctgttggagtcgtggggagtcttggtacaggccggtgggggtccctggacgtactctccgtgtacgactcctcgtaggtacttccgaaccgtttaggaacttagtcgcctaagtcgtcggtccgtcgggtaccccgtccgacgggtccctaccgggaagggggtaacgggggtccgtaggggtacgggttcggggttccttaccggttaaggttttaacgttagggttacgggttaaggttcgggttagtaacgtttaacttaaagtaaccgtaaccgttacgaaccgtaacgtaccgttaccgggtagggaacccggggttacccggtttacccaaccgtacgttacccgtacccgaacggaaagtaacctaaaccgttaccaaaacgtaacccacctaacgtacgtaactacgtagaaaccgtaaanaccgaaaccgtacgtccgtaagacggaaccggtccggaaggttacccgaacggtacccgttaaatttacgttacgtacggtcgaaacgtaagtaaccttacgttacgtaccgtaacgttaattacctagttccgtacgtttacggaacttaaacg

SEQ ID NO: 241398 - DNA, 675 bp, Homo sapiens
  misc_feature: GYAE6OF02JHEWA.35.27.C05.1.454.CMB.1.raw
  modified_base (243)..(243): a, c, t, g, unknown or other
  misc_feature (243)..(243): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtnctgataactatgtctcctggtaccaacaccaccaggcaaacgccccaaactcatagtatttatcgatgtacaagttaactccggtcccgtcgtacggggtttactaatccgtcttcgtcgtcggtcctaccgtaacgtcgttcggacaaccgaccggtccctcccgtacgacctactcgtcgtacgggcctaccgacggcgtacgacggacgacggtcgtagtacttacgttactcgacgcgtactcgtaactactaaccaaccgtacgccgacgtacctaccgttacgttccggttcggttaccgggacgggtaaccgggtacccgtaacgggtccgtaacggtacccccggtttaaccgttaccgggttaccgaacccggtaccccggtaaccgggtccccgttaccccgggtccccccgtttacccggg

SEQ ID NO: 241399 - DNA, 627 bp, Homo sapiens
  misc_feature: GYAE6OF02I1W00.35.27.C05.1.454.CMB.1.raw
tcagtacagatcgtcacgaccggtgctcgatttagacgcgatcgaagggtttggggagctctgagagaggagcccagccctgggattttcaggtgttttcatttggtgatcaggactgaacagagagaactcacatggagtttgggctgagctggtctttttcttgtggcttattttaaaaggtgtccagtgtgaggtgcagctgttggagtcgtggggggaggcgttggtacaggccgtggggggtccctggacgacgtctccgtgtgaacgtcctcgtggtacttaccgtaccttttaggaaacctagtcgaccctattgtgcgttcgggtcccgccgagggcctccggaggggaacggggctgggaggtgggtctcgtaggtttagttaggtgggtagtggtagtatactatacacgtcgacaagtactccggtaggaacgggtcccgtttacacctactcctaccgagacgaactaacttaccaagaacaccactataactctacgactaaatcgaaacacgtccgtagacgacgacggacgacgacgacgtatactatgtagacgaaacgtacattacgtacgtacgttacttacgtactacgtacgttacggaagttaacg

SEQ ID NO: 241400 - DNA, 694 bp, Homo sapiens
  misc_feature: GYAE6OF02IB7FN.35.27.C05.1.454.CMB.1.raw
  modified_base (241)..(241): a, c, t, g, unknown or other
  misc_feature (241)..(241): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcaggcacagggtcctgggcccagtctgccctgactcagcctgcctccgtgtctggtctcgtgacagtcatcacatctcctgccactaggaaccagctagtggacgttggngactagaataactatgtctaccgtagtaccaacacccaccaggacaaacgccccaaactcatgtaatttacagatgtctagtaactccgcctacgtacgggtttactacgtcgtacttctcgtgtaccaccgtaacgtcgtacggacaccgtaaccgtccctaccgtacgacctactccgtcgtacggtccctaccgagcttacggaaccgacggtaggtaccgttagttaactttaccgttacgtacggtacctaacgtacccttaacgtaacgtttaaaccgaaaccttaaaccgacggaacccgtacgtaacccgtacccttaacggttccgggttaacggggtccccggttaaggggaaccggtaccggaaaggtccgtaccggtacccggttactaccgggtacacccggacccgttaacggcccgttaccccgtcccgttaacccgg

SEQ ID NO: 241401 - DNA, 687 bp, Homo sapiens
  misc_feature: GYAE6OF02JN1CV.35.27.C05.1.454.CMB.1.raw
  modified_base (655)..(655): a, c, t, g, unknown or other
  misc_feature (655)..(655): n is a, c, g, or t
  modified_base (661)..(662): a, c, t, g, unknown or other
  misc_feature (661)..(662): n is a, c, g, or t
  modified_base (666)..(666): a, c, t, g, unknown or other
  misc_feature (666)..(666): n is a, c, g, or t
  modified_base (675)..(675): a, c, t, g, unknown or other
  misc_feature (675)..(675): n is a, c, g, or t
  modified_base (677)..(678): a, c, t, g, unknown or other
  misc_feature (677)..(678): n is a, c, g, or t
  modified_base (680)..(680): a, c, t, g, unknown or other
  misc_feature (680)..(680): n is a, c, g, or t
  modified_base (682)..(687): a, c, t, g, unknown or other
  misc_feature (682)..(687): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacacactgaatctgacaaatgaaacagcctgagagccgaggacacggccgtatattactgtgaccgaaaagcatatcgcgtattactaatgcttcggagtacttaaagttgagtctttagacgtacgtcggggaccaacgggaacccgtggtaccaccggtactccctacgtacgccctaccgaccgaaccgggaccctacgtacccggttccctttacccccgtcggtaccctaaccccgttccctacccgtaaacgacgtaccctaacccgttccggtaccggggggtacctaacccggtaccgggtaaccccgggtcccggtcgggggtcccgtccggtacccggttcgggtacccggtaaaccgggtaccgtttaccctaccggtaaccgtacttccgtacggttaacctcggaacggtcgggtccgttacggaccggtaacggtccgacgtaaccgttagcncgtacnncgtnacgcgtgcncnngncnnnnnn

SEQ ID NO: 241402 - DNA, 647 bp, Homo sapiens
  misc_feature: GYAE6OF02FR05E.35.27.C05.1.454.CMB.1.raw
  modified_base (215)..(215): a, c, t, g, unknown or other
  misc_feature (215)..(215): n is a, c, g, or t
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (301)..(301): a, c, t, g, unknown or other
  misc_feature (301)..(301): n is a, c, g, or t
tcagtacagatcgtcacgaccggtgctcgatttagacgcgatcgaagggtttggggggggggtctcaaggaggcagcgctctcgggacgtctccaccatggccctgggctctgctattcctcaccctcctcactcgagggcacagggtcctgggcccagtcctgcccctgacctcagcctgcctcgtgtcgtgggtctctggacagtcgatcacntcctctgcagtcggacngcagtgacgttgnctnatactntgtctcgtacgaccaacacccaccgacgacaaccgacccctaaactnagtgtattagtgatcgtactagtacgtcgtccgtacgtacggttactagtcgtcttctcgtaggtcctacgacgtcgtacgactaccgaccggtcccttccgtcgtaacctactcgtacggtcgtccgtacgcggtcgacgaaccgacggacggtctagttattacgtacgttagaccgtacgtctacggttaactaacgttaccgaaacgtacgaccgtacgtaccttacgtccgtaggttcgggttaccgggacgggtaaccgacgtaaccgtcggtaccggtacccgttacggtacggttaccggacctaacccgtacggtcccgcccggttacccgtacccg

SEQ ID NO: 241403 - DNA, 755 bp, Homo sapiens
  misc_feature: GYAE6OF02GKBWX.35.27.C05.1.454.CMB.1.raw
  modified_base (224)..(224): a, c, t, g, unknown or other
  misc_feature (224)..(224): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagctggcttttctgtggctattttaaagtgtcagtgtgaggtgcagctgtcggagtcgtggggagcttggtacnggccgtgggggtccctggagagtctccgtgtgcagcctgtggatcaccgttgagtagctagtggctagtgagcgtgggtcccgccgaggcctaccggacggggtaccggggcgtgggacggttcgggttacttctttacgtagtttaggtcggtacgtttagggtcggtcggttacgtacaccgtattaccgtacgacgtaagtaccgttcgttcgggacggtaaccggggtcccggtttaccgaaccccggttcctacccggaagtaccggaaccttaaaccgttacccgaaaacgttaacccgtaccccgttagttaactcccgttacgaacgtaaaacttccgaaacccgtacggtacccgtagggtaacggaacccgacccgggtaaaccgtaaccgacccggttaccgttaacgttacgtttaaccggtggttaacggtaaaccggtaaaagtttccggggaaaccgttaacggggttagggggtaaaccgttcggttaacccgttttcggaaccgttttcccggg

SEQ ID NO: 241404 - DNA, 719 bp, Homo sapiens
  misc_feature: GYAE6OF02GE7UO.35.27.C05.1.454.CMB.1.raw
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
tcagtacagatcgtcacgaccggtgctcgatttagacgcgatcgaagggtttggggggggggtctcaggaggcagcgctctcgggacgtctccacatggcctgggctctgctattcctcaccctcctcactcagggcacagggtcctgggcccagtctgccctgactcagcctgccctccgtgtctgggtctcctggacagtcgatccaccatcctcctgccacgtcggaaacccagcctaaggtcgtacggtttgggtgaccgttgaacttaaactattcgttccttccgtaggtaaccaaccacccacccgaaggaccaaaccgaccccccaaatcaatacgtatttancgtatgtcaagttacnccggtccgtacggtacgggtttactaacgtcgtactttctcgtacggtcctaccgtaagtctacggactaacgcccgtccctccgttacgacccttatccgttacgtccgggaccttacccgaggtaccgtacggtaccgaacggacgtcgtaacttacgtttaacgttacgttacgacttacgccttactaactaacgttaaccgaaccatacggacctacgtaccgttacgttcgtacgggttcgggaccgggacggtaaccgtaacggtccgtacggtaacccggttaccggacgggttaccgaaccggaccggtaacggtcccttaccccgggcccccgtttaaccgg

SEQ ID NO: 241405 - DNA, 803 bp, Homo sapiens
  misc_feature: GYAE6OF02ISHS8.35.27.C05.1.454.CMB.1.raw
  modified_base (243)..(243): a, c, t, g, unknown or other
  misc_feature (243)..(243): n is a, c, g, or t
tcagtacagatcgtcacgaccggtgctcgatttagacgcgatcgaagggtttggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcagtgacgttggtnctgactaactatcgtctcctggtaccaacaccacccaggaccaaacgcccccaaatcatgatttagtgtatcgtacgagtaacgtcggccctagtacgggttctaagtcgtacttcttccgtgtcctccgtaagttcgtacgggaccaaaccgaccgggacccttacccgtacgaacccgtacttccgtcggtaccgggaccttcccgacgggtctacggtaccggacggaggtacccgttagtaacgtttaaacttcgtacggtacctaacgtccgtaacgtaactaacgtaaacccgtaaaccgacggaaccgtaacgtacccgttaaccgttacccggtttaccgggtttaccggggtttacccgggggaccggggtaaccggggggtaaaacccccgaaacggggtttaccccgttaacccgggggttaaccccccggtttaaccccgggggttttaaaccgggtaaaccccggttaaccgggttaaccccccgggaaaaccggggtttccccccgggtaccccccgggtttacccccccgtttaacccccggggg

SEQ ID NO: 241406 - DNA, 664 bp, Homo sapiens
  misc_feature: GYAE6OF02H4ODU.35.27.C05.1.454.CMB.1.raw
  modified_base (486)..(486): a, c, t, g, unknown or other
  misc_feature (486)..(486): n is a, c, g, or t
  modified_base (505)..(505): a, c, t, g, unknown or other
  misc_feature (505)..(505): n is a, c, g, or t
  modified_base (520)..(520): a, c, t, g, unknown or other
  misc_feature (520)..(520): n is a, c, g, or t
  modified_base (559)..(559): a, c, t, g, unknown or other
  misc_feature (559)..(559): n is a, c, g, or t
tcagtacagatcgtcacgaccggtgctcgatttagacgcgatcgaagggtttgggggagagaggagcccagccctgggattttcaggtgttttcatttggtgatcaggactgaacagagagaactcaccatggagtttgggctgagctggtcttttttcttgtggcttaagtttttaaaaggtgtccagtgtgaggtgcagctggttggagtcgtgggggaggtcgttggtacagccggtcgggggggtccctggagacctctcctaggtagacgtcctcgtggtacttcctaccgttttaaggaacttagtacgccatgtgtccgtggggtcccgccgaggcctaccggaaggggaggggcgtgggaggttcgggtctacgtagtttacgtttaggtggttagtggtagtatactataccactacgcacgactccggtaggacggtccgttaccactactcctacgagacactaactaccgaaanaacacacgtgaacttccgnaaacaaatcgaaacncgtcgagagacgccggaacgaccgaccggtactaacttntacggtgtaacgaacgaaactacgtaattaccgtcgtaccgttaatttaaccgtagttccgttaacgttccgggtaaattaaacgtttaagttcggtatttaccg

SEQ ID NO: 241407 - DNA, 609 bp, Homo sapiens
  misc_feature: GYAE6OF02GI25K.35.27.C05.1.454.CMB.1.raw
  modified_base (230)..(230): a, c, t, g, unknown or other
  misc_feature (230)..(230): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
tcagtacagatcgtcacgaccggtgctcgatttagacgcgatcgaagggtttggggagctctgagagaggagcccagccctgggattttcaggtgttttcatttggtgatcaggactgaacagagagaactcaccatggagtttgggctgagcggtgtcgttctaggtcggctaatttaaaggtgtcagtgtgaggtgcagctgttggagtgtgggggagtcttggtacncggtccggtcgggggtcctagacgtctccttcgtagtacgacgtcctcgtgtattctacttacgaactancgacntgtgtcgtcggtccgcgcggtcgtacggagggagggcgtggtcggtcggtctcgtagttagtagtggtggtgtgtatatactactacgtacgacactacgtacgacggtacggtccggtacctacgtactctacgacgagacacgtacaacaacactactatactactacgactaagtaactacacgacgtagacgacgacggacggacgacgtacgtaagttagtagtacggtacgacgtaacgtaactacgtacgttacgtacgttacgttacgttacgtacgtacgttacggttagtaacg

SEQ ID NO: 241408 - DNA, 747 bp, Homo sapiens
  misc_feature: GYAE6OF02I7SXT.35.27.C05.1.454.CMB.1.raw
  modified_base (243)..(243): a, c, t, g, unknown or other
  misc_feature (243)..(243): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgacctccgtgtctgggtcctcctggacagtcatcacatctcctgcactggaaccagcagtgtacgttggnactgaataactatgtctcgtgtacaacaccaccagcaaacgccccaaactcatgattangatncaagtactccggccctggtagggtttctaagtcgtcttcgttctggtcctaccgaacgttcgtacggacctaaccgtcccggtaccctacccgtacgtacctaaacgttccgttccggttcggggacccgttcccggggtaccgttgggaacgggtaccggaacgggtcttaacggtaactttactttaaccgtacgtaccgtacgtaccttacgaacgttaaccgtaaccaaaccgtacgacctaaccggtcctaaccgtttccggttaccggttaccgggttaccggggtaaccgggggtaccgtaacccggtaacgttacccgggttacccggtaacccgggtttacccgtaacggggtttaccccaaaccggggtacccccggtaaacgggttaccccgttaacccccgggtccccccggttaccgggttaaccccc

SEQ ID NO: 241409 - DNA, 764 bp, Homo sapiens
  misc_feature: GYAE6OF02G4UK1.35.27.C05.1.454.CMB.1.raw
  modified_base (172)..(172): a, c, t, g, unknown or other
  misc_feature (172)..(172): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (631)..(631): a, c, t, g, unknown or other
  misc_feature (631)..(631): n is a, c, g, or t
tcagtacagatcgtcacgaccggtgctcgatttagacgcgatcgaagggtttggggggggggtctcaggaggcagcgctctcgggacgtctccaccagtggcctgggctctgctattcctcaccctcctcactcagggcacgagggtcctgggcccagtctgccctgactcngcctgcctccggtgtcgtggtctccgtggacacggtcactccacctatccgtcctgacctacgtaggaacccagccgtaaggttcgtaacggttggtcncgtagaacttaaactntcgttccgtcgtaacggtaaccccaaacgtacccaaccgaacggaccaaaacccgacccctaaatcgtaacgtgttaatttagagttacgtcgtacgtaacggttactccgggtccttacggggtttaacggtttactaacggttccgttcttacgttacgtacggtaccctacgttaggtcgtacgaaccgtaccgtacccggtacccctaccggaccgttaacgtcgttaccggtacggtcgggtaccctacgggcgtaacgttaccggacggtacgaagggtttctaaggttactttaaacgtcgaccgtgacttaccgtaataacctaacaacgacgtanacacgtaccgtacgttcgacgggttagggtccggaacgggttacaaccggtaaccgtccgggtaaccgtccggttaaacggttaccccgacggtaccggtaacccgccggtaccctacccggtccccgtaccg

SEQ ID NO: 241410 - DNA, 721 bp, Homo sapiens
  misc_feature: GYAE6OF02J15N6.35.27.C05.1.454.CMB.1.raw
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggccagtctgccctgactcagcctgcctcgtgtctgggtctcctggacagtcgatcaccatctcctgcactggaccngcagtgacgttggnctgatactatgtctcctggtaccacaccaccaggaccaacgacccccaatcgtatgtattttactagagtacgtctaagtaacgtccggccctcgtaacggggttttactaacgtcgtctttcgtacgtcggtaccttccgaaggtcctagggaccctaaacgtaccgggtaccctcccgtaggtaccctaacgtccgttacgtacgggtccttccgaacggtacccgttagggaacccgacgggtaccggtccgtaacggttacttaacgtttaccgacggtacctaacgtccgttaccaagtttaaccaccgttaaaccgacggtaccgtaccgggaccttaaccgttcgttccgggtttacgggttaccgggaccgggtacgggaacccgtaacggtcgttaacccgggaaccgttcccgtaaggttacccggacgaccccggttacggaccccgttaccgggtacccccttaaccggg

SEQ ID NO: 241411 - DNA, 825 bp, Homo sapiens
  misc_feature: GYAE6OF02JAQDK.35.27.C05.1.454.CMB.1.raw
  modified_base (126)..(126): a, c, t, g, unknown or other
  misc_feature (126)..(126): n is a, c, g, or t
  modified_base (657)..(657): a, c, t, g, unknown or other
  misc_feature (657)..(657): n is a, c, g, or t
  modified_base (674)..(674): a, c, t, g, unknown or other
  misc_feature (674)..(674): n is a, c, g, or t
tcagtacagatcgtcacgaccggtgctcgattttagacgcgatcgaagggtttgggggggggtctcaggaggcagcgctctcgggacgtctccaccatggcctggctctgctattcctcaccctcncactcaggcacgagggtcctgggcccaggtctgcccttgactcagcctgcctcgtgtcgttggcctactggacctaggttccacgtaccaacctacttccgtccgtggaccgtacgttccggaaacctagaccgttaaggttaccgggttaggttcgggttcaccgttaagtaacgttaaaccttaactttccggttaacttaccgtacgttaaccggttaaccccctaaacccgaaccccgacccggttaaccggaaacccgaaaacccccggtaaccccctaaaacgttacctaaccggttaacgttaattttaccgtagtaacggttacgtacggtaaacgttaacgtcccggtaccgttacggttaacggggtttacctaacgtttaccgtaccgtttcgtcctttaccgggtaccttaccgaccgttacggtaccgaacctaaccggaaccccgttcccgttaacctacgacccttacgtccgtccgtcggtacccgcgtacgcggtaccgaacgtacggtacgtnacgttaacttacgtacngtacctcggactactaactacgtaacgaaccactacgacctctacccgttgtaccgttcggaccggtacggaccggtaacgacgtacgtaacccggttaccgtaccgttacggtacccgaaccgtaccgtacgcccgtaccggtacccccg

SEQ ID NO: 241412 - DNA, 669 bp, Homo sapiens
  misc_feature: GYAE6OF02HPAI6.35.27.C05.1.454.CMB.1.raw
tcagtacagatcgtcacgaccggtgctcgatttagacgcgatcgaagggtttggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggacaaacgcccccaaactcaatgatttatggatgtacagtaatccggcctgtacgggtttactaatcgtacttcctcgtaggtcctccgaaagttctaggacaacgaccgccctccctagacctagttcctcgtacgggcctaccgaacgggtcttacggaaccggaacggtacgggccttagttaacgtttaacttacgtggacctacgtccttacgaacgttaactaacctaacccgagacctaacggtacccttaaccgttcgtttacccgggtagtttcccgggggacgggtaacgggaacccgtaacgggtccgtaacggtacccgttaccgtacggttaccaccggacccggaacggtcccgtcccggtacccccttaccggg

SEQ ID NO: 241413 - DNA, 600 bp, Homo sapiens
  misc_feature: GYAE6OF02HFMTC.35.27.C05.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
  modified_base (470)..(470): a, c, t, g, unknown or other
  misc_feature (470)..(470): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctcgggcccagtctgccctgactcagcctgcctccgtgtctgggtctcctggacngtcgatcaccatctcctgcactggaaccngcagtgacgttgngctgataactatgtctctgtaccaacaccaccaggacaaacgaccccaaatcatgtatttangatgtacagtaactccggtacctcgtacggggtttctaactcgtcttctcgtcgtctcaagtcgtcggacaaccgcgtccctcccgtacgacctactcgtcgtcgggcctcgtacggcgtacggacgacggacggtctagtaactttactcgtcgacacgtacctntataacaacgagcacgcaacgccgtcttacgtcgtcggttacgggacgggtaccggacgtaaccggtctaccggtaccgtaccggtacggtccgaccgtacccggtacggtcccgtacccggtcccccgg

SEQ ID NO: 241414 - DNA, 880 bp, Homo sapiens
  misc_feature: GYAE6OF02FJ7X3.35.27.C05.1.454.CMB.1.raw
tcagtacagatcgtcacgaccggtgctcgatttagacgcgatcgaagggtttggggggggggtctcaggaggcagcgctctcgggacgtctccaccatggcctgggctctgctattcctcaccctcctcactcagggcacgagggtcctgggcccagtctgccctgacctcagcctgtccctccgtgtcgtgggtctccgtggacagtccgatccacactcctccgtgcctacgtcggaaccagctagtcggtacgttgggtcgcttagtaactaaccgttatgtaccgtccgttacggtaacccaaaccgaaccccgaaccccgaacgggaacccaaaacccgtacccccccgtaaaactctaaacgttacggttaaacttttaagtacgtacgtaacgttacgttaaacggttaaccggttccccggtacccgtttaacgggttacggggttttacctaaaggtttcccgttacctttccgtcgttaccggtaccttaccgttaacgtccgtacggtaaccgaaccacccggtcccttacccgtacgtacccgtactccggttacggtccgggtcccgtacgggtacggtccgtaacggaccgggtaacgggtacggtaccggttacttaacgtttaaccgttacggtcgactaccgtacctttaccgtaattaaccggtaaccgtaaccgaccggtaacgtaccgtaccttaaccggttccgttaaccgggttccgggtttaaccggggacccggggtaaacgggtacccgtaaggttacccggtaaccgggttaacccgttaccggtaaccggttacccggaaccccggtacgggtacccctaccccggtaccccggtttacccccgttaacccgg

SEQ ID NO: 241415 - DNA, 562 bp, Homo sapiens
  misc_feature: GYAE6OF02H26HX.35.27.C05.1.454.CMB.1.raw
  modified_base (242)..(242): a, c, t, g, unknown or other
  misc_feature (242)..(242): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (358)..(358): a, c, t, g, unknown or other
  misc_feature (358)..(358): n is a, c, g, or t
  modified_base (427)..(427): a, c, t, g, unknown or other
  misc_feature (427)..(427): n is a, c, g, or t
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
tcagtacagatcgtcacgaccggtgctcgatttagacgcgatcgaagggtttggggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctcctgcactggaaccagcagtgacgttggngctgataactatgtctcctgtaccaacaccaccgagaccaaacgacccccaaatcatntatttangtatgtacagtaactccggtcctgttagggtttacagtcgtactttcgtcncgtcctacgagtcctggaccaacgccggtccctcccgtacgacctactccgtcgtcggcctcgagtcgngacgacggagtctagttattacttctgctagctacatacaaccacngaccagcncgtcgttcggtgtccggacggaggaccgagtccgcggtaccgtccgagtaccgacggccgacggccgtcccgccccgtacg

SEQ ID NO: 241416 - DNA, 722 bp, Homo sapiens
  misc_feature: GYAE6OF02GBC2K.35.27.C05.1.454.CMB.1.raw
  modified_base (536)..(536): a, c, t, g, unknown or other
  misc_feature (536)..(536): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctccgtcactcagggcacagggtcctgggcccagtctgccctgacctcacgcctgcctccgtgtctggtctcctggacagtcgatcaccatcgtcctgctacgtggaaccagcagtcgacgttggtgctgaacttactatcgtcctcgtacgtaccaacgaccaccgaggaccaaaccgacccccaaactcgtatcgtatttactggactgtacaacgtaactccggtcccttacggtacgggtttacctaacgtccgttcgttcgtcgtcggtaccttaccgtaagtccgtacgggacctaaaccgtcccggtcccctacccggtacgtaaccctacttccgttccggtaccggtccctaccggacggtcctaacggaccgtacgggacgttcgtagttaactttacttacgngaccgtacgtctaacgtacttaaccgaaccctaacgacgtacctacgtacccttaccgttcggttcggttaccgggtaccgggcgggaacggtaaccggtaacggtccgtaccgggtaacccgttccggttaaccggaccgtacccggaacccgtaccggtccctccccggttcccccgtaaccgg

SEQ ID NO: 241417 - DNA, 700 bp, Homo sapiens
  misc_feature: GYAE6OF02JPF9U.35.27.C05.1.454.CMB.1.raw
  modified_base (482)..(482): a, c, t, g, unknown or other
  misc_feature (482)..(482): n is a, c, g, or t
  modified_base (543)..(543): a, c, t, g, unknown or other
  misc_feature (543)..(543): n is a, c, g, or t
tcagtacagatcgtcacgaccggtgctcgatttagacgcgatcgaagggtttggggagctctgagagaggagcccagcccctgggattttcaggtgttttcatttggtgatcaggactgaacagagagaactcaccatggagtttggctgagctggcttttctgtggctagtttaaaaggtgtccagtgtgaggtgcgagcgtggttggaggtcgtgggggaggtcttgggtacacggtccggtggggggtccctggacgtactccgtctcggtagaacgcccgtacgtggtacttccgtaaccgtttacggaaacttacgttcgccctaaagttcggttcggccgttacggggtccccgtacccggtacggtacccgtacccgtagggggaaacggggtcgtagggtaaggttcgggtctacgtaacggttagtttaaggtgggttacgtggtacgtagtactagtactcgtagacgtacncgtcgtggaacggtccgtagaccacgtctaccgaagtgaacctagttaccaaacgaaaccncgtaaacgttcaagtccgtcaacctaaataggacctaaacgcgttaagacgtaacgccgaagtaccgacggtcctaaattaccgtacgtgacggaacctaaagcaagttaccgcggtaacctacgtttataaccggtctaaccgttagacgtaaacc

SEQ ID NO: 241418 - DNA, 812 bp, Homo sapiens
  misc_feature: GYAE6OF02HZMMZ.35.27.C05.1.454.CMB.1.raw
tcagtacagatcgtcacgaccggtgctcgatttagacgcgatcgaagggtttgggggggggtctcaggaggcagcgctctcgggacgtctccaccatggcctgggctctgctattcctcaccctctcactcagggcacgagggtcctagggcccagtctgccctgactcgagctgcctccggttgtccgttcgggtcctccgtgggaccaggtcgactccacctatcctctgacacgtcggaaccaggcagtcggacgtttgggctcgtggaaacttaacgtcttcgttcgtccgtacggtaaccaaccgaccctaaccggaacggtaccaaacccgacccctaaaacgtccgtaacgtaagttagtttaacgtagtacttacgtaaccgtaacgttaccggttacccgacccgttacgggttaaccgggtttactaaccggtaccgttaccttacggtcccgttacgggaacctttaccggtaccggtttccgtaaccgggtaaccaccgtaccccgggttcctaaccccgtagtaacccgtacgttcccgtacggtccgggcccttaaccgggtggtacccgttacggaccggtaacgggtaccgggtacgttagtaacgtttacgtttagacggttacgtaccgttaccgtacggtacttaaacgtaaaccgacccgaagtccgaaccgttcctaacgttcccggtacggttccgggtaccgaccgggaacggtaccggaaccggttcgaccggtaccgttacgaaccggttccgaccgtaccgaaccgtcgtcccggtccggttaccg

SEQ ID NO: 241419 - DNA, 689 bp, Homo sapiens
  misc_feature: GYAE6OF02G60YH.35.27.C05.1.454.CMB.1.raw
  modified_base (218)..(218): a, c, t, g, unknown or other
  misc_feature (218)..(218): n is a, c, g, or t
  modified_base (449)..(449): a, c, t, g, unknown or other
  misc_feature (449)..(449): n is a, c, g, or t
  modified_base (654)..(654): a, c, t, g, unknown or other
  misc_feature (654)..(654): n is a, c, g, or t
  modified_base (674)..(674): a, c, t, g, unknown or other
  misc_feature (674)..(674): n is a, c, g, or t
  modified_base (678)..(679): a, c, t, g, unknown or other
  misc_feature (678)..(679): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacacactgaatctgactaaatgaacagccngagagccgaggactaccgggccgttaatattacgtgtgaccgaaaagcattactcgcgttaattactatgtctttacggagtaacttaattggtactcgttttacgaaccttacggtggggacccgaacggggtaaccccgttgggtacccgaccgttccctccttccgacgtcccgtacccgaccgaaccgggccctacgtacccggttccctttccccgtacggacccnccccgttaccctacccgaacgtaccacccacccgtcgggtcggggacccagacggcccggtcccggtgggcccgtcggtcccgttcggtaccgaacggtaccgttaccgtaccctaaccggtactttacgtaccgttacgttacggaccgggtccggtacgtacgggacccggtagggtacccgtcgtaaagtcgtacgcgacgnacgagtcgtgacacgtgcgngagnnatctacgctg

SEQ ID NO: 241420 - DNA, 765 bp, Homo sapiens
  misc_feature: GYAE6OF02G9UKH.35.27.C05.1.454.CMB.1.raw
  modified_base (149)..(149): a, c, t, g, unknown or other
  misc_feature (149)..(149): n is a, c, g, or t
  modified_base (217)..(217): a, c, t, g, unknown or other
  misc_feature (217)..(217): n is a, c, g, or t
tcagtacagatcgtcacgaccggtgctcgatttagacgcgatcgaagggtttgggggggggtctcgaggaggcagcgtctcctcgggacgtctccaccatcggcctggctctgctattcctcaccctcctcactcaggcacgaggtccncgggcccagtctgccctgacctcagcctgcctccgtgtctggtcctcgtggagacgtcgactcgaccntctcctagcactcgaacctgactagtcgtacgttgtcgcgttagaataactactcgtccgttccggtaacggtaacccaacccaaccccgaccgacgggtaacccaaacccgtaaccccccaaattacgtacgtacgttaatttacgtagtaccgttacgtaccgtaacggttaaccgtccggtaacccgttcgggttaacgggtttactaccggttacgtcctttcgtacggtacgttaccgtaccgttaacggtttccgaacggttacctaaacccgggcccgttacccgttacccgtaacgactaccgttccgtacggtcccgtacgtaccggtcggtacgtacggaacgtacgggtacgttacttaggttaactttacgtacgtcgaccgtacgtacctacttaacgtaacccgtaacgtacgacgacgtaccgtacgtaccgttcgtaacggtttcgcgggacggtacgtaacggtcgtccgttacgtacccggtacgtacgccgaccggtcgtaacccggccgtacccggttccgtacccgg

SEQ ID NO: 241421 - DNA, 655 bp, Homo sapiens
  misc_feature: GYAE6OF02JUDRB.35.27.C05.1.454.CMB.1.raw
  modified_base (182)..(182): a, c, t, g, unknown or other
  misc_feature (182)..(182): n is a, c, g, or t
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (523)..(523): a, c, t, g, unknown or other
  misc_feature (523)..(523): n is a, c, g, or t
  modified_base (528)..(528): a, c, t, g, unknown or other
  misc_feature (528)..(528): n is a, c, g, or t
  modified_base (535)..(535): a, c, t, g, unknown or other
  misc_feature (535)..(535): n is a, c, g, or t
tcagtacagatcgtcacgaccggtgctcgatttagacgcgatcgaagggtttgggggggggtctcgaggaggcagcgctctcgggacgtctccaccatggcctgggctctgctattcctcacctcctcactcagggcacagggtcctgggccctagtctgccctgactcacgctgcctcgtntcgtgggttctccgtgcagtcatcacntctccngcacgtcggaaccancagtgacgttcggtgcttagaactatatgtctcctacggtaccaaccacccgaccaggaccaaaaccgaccccctaaactactacgtagttactttatagtagttgtacgaacttacggtaccgtacccgtaggttacgggttttactaagttccgttacttccttcggtacgtccgtacttaacggtcctagggctaaacccgaccgttacccgtccctagtacccgatttccgcgtcggtccctaacgcgtactcgaacgcgtcgggactggtaacctttagcttgaccgntacgntaactanaaccgtacagacgactctaccgttctaacgtcgggtaacggtccgtacgggacctaggtccctagggtaccctccgggtaatccggacgtaacccggccgtctaccccggtccgtcccgg

SEQ ID NO: 241422 - DNA, 873 bp, Homo sapiens
  misc_feature: GYAE6OF02FLT8A.35.27.C05.1.454.CMB.1.raw
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttactaactatcgtctcctggtaccaccaccacccaggaccaaacgaccccccaaactccgatcgtatttatagattagtcaagtaacgtccggtcccttacgtaaggggttttacctaacgtccggtcctttaccgttctcggtcctacccgtaacggttccgtacgggacccgtaaaccgacccggtccccttaccccgtacgtaaccccgtacgttacccgttccgtaccgggggtacccttacccggaacgggtacccgttacgggaacccgggtaacccggtaccgggttacccgttaacggttaaccgttttaaacgtttacccgttaacggtacccgtaacggtacccttaaccgttaacgttaaccgttaaaccgtaacggtacccgtaaccgggtaaccgtaaaccgggtaacccttaaccgttaaccgtttaccgggttaacggggtttacccgggggtaccggggttaaaccggggaacccggttaaccggtaacccggttacccggttaaaccccggttacccggtaaccggttaacccgtaacccgggtaaccccggtaaaccgggttccccggttaacccccgggttaccccccggtttaccgggttaacccccg

SEQ ID NO: 241423 - DNA, 638 bp, Homo sapiens
  misc_feature: GYAE6OF02HHULG.35.27.C05.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (305)..(305): a, c, t, g, unknown or other
  misc_feature (305)..(305): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctctgcactggaaccngcagtgacgttggnctgataactatgtctctcgtaccaacaccaccaggacaaacgccccaactcatgtatttatgntgtacagtaactccggcctcgtagggtttctaagtcgtcttctcgtcggtcttccgtaacgtctaggtaccaaccgtaccggcccttcccgtacgaccctacttccgtaccgtcgggccctccgacggtccgtacggaccggacgaggtccgtagtagtttaacttcgtacgtcagtccttacgaacttacgttaaacgacgactacggacacgtacctacttcggttacgttcgggtaccgggacgggtaccgggtaacctacggtccgtaccggtacccggtacgttaccggtcgaccggtaccccgaaccggtacccctacccgtaaccg

SEQ ID NO: 241424 - DNA, 774 bp, Homo sapiens
  misc_feature: GYAE6OF02G72FW.35.27.C05.1.454.CMB.1.raw
  modified_base (267)..(267): a, c, t, g, unknown or other
  misc_feature (267)..(267): n is a, c, g, or t
tcagtacagatcgtcacgaccggtgctcgatttagacgcgatcgaaggggtttggggggggggtctcaggaggcagcgctctcgggacgtctccaccatggcctgggctctgctattcctcaccctcctcactcagggcacgagggtcctgggcccaggtcctcgccctgacctcagtcctgccctccgtgtctgggtcctccgtggactagtcgatccacctatcctccgtgcacgtacggaaccagctaaggtcgtacggttggngtactagtaacttaacttagttcgttacctccggtacggtaaaccccaaactacccccgaacccgaacgggaaccctaaaacccggacccccctaaaacttacctaacgttacggtaattttacgagtacgttagtaacgtaacgttaccgtcccggtacccgttaggttaacggggtttaccttaacgtcgttccgtttctcgtaccggtactacgtaacgttcgacgaaccgtaccgtaccggtaccctcccgtacgtaccgtacttccggttacgccggttccgtaacggcggttacgagggtaaccggacgggtacgtacgtacgttaaagtttccgtactggtccgacgttacctaccgttaataacctaaacccgacgaacggtacacgttcctacgttcgtacgggttcgtaccggggacgtacggaaccggtcgccgttacgtcccggtaacgttacgccggtaccgtaacgtcccggtcgtacccgtaccccgttcgg

SEQ ID NO: 241425 - DNA, 714 bp, Homo sapiens
  misc_feature: GYAE6OF02IVYBJ.35.27.C05.1.454.CMB.1.raw
  modified_base (200)..(200): a, c, t, g, unknown or other
  misc_feature (200)..(200): n is a, c, g, or t
tcagtacagatcgtcacgaccggtgctcgatttagacgcgatcgaagggtttgggggggggtctcaggaggcagcgctctcgggacgtctccaccatgcctgggctctgctattcctcaccctcctcactcaggcacagggtcctgggccctagtctgccctgactcagcctgcctccgtgtcgtggtcctcctggacgngtcgactccaccactcctcctgccactaggaaccagtctaggtcggtaccggttggtgcgtagtaactaacttagtcgtctccgtaggtaacccaaccacccacccgaggacctaaaccccgaacccccaaactccgactaggttactttaagtcgtaagttcgtaaccgaacggttaacgtacccgggttcccggttacggtttaagggtttacttaacgttccggttaccttccgtccggtacgtcccttaaccgtaacggtaccgtccgaaccgtaacccgtaccgtccccgttctacccggtaaccttcctcggttaccgcggtccgaacgttcggctacggtcgtaccgtaggtcctagttaacgttacttcgagtccagtctaactactaccgacacgtacgctacacctcgtctcgggtacgtcggacgacggtacgtcggaccttacggaaccgttacgacgtcccgtacgacccgtacggtccccgttacccggtcccgttaccg

SEQ ID NO: 241426 - DNA, 683 bp, Homo sapiens
  misc_feature: GYAE6OF02F0QPV.35.27.C05.1.454.CMB.1.raw
tcagtacagatcgtcacgaccggtgctcgatttagacgcgatcgaagggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtcctctggtaccaacaccaccaggacaaacgcccccaaactcatcgtatttatgatgtacagtaatcgcctcgtacgggtttctaatcgcttctctggtctactaacgttcgcggtacaacgaccggtccctcccgtacgtaccctagtccgtccgtcgggtcctccggaggtccgtaggaccggaacggacggtacgtagttaactttaattaccgtacgtaccgtacgtcttacgtaattaacctaaaccgaaccacgtaccgaaccttacctaaccgttccgtttcggttacggtttacccgggacgggtaaccgggaaccgttaacggtaccgttacccggtaacccggttaccggttaacggtacccgaacccggtacccggtaaccgggtccccgttaccccggtacccccggttaccccgg

SEQ ID NO: 241427 - DNA, 806 bp, Homo sapiens
  misc_feature: GYAE6OF02ILBT5.35.27.C05.1.454.CMB.1.raw
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
tcagtacagatcgtcacgaccggtgctcgatttagacgcgatcgaagggtttgggctcaactttcttgtccgccaggctccagggaagggctgggagtgggtctcaagttattaggtggttagtggtgattactatacactacgcagactccggtgaacgggccgttcacctatctcagagacaattccaagaacactactagaactctgactaaagtcgaacaggtcctaggagacgccgaaggacctaacggtcctaagtttacttacgngtcgaacgaaanctagtaactcgacttaattactatcgtcttacggaataacttaaagttcgagtactttacgactaccggtacgggtaccgtaacgggtaacccgtgtacctacgtactacctcgtacgtcccgtaccgtaacgaaccggtccgtagtcccggttaccctttaccccgtacgtcccctaacccgttctaaaccgtaacgtaccgacctaccgttcgggtacggggaccttaaccggaccggtacccggttacccggtacggggtccgttacggtaccggtttaaccggtaacgtaaaccgggtttaacccgtttacccgttaccggttaaaccgttaccgttaccgttaacgttaccgtaacgggttaacgggtccggggttaaccgttaaccggggaacggtaaaccgggtaacccgtttaacggtaaccggtttaacggacggtaaaccgcggttacgtagacggttaggcggtataccggtagacgtacgtacgtcgtaccgtacgtactacgtacgtac

SEQ ID NO: 241428 - DNA, 717 bp, Homo sapiens
  misc_feature: GYAE6OF02GWXJO.35.27.C05.1.454.CMB.1.raw
tcagtacagatcgtcacgaccggtgctcgatttagacgcgatcgaagggtttgggggggggtctcaggaggcagccgctctcgggacgtctccaccatggcctgggctctcgctattcctcaccctctcactcaggcacagggtcctgggcccagtctgccctgactcagcctgcctccgtgtcgtgggtcctccgtggactacgtcgaatccgactatccgtcctgcctacgtcggaacctagccaaggtcgtacggttggactctagaattacgtatcgtctccgtaggtaccaaccgtccaccgaggtcaaacgacccccaactacagtaggtacttagacgactagcaagtactcgcccgtagtacgggtttccaagttcgcttactcgtcgtactaccgtagtcgtacgtccaacgtacccgtccctcccgtacgaactactccgtacggtccggtaccctcggtacggtcccgttaggaccggacgtacggtactacggtaatttacgtaccgtttcgaaccttacggaccttataaacttaacgtaaaccgaccctagtaccgtaacgtacctacgttaccgttacggttacggtacccgggtacggtaacgggtaaccgaaccggtttcgaacccggtccgttaaccggttacgacccggttagaacccgggtaacctcccggttaccccggtaccccgttaacccggg

SEQ ID NO: 241429 - DNA, 714 bp, Homo sapiens
  misc_feature: GYAE6OF02JSVUR.35.27.C05.1.454.CMB.1.raw
  modified_base (203)..(203): a, c, t, g, unknown or other
  misc_feature (203)..(203): n is a, c, g, or t
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
tcagtacagatcgtcacgaccggtgctcgatttagacgcgatcgaagggtttggggggggggtctcgaggaggcagcgctctcgggacgtctccaccatggcctgggctctgctattcctcaccctcctcactcgagggcacagggtcctgggcccagtctcgccctgactcagcctgcctcgtgtctgggtcctcgtggacngtcgatcgacctatctcctgcacgtggaaccgcagtgtacgtgcatanactactntgtctcgtacgaaccacaccgacgagaccaaccgacccaatatagtactattagtcgtagtcgtaacgtaacgtacgtccggtaccgttacggttacggttactaaccgtcgtccgttctaccggttacgtacctaacggtaacgtacggaccgtaaaccgtaccgtacccgttccctaccgtaacgtacctacgttcggtccggtacgtacgtacgaccggttacgaacgtacggtaacggacgttacgtagttaaacgttacgttacacgtaccgtacgtaccgtaactacgttaaccaaccgaaccgtacgtacgaccgttacgttccggttacgtacgggtaccggtacgggtaccgggaccgtaacggtacggtcgttaacccggtacccgttacggtaccgtaccggaccggtacccggtaccggtaccccggtacccgttaccggtacc

SEQ ID NO: 241430 - DNA, 675 bp, Homo sapiens
  misc_feature: GYAE6OF02II6ZJ.35.27.C05.1.454.CMB.1.raw
  modified_base (230)..(230): a, c, t, g, unknown or other
  misc_feature (230)..(230): n is a, c, g, or t
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
  modified_base (526)..(526): a, c, t, g, unknown or other
  misc_feature (526)..(526): n is a, c, g, or t
tcagtacagatcgtcacgaccggtgctcgatttagacgcgatcgaagggtttgggggggggtcgtcgaggaggcagcgctctcgggacgtcctccaccatggcctgggctctgctattcctcacccttcctcacctcagggcacgagggtcctcgggacccaggtctgccctgacctcagccctgcctcgtgtcgtggtcctctggcagtcgatcgaccatcctctagcncgtaggaccagctagtcgtaccgttggcgctgaattaactagtgtctcgtacgtaccaccaccaccgacgaccaaccgacccccaanctaacgtntacttatcgattcgtacgagttaaccgtccgtaccgtacggttacgggttactacgtccttcgtctcgtcgtacctacgtacgtcgacgactaccggaccgtccctaccgtaccactccgtctacggtcggtacctacgacgttcgaacggcgtacggactcgtattacgttactgacgcngtaccntaacttcgaaaccnaccgacgccttaacgtccgttacggtccgggttacggtacgggacccgggaacggtaccgtccggtaaccgtacccggttccgttacccggaccgttcccggaaccgtacccgggtaccgtcccgttacccccggttaccggttacccg

SEQ ID NO: 241431 - DNA, 658 bp, Homo sapiens
  misc_feature: GYAE6OF02JIV3E.35.27.C05.1.454.CMB.1.raw
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (547)..(547): a, c, t, g, unknown or other
  misc_feature (547)..(547): n is a, c, g, or t
tcagtacagatcgtcacgaccggtgctcgatttagacgcgatcgaagggtttgggggggggtctcaggaggcagcgctctcgggacgtctccaccatggcctgggctctgctattcctcaccctcctcactcaggcacgaggtcctggccctagtctgccctgactcagcctgcctccgtgtctggtctctaggacagtcgatccacntctccgtgcacgtggaaccngcagtgtacggttggncgtgactaacgtatcgtctccgtcggtaccaaccaccctaccacgaccaaaccgacccctaaactccattacgtatttactacggtcttaggtactaagggttacctccggtcccgttacgttacgggtttactacgtcgtcttcgttcgtcgtccgtaccgtactcgtacgacaaccgccggtccctaccgtccgaccgtacttctcgtcggtcctccgacgttcgcggtaacggaacggtaccggtatagttacgttaacgtctacgtcaccgtaccgttctaccttaacgaaccctaccncgtacgaccggttcaaccgttcgtcgttacgtacgggtcggacgaaccgcgtaccgttacgaccgttacggtaccacgccgtaccgccggtccgtccccggtccgtaccgg

SEQ ID NO: 241432 - DNA, 655 bp, Homo sapiens
  misc_feature: GYAE6OF02GPZZG.35.27.C05.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (377)..(377): a, c, t, g, unknown or other
  misc_feature (377)..(377): n is a, c, g, or t
tcagtacagatcgtcacgaccggtgctcgatttagacgcgatcgaagggtttggggggggggtctcaggaggcagcgctctcgggacgtctccaccatcggcctgggctctgctattcctcaccctcctcactcaggcacagggtcctgggcccagtctgccctgactcagcctgcctcgtgtcgtggtctctggacagtcatcaccatcctcctgcactcggaaccngcagtgacgttggntctgaactactatcgtacctccgtcgtaccaaccaccaccgacggacaaccgccccaaatcactgtacttatgtatcgtacgtacgtacgtccgtacccgtgtacgggtttctaacgtcgtacttcctcggtacncgtacctaggtcgtacggaccaacgtccgtccctctaccactactcctcgtcgcctccgcggtacctaggaccgacggtacgacgtacgttacttacgttaccgtagtcgtacgtacctactataacaacctaaccgtcgacctacgcgttaccgttccggttcgttacggttacgggaccgggtacggaacggtaccgtaccggtaccggtaccgttaacccgggtcggtaccgtacccggtaccggtaacccgtcgtccccggtacccgttaccgg

SEQ ID NO: 241433 - DNA, 825 bp, Homo sapiens
  misc_feature: GYAE6OF02JN594.35.27.C05.1.454.CMB.1.raw
  modified_base (139)..(139): a, c, t, g, unknown or other
  misc_feature (139)..(139): n is a, c, g, or t
  modified_base (191)..(191): a, c, t, g, unknown or other
  misc_feature (191)..(191): n is a, c, g, or t
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
tcagtacagatcgtcacgaccggtgctcgatttagacgcgatcgaagggtttggggggggtctcaggaggcagcgctctcgggacgtctccaccatggcctgggctctgctattcctcaccctcctcactcgaggcacngggtcctggcccagtctgccctgactcagcctgcctcgtgtctgggtctccnggacagtcgatcaccagtccncctgcactggaaccngcacggtgacggttggacncctagtaactaacttagtcgttctaccgtggtaaccaaccaccacccgacggacaaaccgtccccaaacttaccagttacgtattttaacgtacgacgttagtacgtaacggttaactcccgggtccctaccgttacggggtttactaacgtccgtccttctccgttcggtcctaccgttaacgtcgtacgggtaccaaacgtcccggtacccttacccggtacggttaaccctaacgttacccggttccggttaacccgggttacccgttccggtaacgggtaccggtttacggtaaaccgggaacgggtaccggttaccgttagggtttaaccgtttacttaaacccggtttcgggaaccttccgggtaacgttaactaaccgttttaacccgaaccaaacccgggttaacaccggtaaccgtccggttaacccttcggtttaaaccggttcgttaccggggaccggtaacgggtaacccgaacggttcgtaacccgggttaccgttaccggtaacggttaccgaaccgtttacccggaaccgttccggtttacccccgtccccggtttaaccccgg

SEQ ID NO: 241434 - DNA, 588 bp, Homo sapiens
  misc_feature: GYAE6OF02GAWCQ.35.27.C05.1.454.CMB.1.raw
  modified_base (221)..(221): a, c, t, g, unknown or other
  misc_feature (221)..(221): n is a, c, g, or t
  modified_base (349)..(349): a, c, t, g, unknown or other
  misc_feature (349)..(349): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (568)..(568): a, c, t, g, unknown or other
  misc_feature (568)..(568): n is a, c, g, or t
  modified_base (570)..(573): a, c, t, g, unknown or other
  misc_feature (570)..(573): n is a, c, g, or t
  modified_base (575)..(588): a, c, t, g, unknown or other
  misc_feature (575)..(588): n is a, c, g, or t
tcagtacagatcgtcacgaccggtgctcgatttagacgcgatcgaagggtttgggctcaactttcttgtccgccaggctccagggaaggggctggagtgggtctcagttattagtggtagtggtgatactatacactacgcagactccgtgaagggccggttcaccatctccagagacaattccaagaacacactgaatctgcaaatgaacagcctgaganccgaggacacggccgtatattactgtgacgaaaagacatatcgcgtattactaatgtcttcggagaactttaaattgagtcttttgacttacgtggggccaagggaacccctggtcaaccgtctcctncgcctccaccgaacgggccctatcggtcttcccccgnggacccnccctccctaccaagcgaccaacccttcggtcggggctaaccgcggcccggtccccgtaggggccctcgggccccgttggtacggaacggaccttaccgttacccacggtaacttcgtagttaccgtaggtacggtccgggcgtacggaccgaagggcgaccgtaagtaggactgngnnnngnnnnnnnnnnnnnn

SEQ ID NO: 241435 - DNA, 642 bp, Homo sapiens
  misc_feature: GYAE6OF02HICMG.35.27.C05.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
tcagtacagatcgtcacgaccggtgctcgatttagacgcgatcgaagggtttggggggggggtctcaggaggcagcgctctcgggacgtctccaccatggcctgggctctgctattcctcaccctcctcactcagggcacagggtcctgggcccagtctgccctgactcagcctgcctccgtgtctgggtcctctggacagtcgatccaccatctcctgcactggaaccngcagtgacgttggtnctgaactactatgtctctgtaccaacaccaccgaggacaaacgccccaaatcatagtacttatgactgtacagtaactccgaccttcgtacgggttttactaacgtcctcttacgtctacggtctaaccgtaagtcgtacggacaacgtaccggcccttacccgacgaacctacttcctcgtacgggtcctaccgacggtctacggtaaccgacggacgtccttagtaactttaactttaacgcgacacgtactactaataacaaccaaccgtagaccgaactcgaaccttcgttacggtacgttacgggacggaacggtaccgtaaagtccgttaaccgaacccgttcgtaacggtccaaccggaccgtacgggcccttcccggaccccgttacgg

SEQ ID NO: 241436 - DNA, 518 bp, Homo sapiens
  misc_feature: GYAE6OF01BYMIR.38.5.A05.1.454.CMB.1.raw
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctcctggtaccaacagcacccgggcaatcgacccccaaaatcaatgatttatgaggtcactcatcggccctgagggtttctaatcgcttctctgcatccaagtctggcaacacggcctcctgaccatctctgggctccaggctggaggacgaggtactaattatttctgctagttcatactaacaaccagacaacactctgctagttcggcggtacgggaccaagctggacccgtacctaagtccacgacccaaggcctcgccccctcgg

SEQ ID NO: 241437 - DNA, 512 bp, Homo sapiens
  misc_feature: GYAE6OF01BAFNA.38.5.A05.1.454.CMB.1.raw
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatgcccccaaaatcatgatttatgaggtcactcatcggccctcgaggggtttctaatcgcttctctgcatccaagtctggcaacacggcctccctgacccatctctgggctccaggctgaggacgaggcttaattatttctgctagttcatatacaaccagcaacactctgctattcgggcggagggaccaagctaggacccgtactaagccacgcccgaaggcctcgccccctcgg

SEQ ID NO: 241438 - DNA, 589 bp, Homo sapiens
  misc_feature: GYAE6OF01C96GN.38.5.A05.1.454.CMB.1.raw
  modified_base (221)..(221): a, c, t, g, unknown or other
  misc_feature (221)..(221): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttaataactatgtctactggtaccaacaacaccaggacaaacgcccccaaactcatgtatttatgacggtcactaatccgcctcgtagggtttactaatcgtcttctcgtgctaccagtctggacaacgacgccctcctgacctattctcgtggcctccgaggtctaggaggacggcggtcctagtatttattactcgctacgtcttattaagtaagaaagtaagtagactaacgttcggttggttacgggttaccgggcgggtaacgggaccgaaggtccgtacggtacccgttacgtaacgtaccgacggacccgtaaggtccgtacccggcccccgttcggtcctacccg

SEQ ID NO: 241439 - DNA, 499 bp, Homo sapiens
  misc_feature: GYAE6OF01AMM1T.38.5.A05.1.454.CMB.1.raw
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatgcccccaaaatcatgatttatgaggtcactcatcggccctcaggggtttctaatcgcttctctgcatccaagtctggcaacacggcctccctgaccatctctgggctccaggctgaggacgaggctaattatttctgcagttcatataacaaccagacaacactctgctagttcggacggaggaccagctgaccgtctaagtcagcccaagctcgcccctcgg

SEQ ID NO: 241440 - DNA, 499 bp, Homo sapiens
  misc_feature: GYAE6OF01BXBJP.38.5.A05.1.454.CMB.1.raw
  modified_base (265)..(265): a, c, t, g, unknown or other
  misc_feature (265)..(265): n is a, c, g, or t
  modified_base (402)..(402): a, c, t, g, unknown or other
  misc_feature (402)..(402): n is a, c, g, or t
  modified_base (434)..(434): a, c, t, g, unknown or other
  misc_feature (434)..(434): n is a, c, g, or t
  modified_base (458)..(458): a, c, t, g, unknown or other
  misc_feature (458)..(458): n is a, c, g, or t
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttgtgttataattgtctctgtaccaacagcaccggnaatgcccccaaaatcatgatttatgaggtcactcatcggccctgagggtttctaatcgcttctctgcatccaagtctgcaacacggcctcctgaccatctctgggctcgaggctgaggacgaggctaagttatttcngctagttcattataacaaccagacaacactcngctagtcggacgagggaccagtcncgaccgtccgtaagtctacgacccaagcctcgcccctacgg

SEQ ID NO: 241441 - DNA, 500 bp, Homo sapiens
  misc_feature: GYAE6OF01BCMTK.38.5.A05.1.454.CMB.1.raw
  modified_base (220)..(220): a, c, t, g, unknown or other
  misc_feature (220)..(220): n is a, c, g, or t
  modified_base (296)..(296): a, c, t, g, unknown or other
  misc_feature (296)..(296): n is a, c, g, or t
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtggttataaatttgtctcctggtaccaacagcacccggcaatgcccccaaaatcatgatttangaggtcactcatcggccctcaggggtttctaatcgcttctctgcatccaagtctggcaacacggcctccctgaccatctctgggctccaggctggaggacgaggcttaattatttctgctagttcatatacaaccagacaacactctgctattcggcggagggaccaagctgaccgtctaagtcacgacccaagctgccctcgg

SEQ ID NO: 241442 - DNA, 649 bp, Homo sapiens
  misc_feature: GYAE6OF01CY6M5.38.5.A05.1.454.CMB.1.raw
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctcctggtaccaacagcaccggcaatgcccccaaaatcatgatttatgaggtcactcatcggccctcgaggggtttctaatcgcttctctgctactactaagtcgtacggaccaaacgacccggtcccttcccgtacgaccctacttcctcggtcgggtcctccgacggtcgtaggaacgggacggacggtacttaaacgttttactttcgttcgacttacggtttactaagttaacctaaccaaaccctaacgtaaccctaactacccttacgtcgttacgttaacggttccggggaccgggtaacgggaacccgaacggtccgttacggtaaccccgttaccgtaaacgtaccgtaaccgaacccgaaggtccccgtcccggtccccccggttacccgg

SEQ ID NO: 241443 - DNA, 566 bp, Homo sapiens
  misc_feature: GYAE6OF01EY4AT.38.5.A05.1.454.CMB.1.raw
  modified_base (297)..(297): a, c, t, g, unknown or other
  misc_feature (297)..(297): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctccgtggacagtcgatcaccatctcctgcactggaaccagcagtgacgttggtggttaataattgtctcctggtaccaacagcaccggcaatcgaccccaaaatcatgatttangagtcactcatccgcctcgtagggtttctaagtcgcttctctgcactccaagtcgtgacaaccaccggcctccctacgaccctatcctcgtcgggcctaccgaggtcgtaggaggacggagtacttaatttactttctgctacgttcaattactaaccaaccagactaactactcctagtacttagtaccgggcggaacggaaccgtacgtcgtacggaccgttacctaacgtaccgacgacccgaaggcctcccgcccccgttaccgg

SEQ ID NO: 241444 - DNA, 518 bp, Homo sapiens
  misc_feature: GYAE6OF01D4F0Y.38.5.A05.1.454.CMB.1.raw
  modified_base (317)..(317): a, c, t, g, unknown or other
  misc_feature (317)..(317): n is a, c, g, or t
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctcctggtaccaacagcacccgggcaatcgcccccaaaatcatgatttatgaggtcactcatcggccctntaggggtttctaatcgcttctctgcatccaagtctggcaacacggcctcctcgaccatctctgggcctccgaggctggaggacggaggtcttaattatttctgctagttcatactacaaccagacaacactctgtctagttcggcggtaggaccaagctacggaccgtcctaagtccagacccaaggcctgcccccgtcgg

SEQ ID NO: 241445 - DNA, 864 bp, Homo sapiens
  misc_feature: GYAE6OF01C7Z5O.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggtattttccttttggctattttaaaaggtgtccagtgtgaagtgcagctggtggagtcgtgggggaggcttggtacagcctggcacggtccctgagactctcctgtgcagcctctggattcagtcttttgatgtattagtggacagtgccgtacgttcgggggtccccggacaaaggtcccgttacccggaaaggggggaaacggggtcccttagggggtaggttcggggttcccttacggtaaggggtttaagtttttaacgggttaggggaaaaccgtaggggtttaggggttaaagggtagttaaacggggtcctttaaaggtcggggtacccgggtaactttccggttaggggttaaggggaaaccggggggttcccctaagtttaccaacgggcctaacgtcccgttacccgaaagggaacgaaacccgaaaccgacccgtaaaaggttaaccttttcccccgtaagtttaaactaaccttaaaccgaaaaagttccggtaaaaccctagggtttaccgtaggaacggtaacggtcccgttaaggggaccgggtaaacccgtacgggttccctttttaaggtaacgtttaccgtggtaacgtaaacgtaaaaaacggtttgtttttacggtaaagggttttaagggtaaggtttaaacgggtttaacggggtttacccttaacgttaaacccggttaagggttacgtacggggttccgttacgggtaaccggggg

SEQ ID NO: 241446 - DNA, 606 bp, Homo sapiens
  misc_feature: GYAE6OF01BH3XY.38.5.A05.1.454.CMB.1.raw
  modified_base (276)..(276): a, c, t, g, unknown or other
  misc_feature (276)..(276): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttcctttggctattttaaaaggtgtccagtgtgaagtgcagctggtggagtcgtgggggaggcttggtacagcctggcaggtccctgagactctcctgtgcagcctctggattcagctttgatgattatggcatgcacgtgggtccgnaagctcgaggggaggcctggagtgggtctcgaggtattagtggaacaggtggtagataggctatggcggtatcgtgtggaagggcctagttcaagctatctacagacgacaacgcaaagacttccctagtactactaacaaagtcaaactgtactaggaacgtagacgtaggaacggaaccgtacggtccctttagtaactttacgtggttacggaaccgtaaaaccggaacccggttccccgttagtaacgggttgggggtaccggggtaatttacgtcgggttccggtacgggggacccaacggggtaaaccccgttcggggaacccc

SEQ ID NO: 241447 - DNA, 681 bp, Homo sapiens
  misc_feature: GYAE6OF01B5GAI.38.5.A05.1.454.CMB.1.raw
  modified_base (266)..(266): a, c, t, g, unknown or other
  misc_feature (266)..(266): n is a, c, g, or t
  modified_base (292)..(292): a, c, t, g, unknown or other
  misc_feature (292)..(292): n is a, c, g, or t
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctctgcactggaaccagcagtgacgttggtagttataattgtctctgtacaacagcaccgganaactcgaccccaaaatcatgtattangtagtctactcatccggccttacggtacgggtttactaacgttcgtctttccgtctcgtacactacctaagtctcggaccaacgaccggtccctaccgacgtaccctattccgttcgtcgggtcctccgaaggtccgttagggaacggtaacggtacgggtaactttaaacgttttacttttacgacgtacgttactttaacctaatttaacccttaaaccaaacccgtacgtaaaccctaaactaccgttacccgttagtacccgtttagtttacccggggaaccggggtaaacggaacccgtaacggtccgtaacggtacccgttaaccctaaacggtacccgaaccggtaccccgaaggtccctccccgggtaccccccgtttcgg

SEQ ID NO: 241448 - DNA, 594 bp, Homo sapiens
  misc_feature: GYAE6OF01A7A2Z.38.5.A05.1.454.CMB.1.raw
  modified_base (220)..(220): a, c, t, g, unknown or other
  misc_feature (220)..(220): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (353)..(353): a, c, t, g, unknown or other
  misc_feature (353)..(353): n is a, c, g, or t
tcagtcgatcacgtcacgaccggtgctcgatttagatagatagacaggggggggtctcaggaggcagcgctctcaggacatctccaccatggcctgggctctgctgctcctcaccctctcactcagggcacagggtcctgggcccagtctgccctggctcagcctgcctccgtgtctgggtctcctggacagtcgatcaccatctcctgcactggaaccngcagtgacgttggtgttataattgtctctggtacaanagcaccggnaatcgaccccaaaatcatgtatttatgagtcactcatcgcctcgtagggtttctaatcgtcttctctgcatccaagtctggacaacnccggccctccgtgacctatctcgtcggcctaccgaggctaggacggacgacggtaccttaatttactttcgtgactagttacaattaactaaccaaccacgtacaaacctactcctagtaccttaaggttccgggacgggtaacggaacctaaggtaccgtacggtaaccccgttaccgttaaacgtacccgaaccggtaccccgtaaacggtcccgttcccggtccccccgttacccggg

SEQ ID NO: 241449 - DNA, 573 bp, Homo sapiens
  misc_feature: GYAE6OF01C8ENW.38.5.A05.1.454.CMB.1.raw
  modified_base (221)..(221): a, c, t, g, unknown or other
  misc_feature (221)..(221): n is a, c, g, or t
  modified_base (297)..(297): a, c, t, g, unknown or other
  misc_feature (297)..(297): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctcctggtaccaacagcaccgggcaatcgcccccaaaatcatgatttangaggtcactcatcggcctcgagggtttctaatcgtcttctctgcatccaagtctggcaaacgacggccctcccgtcgaccatcctcgtcgggcctccaggctggaggacgaggcttaatttattctgctagttcatataacaacagacaacacttactcgacttacgttcgggacgggtacggacccgtaacggtccgttacggtaacccgttacccgttaaaggttaccgaaccggaccccgaagggtcccgtcccggtccccccgttacccggg

SEQ ID NO: 241450 - DNA, 654 bp, Homo sapiens
  misc_feature: GYAE6OF01BPFY9.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggtatttttccttttggcttattttaaaaggtgtccagtgtgaagtgcagctggtggagtcgtgggggagtcttggtacagcctggcaggtccctgagactctcctgtgcagcctctggattcagtctttgattgattatggcatgcacgtgggtccgcaagctccgaggggacggcctgggagtgggtctcgaggttattaggtggaactaggtgggtaggagtaggcttagtggcggtactcgtggtaggaacggggccgtattcgagtcctattccgtaccgaaggtaacgaaccaaaccggaccctaaaagtaacctttccccgtagttaacttacctaaactaaagtacgaaactagtcgtagagagcgtaggacggacctacggtccttagttacttacgtgtacgtaactaaaaggttgttttaggtaaggttttaaggaagggtttaaacggttaaacggggttccttaaacggttaacggttacggggttaagttacggggtacggttccgggtacgggggg

SEQ ID NO: 241451 - DNA, 600 bp, Homo sapiens
  misc_feature: GYAE6OF01BCRXM.38.5.A05.1.454.CMB.1.raw
  modified_base (499)..(499): a, c, t, g, unknown or other
  misc_feature (499)..(499): n is a, c, g, or t
  modified_base (570)..(570): a, c, t, g, unknown or other
  misc_feature (570)..(570): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttccttttggcttattttaaaggtgtccagtgtgaagtgcagctgggtggagtcgtggggggaggcttggtacagcctggcaggtccctgagactctcctgtgcagcctcgtggattcagtctttgattgatttagtggctagtcgctacgtggggtccggcaagcctaccgaggggacgggcctgggaggtgggtctcgaggttattaggttaggaactaggttagggtaggagttaggactagtcggcggacttcgtggtaggaacggggtccgtatttcgagctattccgtaccgaaggacgaaccaaccgaccaaagtaacctttcccgagttactactaacgaaattacgaactaggtctagacgngcgtagacggtacgaccggtcttagtacttacgtgtagactaaagtgtttagagtttagagttagtaggtntacgtacgtacgtagtcgtacgtgtacggg

SEQ ID NO: 241452 - DNA, 679 bp, Homo sapiens
  misc_feature: GYAE6OF01A3QKO.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcagctttgatgattatggcatgcacgtgggtccggcaaggcctaccgaggggaacggccgtgggaggtgggtctcgaggttattaggttggaacgtggttgggtaaggagtaggcttagtggccggtactcgtggtaggaacggggccgtatttcgaggtctaattcccgtaccgaaggacgaaccgaaccgacccaaagtaacctttcccgtagttaacttacctaaactaaactacgaaacctacgtactaggaagtacgacgttaggaacggaaccgtaccgggtaccctttagttaacgttacgtagtacgtaaccgtaaaaagttagtttttaaggtaagtttaggtaaaggtttacgggttaaacgggttaccttaaacgtttaaccggttaacgggttaagttacgggtaaccgggtttcggtacggggg

SEQ ID NO: 241453 - DNA, 529 bp, Homo sapiens
  misc_feature: GYAE6OF01AWZX3.38.5.A05.1.454.CMB.1.raw
  modified_base (276)..(276): a, c, t, g, unknown or other
  misc_feature (276)..(276): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtaggttataaatttgtctcctggtaccaacagccacccgggnaatcgacccccaaaatcatgtatttatgaggtcactcatcggcctcgtagggtttctaatcgtcttctctgcataccaagtctggcaacgaccgccctccctgaccatctcgtcggctccaggctgaggacgagacttaattatttctgctgttacatataaccaaccacacaactactctcgactacgtcggcggagggaccgacgtactcgacccgtcctaagcacgacccaaggccctcgcccccgtcgg

SEQ ID NO: 241454 - DNA, 873 bp, Homo sapiens
  misc_feature: GYAE6OF01A6WPM.38.5.A05.1.454.CMB.1.raw
  modified_base (205)..(205): a, c, t, g, unknown or other
  misc_feature (205)..(205): n is a, c, g, or t
  modified_base (222)..(222): a, c, t, g, unknown or other
  misc_feature (222)..(222): n is a, c, g, or t
tcagtcgatcacgtcacgaccggtgctcgatttagatagatagacagggggggggtctcaggaggcagcgctctcaggacatctccaccatggcctgggctctgctgctcctcacctctcactcagggcacgagggtcctgggccagtctgccctggctcacgcctgcctcgtgtcgtggggtctccgtggacagtcgatcaccntcctctgcatggaaccngcagtgtacgttggtaggttaataaagtttgtctccgtcggtaccaacgtacgccgacccgggacaactcgaaccccctaaaaatcaagttacgtactttacgtacggtacggtacctactacgtacgtccggacccgttacggtacggggttttactaacgtccggtcgtttacgtcgtcgacctagtaccctaagttctacgggtacctaaaccgtaccggtcccttacccgtacgtacccgtagttccgtaccggttacggggtccctaccggtaacgggtaccgttagggaaaccgggttaaccgggtaacggttaaccgtttaaacgttttacgttttaccgtaccgtaacgtttaacggtttaacctaaacgtttaaaccgttaacccgtaaacccgtaaccggtaacccgttaaaaccgttacccgttacccgggttacggtaacccggtttaacggggttacccggggtaacccggggtaaacccggggtaaacccgtaaaccgggttcccggttaaacccgggttaaccccgggtttaaacccgttaaaccgggttaacccgtaaacccgggttaacccccgggtaaacccgggtttaccccgtttccccccggggttaacccccccggtttaaccccgggg

SEQ ID NO: 241455 - DNA, 559 bp, Homo sapiens
  misc_feature: GYAE6OF01A807E.38.5.A05.1.454.CMB.1.raw
  modified_base (368)..(368): a, c, t, g, unknown or other
  misc_feature (368)..(368): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatcctcctgcactggaaccagcagtgacgttggtggttataaatttgtctcctggtaccaacagcacccgggcaatcgacccccaaaatcatgatttatgaggtcactcatcggcctcagggtttctaatcgcttctctgcatccaatctgcaacacggcctcccngaccatctctgggctccaggctgaggacgacggactaagttatttctgtctagttcattataaccaaccagtaccaactacctctagtccttagtccgggacggaaggggaccctaaggcccttacggaacccgttcccgtaaggtcccgtaacgaccccgtaaggccgtcccggtcccccgttacccggg

SEQ ID NO: 241456 - DNA, 521 bp, Homo sapiens
  misc_feature: GYAE6OF01C12TY.38.5.A05.1.454.CMB.1.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (341)..(341): a, c, t, g, unknown or other
  misc_feature (341)..(341): n is a, c, g, or t
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccagcagtgacgttggtgttataaatttgtctcctgtaccaacatcacaacatcacccaggcaaagtccccaaatcataatttangagtcactaaacggccctanaggagtttctaatcgcttcnctggctcaagtctggcaacacggcctcctgacctatctctcgggctccaaccgtgacgacgaggctcactattattgcagctctatatacaagcagctcacgttgggtgttccggcggacgggaccgtaccgtggtacccgttcgttacggtcacgacccgaggcctccgcccccgtcgg

SEQ ID NO: 241457 - DNA, 745 bp, Homo sapiens
  misc_feature: GYAE6OF01DM659.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggtattttcctttggcttaattttaaaaggtgtccagtgtgaagtgcagctggtggagtcgtgggggaggtcttggtacagccgtggcaggtccctgagactctcctgtgcacgcctcgtggattcagtctttgatgtattagtggctagtcgctacggtcggggtcccgacaaggcccgtacggagggggaacgggtccgtaggggacggtcgggtctacggtaggttagtttaggttaggaaacgtagggttagggtaaggagtaggctagtcggaccggtactcggtaggtaggaacgggccgtaattcgagtcctacgttccgacgaaggtaacgaacccgtaaccgtacccgtaaagttaaccctttcccgtaagttaacctaccctaaaagaaagttaccgaaactcggttacgtaggacgtaacgtcgtaagggaaccgtaccggtaccggttactttaggttaacctttggaggttaaacgtaaacgttaaaaaggtttacgtttttagggtaaaggttttaaggaacgggttttaagggtaaaccggttactttaaacccgttaagggttacgggttaacgtcggggtaacccggttggggtaaacccggggg

SEQ ID NO: 241458 - DNA, 699 bp, Homo sapiens
  misc_feature: GYAE6OF01CI84C.38.5.A05.1.454.CMB.1.raw
  modified_base (203)..(203): a, c, t, g, unknown or other
  misc_feature (203)..(203): n is a, c, g, or t
tcagtcgatcacgtcacgaccggtgctcgatttagatagatagacgaggggggggtcgtcaggaggcagcgctctcaggacatctccaccatggcctgggctctgctgctcctcaccctcctcactcagggcacagggtcctgggcccagtctgccctggctcagcctgcctcgtgtctgggtctctggacagtcgatcaccntcctcctgcacgtggaaccgcagtgacgttggtagttaataattgtctctgtacacagccaccggcatcgacccaaatcatgtattatgagtcactcacgtccggtcctcgtacgggtttactatccgtcttctctgctactacaacgtcgtcggacaacgaccggtcccttcccgtacgtaccctacgttccgttcgtccgggccttaccgaggtccgtaggacgggtacggtacgtacctttaaattttacgtttcgtacgtacttacgtttactaacttaacctaaaccgaacccgtacgtaacctaacccgttaaccgtaccttacggtaaccgtttaacggttcccggggaaaccgggttaaacgggaacccgtaacggttacccgttacccgggtaaaccccgtttaccggtaaaccgtacccggtaacccggtaaccccggtaaacccgggttcccccttaccccggggtcccccccgtttaacccggg

SEQ ID NO: 241459 - DNA, 555 bp, Homo sapiens
  misc_feature: GYAE6OF01B6AK2.38.5.A05.1.454.CMB.1.raw
  modified_base (293)..(293): a, c, t, g, unknown or other
  misc_feature (293)..(293): n is a, c, g, or t
  modified_base (424)..(424): a, c, t, g, unknown or other
  misc_feature (424)..(424): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccagcagtgacgttggtgttataattgtctcctgtaccaacagcaccggcaatcgacccccaaatcatgtatttangaggtcactcatccggccctcgacgggtttctaagtcgtcttctctgctatccaagtctgacaacgcgcctcctacgacctatctcgtcgggctcgaggctggacggacgaggtcttaaagtttactttcngtactagtttcaatactaaccaaccgagaccaactctcgtcgcttacgttcgggcggaacggaccgaacgtcgtacgacccgttaccgtaacgaccacggaccccaagggccctccggcccccgttaccgg

SEQ ID NO: 241460 - DNA, 673 bp, Homo sapiens
  misc_feature: GYAE6OF01BVJEL.38.5.A05.1.454.CMB.1.raw
  modified_base (107)..(107): a, c, t, g, unknown or other
  misc_feature (107)..(107): n is a, c, g, or t
  modified_base (329)..(329): a, c, t, g, unknown or other
  misc_feature (329)..(329): n is a, c, g, or t
tcagtcgatcacgtcacgaccggtgctcgatttagatagatagacaggggggggtctcaggaggcagcgctctcaggacatctccaccatggcctgggctctgctgntcccccccccctaccctcctcactcagggcacagggtcctcgggcccagtctcgccctggctcagcctgcctccgtgtcgtcgggtctccgtggacagtcgatcaccattcctcctgctactacggaaccaggcagtgacgttggtagttattaatttgtctacgtacggtaccaacaaccgtaccaggaccaaaccgacccctaaactcactactatttanacgtaccgtctactcactcccgcctaggtcggtttccactcgtcttacgtctcgtctacgtacgtttcgactaacgccgcctccgtacgtacctagttcgaggtccctcgaggtccgtaggacggtacgtcgtacgttaagttaattttacgtcgtaccttaccgtactaacgtacgtacgtacggactaacggtcctaccggtaccccttacccgtttgtaccgtttccgtacgggtaaccgtacgggtaacctacggttcccgtaccgtacccgttaggcctacccggaacccaccgggtaacccctaacccgacgttaccgcctacggttccctacccggg

SEQ ID NO: 241461 - DNA, 699 bp, Homo sapiens
  misc_feature: GYAE6OF01CRL0G.38.5.A05.1.454.CMB.1.raw
tcagtcgatcacgtcacgaccggtgctcgatttagatagatagacgaggggggggtctcaggaggcagcgctctcaggacatctccaccatggcctgggctctgctgctcctcaccctcctcactcagggcacagggtcctgggcccagtctcgccctggctcagcctgcctccgtgtcctgggtctcctggacagtcgatcaccatctcctgcactggaaaccagcagtgacgttggtgttaataaatttgtactcctggtaccaacacgcacccgggacaactcgaccccaaaatcaatgtatttagtgaaggtcaacgtcaagtccggccctcgtacggggtttctaagtccgtcttcgtctgctataccgaagtctacggacaaacgtaccggtccctaccgtacgtacccaacttccgtacgttacgggccttaccgacggtcctaggaacggtaaccggtagggtaacttaaatttaacgttttccgtagtacctaggtttacctaattaacttaacccgaaaccgtaacgtacctaaaccgtaacttcgttacgaccttaacggttacccgggacgggtaacgggtaacccgtaaaggtacccttacggtaaaccccgttacccgttaaaggttaaccgaccggttaaacccccgaaagggtcccctttcccgggcccccccgtttaccggg

SEQ ID NO: 241462 - DNA, 637 bp, Homo sapiens
  misc_feature: GYAE6OF01ACXR5.38.5.A05.1.454.CMB.1.raw
  modified_base (618)..(618): a, c, t, g, unknown or other
  misc_feature (618)..(618): n is a, c, g, or t
tcagtcgatcacgtcacgaccggtgctcgatttagatagatagacagggggagattcccaggtgtttccattcagtgatcagcactgaacacagaggactcaccatggagttgggactgagcgtggtagtttcctttaggctattttaaaaggtgtccagtgtgaagtgcagctggtggagtcgtgggggaggcttggtacagcctggcaggtccctgagactctcctgtgcagcctctggattcagtctttgatgattgtggcatgcacgtgggtccgcaagccgtccgaggggacggccgtggaggtgggtctcgaggttagtttaggtaggaacgtggtgggtaaggtatagggcttaagtcgggacggtacttcgtaggtaggaaacggggtccctaattcgaggtcctagttcctacccggaggaacgtaaccaaccgtacccgaaaggtaacctttcccgtagttaactccgtaaactaatacgaacgtacgttctaggaacgtagtccgtaagggacgaccgtacggtctttagtacttacgtgtacgaagtaaacgttgtttaggtaaggtttagaaggttaggttacggttactaacttacggtaggtntcgggtacgtggtacgggg

SEQ ID NO: 241463 - DNA, 567 bp, Homo sapiens
  misc_feature: GYAE6OF01BAID7.38.5.A05.1.454.CMB.1.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (469)..(469): a, c, t, g, unknown or other
  misc_feature (469)..(469): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggngttataattgtctctggtaccaacagcaccggcaatcgacccccaaatcatgtattatgtagtcactcactccggccctcgtacgggtttactaactcgtacttctctgtcatctaagtctgacaacgcggtccctcctcgaccactctcgtcggcctccgaggctaggaggacgagtcttaagttacttcgtgtctagttcaattactaaccaaccacgtacaaactctacgtntccgttagtccggacgggtaacggaccaaggtccgtacgtaccccgttaccgtaaacgcctaaccggtacccaaggtccctaccgtccccccgtacgg

SEQ ID NO: 241464 - DNA, 563 bp, Homo sapiens
  misc_feature: GYAE6OF01AXUZ3.38.5.A05.1.454.CMB.1.raw
  modified_base (510)..(510): a, c, t, g, unknown or other
  misc_feature (510)..(510): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttccttttggctattttgaaaggtgtccagtgtgaagtgcagctggtggagtcgtggggggaggcttggtacagcctggcaggtccctgagactctcctgtgcagcctctggattcagtctttgatgattatggcatgcacgtgggtccagcaagctccgagggacggctggagtgggtctgaggtattaggtaggaacgtaggtggtaaggagtagggctagtggcggtactcgtggtaggaacgggccgtattcgagctatcctaccgagtacgaaccaacgaccaagtaactttcccgtagtactacctaacaaatacgaaactagtcgagagagtcaggacgacgtacgtcgttagtatacgtgtagaagtaaagttntttaggagttagagttaggtaacggtacttacgtacgtacggtagtggtacgg

SEQ ID NO: 241465 - DNA, 621 bp, Homo sapiens
  misc_feature: GYAE6OF01B35ZD.38.5.A05.1.454.CMB.1.raw
  modified_base (222)..(222): a, c, t, g, unknown or other
  misc_feature (222)..(222): n is a, c, g, or t
  modified_base (256)..(256): a, c, t, g, unknown or other
  misc_feature (256)..(256): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctccgtggacagtcgatcacatctcctgcactggaaccngcagtgacgttgtgttataattgtctctgtacanagcaccggcaatcgacccaaatcatgtatttagtgtaggtacactacagtccggcctcgtacgggtttctaatcgtcttctctcgctactccaagtcgtaggaccaaccgaccggtcccttacccgtacgtacctacttccgtccgtcgggcctccgacggtcgtaggaacgggacgtacggtacttaagtttacttcgtgtacgttattactacgttaactaaccaaccgagtaaccaaacgtactactcgtaaccttacggtacgggtaccgggaacggtaaccgaacgtcgtaccggtacccggtacctaacggtacccgaccggtacccgaaggtcccgttcccggtcccccgttaccggg

SEQ ID NO: 241466 - DNA, 674 bp, Homo sapiens
  misc_feature: GYAE6OF01ED0NK.38.5.A05.1.454.CMB.1.raw
  modified_base (370)..(370): a, c, t, g, unknown or other
  misc_feature (370)..(370): n is a, c, g, or t
tcagtcgatcacgtcacgaccggtgctcgatttagatagatagacagggggggtctcaggaggcagcgctctcaggacatctccaccatggcctgggctctgctgctcctcaccctcctcactcagggcacgagggtcctgggcccagtctcgccctggctcacgtcctgcctccgtgtcgtgggtctcctggacagtcgatcaccatctcctgcactaggaaccagcagtgtacgttggtaggttaattaaatttcgtctccgtaggtaccaacagccgaccgggacaactcgaaccccctaaaatcaactgtactttagcggtacggtcactcatccggcctagtacgggtttacagtcgtcttctcncgtcactacgagtctcggaccaacgaccgccctcctacgacctatccgtcgtcgggcctacgacggtcgtacggaacggacgtaggtactttaaagtttctttgacgtctacgttcaataacctaaccaacgacgtaaccaacgtaccttcgtacgtaccgttaggttaccgggacgggtaaaccgggtaccgtaaacgggtacccttaaccgggttaacccgttaacccggttaaacggtacccgtaaccgggaaccccggttaaacggccccggttaccccggtccccccggttaacccggg

SEQ ID NO: 241467 - DNA, 590 bp, Homo sapiens
  misc_feature: GYAE6OF01AX3JN.38.5.A05.1.454.CMB.1.raw
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctctgcactggaaccagcagtgacgttggtgttataattgtctctggtacacacgcaccggcaatcgaccccaaatcatgtacttatgagtcactcatcgcctcgtagggtttctatcgtcttctcgtcgactactccgaagtcgtagacctaacgaccggtccctaccgtacacctacttccgtacgtcgggccttcgacggtcgtacggaaggacgagttacttaatttcgttctgtctagttctaagttactaacgtaaccgagacctaacgtctacctagtacgttacgttacgggaccggtaacggaacgtaacggtcgtaccggttacccgtacccgttaagtccgacgacccgtacgccctcccggcccccgttaccgg

SEQ ID NO: 241468 - DNA, 740 bp, Homo sapiens
  misc_feature: GYAE6OF01D3YB4.38.5.A05.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (500)..(500): a, c, t, g, unknown or other
  misc_feature (500)..(500): n is a, c, g, or t
tcagtcgatcacgtcacgaccggtgctcgatttagatagatagacgagggggggggtctcaggaggcagcgctctcaggacatctccaccatggcctgggctctgctgctcctcaccctcctcactcagggcacgagggtcctgggcccagtctcgccctggctcagcctgcctcgtgtcgtgggtctccgtggacngtcgatcacatctctgcactggaaccngcagtgtacggttggtagttaattaagtttcgtcctccgttacggtaaccaacgacgccgaacccgggacaaacgtcccgaaccccctaaaatctaagttagtaagtttagtacggtacggtactaccgttaccgacgtcccggtacccgttacggttaacggggtttactaacgtccgttcttctcgtcgactactccgtaacgttcgtcgaacctaccgtacggtcccttaccgtacgaaccttctcccgttccggtacgggtcccgtaccggnggtaccggtagggaacggtaacgttacgggtaactttaagtttcgtttcgtcgtaacttagttacgtaataaccgtaaccaaccgtacaaccgttaactcctgtacgtaccgttacggtaccgggacgggtaaaccggtaaccgacgtacggttaacccggacccggttaacgtaaccggttaacccggacccgtaacccgggtaacccggtcccggtttccccgccccccggtttacgg

SEQ ID NO: 241469 - DNA, 816 bp, Homo sapiens
  misc_feature: GYAE6OF01AQW1H.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggtatttttccttttggcttattttaaaaggtgtccagtgtgaagtgcagctggtggagtcgtgggggaggtcttggtacagccgtgggcaggtccctgacgaccttctccgtgtcgcacgcctcgtggacttcgagtctttgattgtaatttagcggtctagtcggactacggttcggggtacccagactaacggtccgtaccgggaagggggacgggtccgtaggggtacggttcggggttcttacgggtagggtttaagtttagggtacggaacggtagggttagggtaaggtagtacgggtacgttaggtcgggtacccggttacgttcggttagggtaacggggtaaccgggtccgttaagttaccgaaggtccttaacgttacccgtaccggaaggaaccgtaaccgaaacccggaaccctaaaaggttaaccctttaccccggtaagttaaccttaaccgttaaacgtaaaacgtagtaacccgtaggttacgtaacgggaacgttacggaccgttagggaccgtaccggtaccggtttccgtttaagtacgttcgtaacggtacggtaaacgtttaaaggtttaggttttagttaaagggtttaggtaacggtttaaacgggttaacggtttacttaaccggtttacgggtaaccggtttaggtaggggttacccggtacggggg

SEQ ID NO: 241470 - DNA, 531 bp, Homo sapiens
  misc_feature: GYAE6OF01B3K27.38.5.A05.1.454.CMB.1.raw
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccagcagtgacgttggtgttataattgtctctggtacacagcaccggcaatcgacccccaaatcatgatttatgaggtcactcatcggcctcgagggtttctaatcgcttctctgctatccagtctgccacacggcctcctcgacctatctctcgggctccgaggctaggaggacgaggtcttaattacgtttcgtgctagttacatactaactaaccagtaccaactactctagtctacgttcggacggacgggaccgaagtcgtacgtaccgtaccgttaacgtcacgcccaaggcctccggtcccccgtcgg

SEQ ID NO: 241471 - DNA, 808 bp, Homo sapiens
  misc_feature: GYAE6OF01CSKQI.38.5.A05.1.454.CMB.1.raw
  modified_base (234)..(234): a, c, t, g, unknown or other
  misc_feature (234)..(234): n is a, c, g, or t
tcagtcgatcacgtcacgaccggtgctcgatttagatagatagacagggggagattcccaggtgtttccattcagtgatcagcactgaacacagaggactcaccatggagttgggactgagctggtattttcctttggctattttaaaaggtgtccagtgtgaagtgcagctggtggagtcgtgggggagcttggtacagcctggcaggtccctgagctctcctgtgcagcctntggattcgagtctttgatgattagtggcatcgctacgtgggtaccagcaagccgtaccgaaggggacggtccgtggacggttcgggtctcgtaaggttattaggtggaacgtggttagggtagataggctagtcggacggtactcgtggtagggacgggtccgtattcaggtactactaccgtacgagtaacgaaccgtaaaccgacctaaaggtaaccttacccgtagttaacctaaccgttaaacaaacgttacgtaaaccgtagtttaccgtagggtaacggtaacggtaccgtaacgggaaaccggggtaacccgttaacccggggtttaccgtttttaacgggtttaacctttaacccgggtttaaggtaaaccgggttaaaacccgttaaaaaagggttttccgtttttttaaagggtaaagggttttttaaacgggtaaaacggggttttaaaaccggggttttaaaacggggttttaaccccgttaaacccgggttttaaaacgggtttaaccgggggttttaaacggttaaaccggggggttaaccccggggtttaaccgggggg

SEQ ID NO: 241472 - DNA, 645 bp, Homo sapiens
  misc_feature: GYAE6OF01B699O.38.5.A05.1.454.CMB.1.raw
  modified_base (221)..(221): a, c, t, g, unknown or other
  misc_feature (221)..(221): n is a, c, g, or t
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatccaccatctcctgcactggaaccngcagtgacgttggtgttataattgtctcctggtaccaacagcacccggcaatcgacccccaaaatcatgtatttatgaggtcactacatccggccctcgaggggtttctaatcgcttctctgcatccaagtctggcaacgtacggcctccctgacctatctcgtcgggctccgaggcgtggaacgggacgaggtacttaagtttactttcgtgtctaggtttacataattaaccaaaccacgtaccaaacctaccttcgtacgtaccgttaacggttaccggggtacgggaaccggggtaaacccgtaaacggtacccggttaaccggtaaccccggtttacccgttaaaacggttaccccgtaaccgggaacccccgtaaaccgggtccccgttccccggtccccccccggtttacccccggg

SEQ ID NO: 241473 - DNA, 689 bp, Homo sapiens
  misc_feature: GYAE6OF01ACC93.38.5.A05.1.454.CMB.1.raw
  modified_base (231)..(231): a, c, t, g, unknown or other
  misc_feature (231)..(231): n is a, c, g, or t
  modified_base (302)..(302): a, c, t, g, unknown or other
  misc_feature (302)..(302): n is a, c, g, or t
  modified_base (528)..(528): a, c, t, g, unknown or other
  misc_feature (528)..(528): n is a, c, g, or t
tcagtcgatcacgtcacgaccggtgctcgatttagatagatagacgaggggggggtctcaggaggcagcgctctcaggacatctccaccatggcctgggctctgctgctcctcaccctctcactcagggcacgagggtcctgggcccagtctcgccctggctcagcctgcctcgtgtcgtgggtcctccgtggacagtcgatccacctatcctcctgacacgtcggaaccngcaggtggtacggtttggtagttaataatttcgccttaccgtacggtaaccaacgacggccgacccggganaactaccggaacccccaaagtcagttagtactttagaggtacggtaccaccgtctacgtcccggtacccgttaggttacgggtttactaacgttccgttacttctactcggacctacgtaccgacgttcgcgacaaaccgcccggtccctcctacgacctattccgtacggtcggtcctacgaggtccgtagggacggaaggtacgttaatttaacgtttcgttcncgtacgttattacattaacgaaccaacgctaaccacttagtcgtacgttacggtacgtaccggggacggtaacccggacgtaaccgtccggttaccgtacccgtaccgttaagacccgaaccgtacccgaaccggtccctaccccgggtcccgttcccggg

SEQ ID NO: 241474 - DNA, 708 bp, Homo sapiens
  misc_feature: GYAE6OF01CQ5YB.38.5.A05.1.454.CMB.1.raw
tcagtcgatcacgtcacgaccggtgctcgatttagatagatagacaggggggggtctcaggaggcagcgctctcaggacatctccaccatggcctgggctctgctgctcctcaccctcctcactcgagggcacgagggtcctgggcccagtctcgccctggctcagcctgcctcgtgtcgtgggtctccgtggacagtcgatccacctatcctcctgcctacgtacggaaccagcgaggtcggtacggtttggttaggtttaattaaagttttcgtccttaccgtacggtaaccaacgacgaccgacccgggactaacgtcccgaacccctaaaatcaattagtatttagtacgtacggtaccactactacgtcccggtacctggtacgggtttactacgtccgttcttacctcgtcacctacttaccgtaagtccgtacggaaccaacccgtacccggtcccttacccgtacgtacctacgttccgtcggtccggtacctccggtacggtcgtaacgggaacgggtaccgtaacggttactttaagtttacgttcgtacgtctaacgttactaataaccgtaacaaccgagtacctaactactcgtagtaccgttacggtcggggaaccggtacggaaccgtaacgtccgtaacgtacccgtactaagtccgaaccgtacccgagtcccgttcccgccccggttacg

SEQ ID NO: 241475 - DNA, 685 bp, Homo sapiens
  misc_feature: GYAE6OF01DRR6M.38.5.A05.1.454.CMB.1.raw
  modified_base (224)..(224): a, c, t, g, unknown or other
  misc_feature (224)..(224): n is a, c, g, or t
tcagtcgatcacgtcacgaccggtgctcgatttagatagatagacagggggggtctcaggaggcagcgctctcaggacatctccatcatggcctgggctctgctgctcctcaccctcctcactcagggcacagggtcctgggcccagtctgccctggctcagcctgcctccgtgtctgggtcctccgtggacagtcgatcaccatcctctgcacgtacgaaccngactaggtgtacgttggttagtttaacttaagtttcgtcctcgtacgtaacctacgacgccgaccggacaccgtacccgaaccctaaatctaagttcgttaagtttagacggtacgtcctactacgtaccgtccggtcccgtaggtttacgggtttacctacgtccttacttcgtcgtcgactacgtaccgtacgttcgacgaaccaaccggtccgtccctaccgtcgtacctacttccgtccggtcggtccctacggtacggtacgtacgggaacggtaccgtagttaactttaagttttacctttcgacgttacttaacgttaatacgttaacctaacccaaccgtacaaccgttaacctcttcgagtccttaaggtccgggaacggtaacggaacctagaccgtcccggtacctacgtacgtccgaaccgtcccgaccgtccgtccccggttaccccg

SEQ ID NO: 241476 - DNA, 735 bp, Homo sapiens
  misc_feature: GYAE6OF01D7N7C.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttcctttggcttattttaaaaggtgtccagtgtgaagtgcagctggtggagtcgtgggggagcttggtacagcctggcaggtccctgagactctcctgtgcagcctcgtggattcagtcgtttgattgtattagtggctatgcacgtgggtccgacaagcctaccgaaggggacggccgtagggaggttcgggtctacggtaggttagttaggttaggaactaggtggtaggagtaggctagtcggacggtactcgtggtaggacgggtcctagttcgagctacgtcctaccaagacgaacgaaccgacgaaacgtacttacccgtagtaacgtacctaagtaaactcggaaacctaggttctaggaaggtacgtacgtacggaacggaaccgtaccggttaccgtttagttaaccgtttacgttacgggtaacgtaaaccggttaaaaggtttagttttttaacgggtaaaggtttttaaacgggtaaacgggttttaaacggggttaaaccggtttaacctttaaaccggtttaaacgggtttaaaccggggtttaaggttaaccgggggttaacccggttccgggggttaaaccccgggggggg

SEQ ID NO: 241477 - DNA, 560 bp, Homo sapiens
  misc_feature: GYAE6OF01BSIKB.38.5.A05.1.454.CMB.1.raw
  modified_base (330)..(330): a, c, t, g, unknown or other
  misc_feature (330)..(330): n is a, c, g, or t
  modified_base (433)..(433): a, c, t, g, unknown or other
  misc_feature (433)..(433): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttcctttggctattttaaaaggtgtccagtgtgaagtgcagctggtggagtctgggggaggcttggtacagcctggcaggtccctgagactctcctgtgcagcctctggattcagtctttgatgattatggcatgcacgtgggtccagcaagctccgaggggagggcctgggagtgggtctcgaggttattaggttggaacnggtggtaggatagggctagtgcggactcgtggtggaagggcctagttcagcatctccagacgaacaacgccaaagtacttcccgagtactctaacaatgaacngtcaggagaggctaggacgacgtacggtcttagtacttactggtacgtaataaagttgtttaggagtttaggaagttaaggtaagggttacttaacgtaacgttaagggtattgggtacgttacggg

SEQ ID NO: 241478 - DNA, 613 bp, Homo sapiens
  misc_feature: GYAE6OF01BXV38.38.5.A05.1.454.CMB.1.raw
  modified_base (220)..(220): a, c, t, g, unknown or other
  misc_feature (220)..(220): n is a, c, g, or t
  modified_base (440)..(440): a, c, t, g, unknown or other
  misc_feature (440)..(440): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcacatctcctgcactggaaccngcagtgacgttggtgttataattgtctctgtaccaacagccaccggcaatcgaccccaaaatcatgtattatgagtcactcatcggcctcgtagggtttctaatcgtcttctctgctatccaagtcgtagacaacgaccggtccctaccctcgacctagttcctcggtcgggccttaccgaggtctaggacggaccgaggtacttaaatttacgtttcgngtacgtacgtttacaagttaactaaccaaacctacgacctaaacctacgttctacgtacgttacggtacgggaccgggaaagggtaacccagggtacccttacggtaaccccgttacctaacggtaccgaccggtaccccgaaagggtcccctaccggtcccccgttaccggg

SEQ ID NO: 241479 - DNA, 870 bp, Homo sapiens
  misc_feature: GYAE6OF01DTPRW.38.5.A05.1.454.CMB.1.raw
  modified_base (231)..(231): a, c, t, g, unknown or other
  misc_feature (231)..(231): n is a, c, g, or t
tcagtcgatcacgtcacgaccggtgctcgatttagatagatagacgagggggggggtctcaggaggcagcgctctcaggacatctccaccatggcctgggctctgctgctcctcaccctcctcactcagggcacgagggtcctgggcccagtctcgccctggctcacgcctgccttccgtgtctgggtctccgtggacagtcgatcaccatctcctgcacgtacggaaccngcagtcgtacggttggttagttaattaaagtttcgtcttaccgtacggtaaccaacgtacgaccgacccgggactaaacgtcccgaaaccccctaaaaagtctaacgttaggttaacttttaacgcgggtaacggtacctaacgtacctaacggtcccggtcccttacgggttacgggttttaaccttaacgtccgttcctttcgtaccgtcgacctacttaaccggtagtccgttacggacctaaaccggtacccggtaccccttcccgtaacgtaccctaacgttcccgtacgggttaccgggtcccttaccggacggggttaccgtaacgggaaacgggtaacccggtacggtttaacttttaaacgttttccgtttaccgggttacttaccggtttaaccgtttaaccgtaaattaaacccggttaaaccaaacccgttaacggaacccttaaaaccgttcttaacggttacggtaacccggtttaacgggttacccgggggaaacgggaaccgtaaacccggtaacgtccccgggttaaaccgttaaacccggttaaccccggttaagaaccccggtaaccggtaaccccggtaagggtcccccgttaaccccggtccccccgttttaccgggg

SEQ ID NO: 241480 - DNA, 751 bp, Homo sapiens
  misc_feature: GYAE6OF01EQVTO.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggtattttcctttggcttattttaaaaggtgtccagtgtgaagtgcagcgtggtggagtcgtgggggagtcttggtacagccgtggctaggtccctgacgtactctcctgtcgcgacgtcctctaggtacttcgagtcgtttagatagtattagtggactagttgccgtacggtcggggtaccggacaacggtccgtaccggaagggggaaccggtcggtagggaggttcgggtctcggtaggttagttacgtaggaacgttaggtggtaaggtagtacggtcgtagtcggtacggtactcggtaggtacgggaacgggtccgtacgttcgaacggtcctacgtaccgtaccgaggaacgaaccgaaccggaacctaaacggtacctttaccgtacgtaacgtacctaaagtaaactacgaactacgttacgacggtaggcgtacgtaagggtacgtaccggtaccgttacgtttacgtaacttacggtacgtaaggtaaaccgtttaaagttacggttttaacggaaggtttaggtaaacgggtttaacgggtaaacggttaccgttaaagtttacccgggtaaggttacggtaaccgggttaccgggttaccggggtaacccgggg

SEQ ID NO: 241481 - DNA, 707 bp, Homo sapiens
  misc_feature: GYAE6OF01BQOPQ.38.5.A05.1.454.CMB.1.raw
  modified_base (223)..(223): a, c, t, g, unknown or other
  misc_feature (223)..(223): n is a, c, g, or t
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctcgccctggctcagcctgcctccgtgtctgggtctccgtggacagtcgatcaccatctcctgcactggaaccngcagtgacgttggtagttataatttgtctctggtaccacagccaccggnaactcgaccccaaatcatgtatttangagtcactcacgtcgcctcgtagggtttctacgtcgtcttctctgacactaccgagtcgtcgacacgaccggtcctaccctacgacctcgtccttacgtcgggtccttacccgacgggtactcgggtaacgggaccggtaacgggtctttaaacttttacgttttccgtagtacttacgtttaccaattaacgtaaacccgtaacggtccctaaaccctttaccgtttccccgtttaccgtttaccgttttaggtttaccggtttaccggggtaccggggtaaccggggttaacccgggttacggggtacccgttaccccggttaccgggttaaaccggtcccgtaacccgggtaccccgtacgggttacccggttaccccggttccccccggttccggttaacccccg

SEQ ID NO: 241482 - DNA, 743 bp, Homo sapiens
  misc_feature: GYAE6OF01AOQ58.38.5.A05.1.454.CMB.1.raw
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctcgtgtcgtgggtctcctggacagtcgatccacctatcctcctgcacgtacggaaccagcaggttggtacggtttgggttaggtttaattaaagttttcgtcttcctacgggtaaccaacgagaccgacccgggactaactccgacccccaaaatcattagtatttatggagtcactcacgtccggtcctacggtagggtttacctaacgttcgtctttctctgcctacttaccgaacgttcgtacggaacctaacccgtacccggtccctacccgtacgaaccctacttccgtcggttccggggcctccggacgggtcgtagggacgggtacggacggttaactttaatttacgtttctcggtacttacgttactaacgttaacctaaaccaaccgaacgtaaccctaaccttaccgttcgttacgtaccgttaccgggttccggggaaccgggaaccggggtaaaccctacgggtacccggtaaccggttaacccggttaacccgttaacgggtacccgtaacccgggaaccccgtacgggtacccctcccccggttccccggttacccgg

SEQ ID NO: 241483 - DNA, 730 bp, Homo sapiens
  misc_feature: GYAE6OF01A02XA.38.5.A05.1.454.CMB.1.raw
  modified_base (229)..(229): a, c, t, g, unknown or other
  misc_feature (229)..(229): n is a, c, g, or t
tcagtcgatcacgtcacgaccggtgctcgatttagatagatagacgaggggggggtctcaggaggcagcgctctacaggacatctccaccatggcctgggctctgctgctcctcaccctcctcactcgagggccacgagggtcctgggcccagtctgcccgtggctcagcctgcctcgtgtctggtctcgtgacagtcgactcaccatcctcctagcacgtaggaaccngcagtgtacgttggtagttattaattcgtctcgtacggtaccaacgacgccgaccggcaacgtccgaaccccctaaaatcctatagtactttagtacgtagtacacgtcacgtccgtacccgtcggttacgggtttactaacgttccgtactttactcgtagacgtacgtaccgaacgttcggacggtaacccgaacggtaccccggtcccgttacccgtacggtaccctaccgttccgtcccgtacgggtccttaccccggtacggtaccgtacggtaacgggtaaccgtacgggtttaaccctttaagtttaccgtttacctggaccttacgttaacctaagtaaccttaaccgaaccgtaacgtaccgtaaacctccgttacgtacgttaccgtacgtttccgggacgggtaacccggtaaacgtacgtcccgttaacgtacccgttaacgtaccgtacgaaccgttaccggaacgtccgtacccgtccccggttacg

SEQ ID NO: 241484 - DNA, 765 bp, Homo sapiens
  misc_feature: GYAE6OF01CTS0M.38.5.A05.1.454.CMB.1.raw
  modified_base (211)..(211): a, c, t, g, unknown or other
  misc_feature (211)..(211): n is a, c, g, or t
  modified_base (266)..(266): a, c, t, g, unknown or other
  misc_feature (266)..(266): n is a, c, g, or t
tcagtcgatcacgtcacgaccggtgctcgatttagatagatagacgagggggggggtctcagggaggcagcgctctcaggacatctccaccatggcctgggctctgctgctcctcaccctcctcactcgagggcacaggggtcctcgggcccagtctgccctggcctcagcctgcctcgtgtctgggtctccgtgacagtcgatcaccgtntcctctcgcactaggaaccagcagtgtacggttggtgtaattaagttgtctaccnggtaaccacgacgaccgaccggcaacgtccgaacccctaaaatcgaattagtattacgtggacgtacctactcgacgtccggccttacggtacgggtttactaacgttccgtctttcgtcgtcgactacctactaacgtcgtacggaaccaccgacccggtccctaccgtacgtacctacgttacccgtcggtaccggtacctaccggtacggtacccggttaagggaacccgggtaacggttaacggttaccgttttaaacgttttccgtttaaccggtcggttaactttaccggttaacttaaactaaccgtaaacccgtaaccgaacgtaccttaaacctaccggttccttacggttacccgttaacgggtccgggaaaccggggacggtaaaccgtaaaccgggttccgttaaccggtaaccccgttaaccgtaacgtacccggtaaccggtacccgtaaccggtcccggttacccccggtccccgttaaccggg

SEQ ID NO: 241485 - DNA, 904 bp, Homo sapiens
  misc_feature: GYAE6OF01DH7O2.38.5.A05.1.454.CMB.1.raw
  modified_base (293)..(293): a, c, t, g, unknown or other
  misc_feature (293)..(293): n is a, c, g, or t
tcagtcgatcacgtcacgaccggtgctcgatttagatagatagacagggggagattcccaggtgtttccattcagtgatcagcactgaacacagaggactcaccatggagttgggactgagctggtattttcctttggctattttaaaaggtgtccagtgtgaagtgcagctggtggagtcgtgggggagtcttggtacagcctggcaggtccctgagactctcctgtcgcacgcctcgtggattcgagtctttgatgtaattagtggctagtcgctacggtcggggtccganaacggtccgtaccggaaggggaacgggtccgtaggggacggttcggggtccttacggtaagggtttaagtttaacgggttagggaaaccgttaggggttaggggttaaaggtaggttaacgggtaccttaaaggttccggggaccggggttaacctttccggttaggggttaacggggaaacgggggtccccgttaaagtttaccggaaacgggtacctaacgtttccccgtaaccggaacggaaaccggaaacccgtaaacccgggtaacccgtaaaaacggttaacccttttacccccgttaaggtttaacccttaaccttaaaacgtaaaacgttaaccggtaaaccgttacggttaccgtaaggtaaccgggtaacggtaacggttacgggaaaccgggtacccgtaacccgggttacccgttttaaggttaacgtttacgttacggttaacgtaaaacgttaaaaacggttttacgttttaagggttaaaggttttaagggttaagggtttaaacggggttaaacgggtttacctttaaaccggttaacggtttaaacgggttacggtttaacggggtaccggtttaccggggtaaacccgggggg

SEQ ID NO: 241486 - DNA, 639 bp, Homo sapiens
  misc_feature: GYAE6OF01BF3MW.38.5.A05.1.454.CMB.1.raw
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctccgtggacagtcgatcaccatctcctgcactggaaccagcagtgtacgttggtagttaataatttgtctctaggtaccaacagcaccggcaatcgaccccaaatcatgtatttatgaggtcactcacgtcgtcctacgtacgggtttctaacgtcgtcgttcttcgtacgctactacccgtaagttccgtaggtaccaaaccgaccggtaccccttccctacggacctacgttccgttcgtcgggtacctcccggtaggtcgtaggtaacggacgtacgggtactttaagtttaactttcgtcgtacgtacttacgtaatacgtaaaccaaccgtagaacctaacgtacctcgtacgtcgttacgttccggtacgggaacggtaccgacgtaccgtacggtaccgtaccgtaaagtccgaaccgacccgaacgtcctcccggtcccccgttacgg

SEQ ID NO: 241487 - DNA, 736 bp, Homo sapiens
  misc_feature: GYAE6OF01DIOL3.38.5.A05.1.454.CMB.1.raw
tcagtcgatcacgtcacgaccggtgctcgatttagatagatagacaggggggggtctcaggaggcagcgctctcaggacatctccaccatggcctggctctgctgctcctcaccctcctcactcagggcacgagggtcctgggcccagtctgccctggctcagcctgcctcgtgtctggtctccgtggacagtcatccaccatccgtcctgcacgtcggaaccagcaggtcgtacggttggttagttaattaaatttcgtcttccgtacggtaacccaacgacgccgaacccggacaacgtaccgaacccccgtaaaatcctaagttagtatttacgtacgtaacggtcctactctaccgttccggtacccgttacggttaacgggtttactaacgttccgtctttctcgtcgactactaccgtaacgtcgtacggacctaaccgtacccggtcccttcccgtacgtacctacgttcccgttccggtcgggtcctaccggtagggtaccgtacgggaacggtaccggtaacgttactttaaacgttttcgttcgtacgtcgttaacgttactaacttaaccgtaaacctaaacccgtacgtaacctaaacccgtcttaccgttacgttaaccgttacgggtccgggaaccgggtaacggaaccgtaacgtccgtaccgtaacccgtaccgtagtacccgtaccgaacccgtacggtccctcccgtccccgttaccg

SEQ ID NO: 241488 - DNA, 689 bp, Homo sapiens
  misc_feature: GYAE6OF01BDRK8.38.5.A05.1.454.CMB.1.raw
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
tcagtcgatcacgtcacgaccggtgctcgatttagatagatagacgaggggggggtctcaggaggcagcgctctcaggacatctccaccatggcctgggctcgtgctgctcctcaccctcctcactcagggcacagggtcctgggcccagtctgccctggctcagcctgcctccgtgtctgggtctcctggacagtcgatcaccatcctctgcactggaaccagcagtgacgttggtgttataatttgtctctggtacacagcaccggnatcgaccccaaaatcatgatttangagtcactcacgtccgcctcgtaggggtttctaactcgtcttctctgcactaccaacgtcgtcggacaaccgacggtccctcccgtacgaccctagtcctcgtcgggtccctaccgaggtccgttagggaacgggaaccggtaacgggtacctttaaacgttttacgttttaccgtacggttaccgttacggtttacctaactttaacctaaccctaaacccgtacgaaccctaaaccttaccgttactacggtacttaacggtttaccggggaaccggggtaaacgggaaccccgtaaaggtacccgttaccggtaacccggttacccgttaaacggttaccgaaccggaccccgtaaacgggtccccgttacccgggtccccccgttacccggg

SEQ ID NO: 241489 - DNA, 781 bp, Homo sapiens
  misc_feature: GYAE6OF01CPRWE.38.5.A05.1.454.CMB.1.raw
  modified_base (268)..(268): a, c, t, g, unknown or other
  misc_feature (268)..(268): n is a, c, g, or t
tcagtcgatcacgtcacgaccggtgctcgatttagatagatagacgaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatccaccatcctcctgcacgtaggaaccagcagtgacgttggtgttaataaatttgtctcctggtaccaanacgcacccggcaatcgaccccccaaaatccatagtatttatgaggtcactcatccggccctgtagggtttctaatcgcttcctctcgactctaccaagttcgtacggccaaaccgaccggtccccttccctacggtaaccctacgtttccctccgttccggggtcctacccgtacggggtccttacgggaacgggtaaccggtaacgggtacctttaaacgttttaacgtttccgttacggtaaccgttaacggttttacctaaacgttaacttaacccggttaaaacccaacggtaccctaaaaccgttacccgttacgtttaccggtaaccgtttaccgggttttacccggggaaccggggttacccgggggtaacccccgggtaacccggtttacccgggtaaccccggttttaccgtttaaccggggtttcccgaaacccgggtacccccggttaaaccgggtcccggtttaaccccccgttccccccgggttccggtttaaccccccg

SEQ ID NO: 241490 - DNA, 841 bp, Homo sapiens
  misc_feature: GYAE6OF01BIZUM.38.5.A05.1.454.CMB.1.raw
  modified_base (803)..(803): a, c, t, g, unknown or other
  misc_feature (803)..(803): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttcctttggctatttaaaggtgtccagtgtgaagtgcagctggtggagtcgtgggggagcttggtacagcctggcaggtccctgagactctctgtgcagtcctcgtggtacttcgagtctttagattgtactttagtggactagtcgctacgtcggggtccgacaagccgtaccggaggggaacggtccgtgggacggttcgggtactacggtaagggttagtttacgggtttagggaacgtagggtttagggtaaggtaagttacgggtaccgttaggtacggggaccggtaacttccggtaggttacgggtaaacggggccctagttaccgaggtaccgtaacgtttccgaacccgaaggtaacgtaacccgaacggtaacccgtaaaacgttaacctttaccccgttaaggttaaacccttacgtaaaaccgtaaagttacccgggtaaaactacggttacctaacgggtaagtaccggtacgtaacgggtaaccgggaacccgttacccggggttaccgttttaggttaaacccgtttaccggttaagggtaccgttaaaaacgtttaaaagtttacgtttttacggggtaaaacgggttttaagaacggggttttaaacggttaaaccgggtttaaccttaccggttttaaaccggtaacggggttttanaacccgggggtttaaccggtcggggttaaacccggggg

SEQ ID NO: 241491 - DNA, 632 bp, Homo sapiens
  misc_feature: GYAE6OF01CAR9T.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggatttttccttttggctattttaaaaggtgtccagtgtgaagtgcagctggtggagtcgtggggggaggcttgggtacagcctgggcaggtccctgagactctcctgtgcagcctctggattcagtctttgatgtattagtggcagtgcacgtgggtccggcaagctccgaggggacggcctggagtgggtctcgaggttattaggtggaactaggtggtaggtagtaggctagtggacggactcgtggtaggaacgggccgtattcgagtctatcctaccgaagaacgaaccaaccgccaaagtaccttacccgtagtactactaaacaaatcgaactagtactggaagagtctagggaacggaccgtaccggtcctttagtaactttacgtcggtagtaaacgtaaaagtttagttttaggtaaggttttaagaagggtttaaaggttaacgggtactttaacgttacgttaacgggttagtacgggttccgtgggtaaccggggg

SEQ ID NO: 241492 - DNA, 719 bp, Homo sapiens
  misc_feature: GYAE6OF01EP8WA.38.5.A05.1.454.CMB.1.raw
  modified_base (216)..(216): a, c, t, g, unknown or other
  misc_feature (216)..(216): n is a, c, g, or t
  modified_base (222)..(223): a, c, t, g, unknown or other
  misc_feature (222)..(223): n is a, c, g, or t
  modified_base (236)..(236): a, c, t, g, unknown or other
  misc_feature (236)..(236): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
  modified_base (608)..(608): a, c, t, g, unknown or other
  misc_feature (608)..(608): n is a, c, g, or t
  modified_base (697)..(697): a, c, t, g, unknown or other
  misc_feature (697)..(697): n is a, c, g, or t
tcagtcgatcacgtcacgaccggtgctcgatttagatagatagacgaggggggggtctcaggaggcagcgctctcaggacatctccaccatggcctgggctctgctgcctcctcaccctctcactcgagggcacgcgggttcctgggcccagtctcgcccgtggctacagcctgcctccgtgtcgtgggtcctccgtaggacagtcgatccacctntctccnncacgtcggaaccngcgtagtcggttacgttggtagttaattaatttcgtcctacgtagtaaccaanacgccgaccgganacaccgaacccctaaatcatcgttaatttanaggtacgtactactacacgtccgtaccgtacggttagggtttacctaacgtcgttcgtttacctacgtcgaccttaacgtaacccgtaacggttcgtacgaacccgtaaccgtacccggtcccttacccgtacggtacctaccgttccggtccgtccgggtacccgttaccgacgggtacgtacgggaaaccggttaggtaccgtttaactttaaacggtttcttcgtaacggtacttagttaccaacttaacctaccaaacgtcaacttaaacnccgttactacgttcgacggtccggtaacgggaccaaccgtctaccggttaccggtactaacccgtagtaccccgacgtacccggtaacnccccggttcctacccggtaccg

SEQ ID NO: 241493 - DNA, 615 bp, Homo sapiens
  misc_feature: GYAE6OF01D63DE.38.5.A05.1.454.CMB.1.raw
  modified_base (364)..(364): a, c, t, g, unknown or other
  misc_feature (364)..(364): n is a, c, g, or t
  modified_base (406)..(406): a, c, t, g, unknown or other
  misc_feature (406)..(406): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatccacctatcctcctgcactcggaaccagcagtgtacgttggtaggttattaatttgtactcctaggtaccaacagaccgacccggacaatccgacccccaaaactcatagtatttagtgtacggtcactcacgtccgccctgtagggttctaatcgtcttcgtctntcatccgtaatcgtgacacgaccggtccctccctacgacctntactcggtcggtcctccgagacgtacggaacggacggagttacttaagtttattcgtcgtacgttacgttactaattaacgtaaccaaaccgtaacgtaactaacctacttcgtcgactttaccggtacgggacggaacggtaccgagtaccgtacgacccggttacgtaacgactaccggaaccgacgtcctcccgtccccgtacccg

SEQ ID NO: 241494 - DNA, 700 bp, Homo sapiens
  misc_feature: GYAE6OF01DKYDG.38.5.A05.1.454.CMB.1.raw
  modified_base (301)..(301): a, c, t, g, unknown or other
  misc_feature (301)..(301): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctccgtggacagtcgatccaccatcctcctgccacgtggaaccagcaggtgacgttggtgttataatttgtctcctgtaccacagcaccggcaatcgacccccaaaatcatgtatttangagtcactcatccgcctcgtagggtttctagtcgtcttctctcgctataccaagtcgtacggacaacgtaccggtccctacccgtcgtaccctacttccgttccggtacgggtcctaccggaggtcgtagggaacggacggtacggtactttaagtttactttcgtacgtacttacgtttactaacgttaactaacccaaaccgtacgacctaaacctaccgttacgttacgtaccgttaccgggttacccggggaccggggtaaccgggtaacccgtaaacgggttccccgttaaccgggtaacccccgttaacccggttaaacgttaccccgtaaccgggtaacccccggtaacgggttcccccggttccccggttcccccccggtttaacccgggg

SEQ ID NO: 241495 - DNA, 620 bp, Homo sapiens
  misc_feature: GYAE6OF01EMU3H.38.5.A05.1.454.CMB.1.raw
  modified_base (302)..(302): a, c, t, g, unknown or other
  misc_feature (302)..(302): n is a, c, g, or t
tcagtcgatcacgtcacgaccggtgctcgatttagatagatagacaggggggggtctcaggaggcagcgctctcaggacatctccaccatggcctgggctctgctgctcctcaccctctcactcagggcacgagggtcctgggcccagtctgccctggctcagcctgcctccgtgtctgggtctcctggacagtcgatcaccatcctcctgcactggaaccagcagtgacgttggtagttaataaatttgctcctggtaccaacagcacccgggacaatcgacccccaaaatcatgatttangaggtcactcatcgacctcgtagggtttctaatcgtcttctctgctagtccaaagtctaggaccaaccaccggcccttcccgtgaacctagttcctccgtgggtcctccgaggtcctaggaacggacgaggtacttaaagtttctttaccgtgtctaacgtttacaattaacgtaacaacccgtaagacctaaaccacgtctagacgttacgttacgggccgggtaacgggaaccctaagtaccgtaccggtacccgttacccgtaaagtaccgaccgggaaccccgtaagggcccttcccggaccccccgttccggg

SEQ ID NO: 241496 - DNA, 615 bp, Homo sapiens
  misc_feature: GYAE6OF01C8612.38.5.A05.1.454.CMB.1.raw
  modified_base (471)..(471): a, c, t, g, unknown or other
  misc_feature (471)..(471): n is a, c, g, or t
  modified_base (538)..(538): a, c, t, g, unknown or other
  misc_feature (538)..(538): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttcctttggctattttaaaaggtgtccagtgtgaagtgcagctggtggagtcgtggggggaggtcttgggtacagcctggcaggtccctgagactctcctgtgcagccctctggattcgagtctttgatgtaattatggcatgctacgtgggtccggacaacgcgtccgaggggaacgggccgtgggagtgggtctgaggttattaggtgaacaggtggtaaggactaggtctagtggacggtacttcgtaggtacggaacggggccgtagttcgacggtcctacgttcctaccgaagacgaaccgaacgaccaacgtaactttaccctagtactacctaaanaactagactagtctagagtagcgtaggacgaccgacgtccttagtattacgtagtagaactaaagtntttaggtaagtttaggaagttaggtaacgggttactaaccgttacgttaacggtagtacgggtcgttcggtacgggg

SEQ ID NO: 241497 - DNA, 768 bp, Homo sapiens
  misc_feature: GYAE6OF01CKIA4.38.5.A05.1.454.CMB.1.raw
  modified_base (194)..(194): a, c, t, g, unknown or other
  misc_feature (194)..(194): n is a, c, g, or t
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacgagggtcctgggcccagtctgccctggctcagcctgcctccgtgtctgggtctcctggacngtcgatccaccatcctccngcactggaaccngcagtgacggttggtgttaataatttgtctcctggtaaccaacagccgaccggcaactcgacccccaaaatcatagtactttaagtaggacggtactaactcgaacgttccggtccccttacggttaacgggggtttaccttaaacgttccggtctttcctcgttggtacctacttaccgtaaacggtccgttaacgggacctaaacccgacccgggtaccccttaccccggtacggtaaccctacgtttcccgtaccggttcggggtcccttacccgggaagggtccgttaaggggaaacggtaaccgggtaacggtaccgttttaaatttacgtttccgtacggtacgttaacgttacgtaaacgttaacctaaaccgtaacccgtaaccgactaaacccgttactaccgttacggaacttacgggttacccggggacggggtaaaccgggacccgtaacgggcttaacgggacccccgttacgttaacgacccgtaaccgtaacccgggaggtccccgtccggttcccccggttaccggg

SEQ ID NO: 241498 - DNA, 819 bp, Homo sapiens
  misc_feature: GYAE6OF01AKOGU.38.5.A05.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacgagggtcctgggcccagtctgccctggctcacgcctgcctccgtgtcgtgggtctccgtggacngtcgatccaccatctcctgcacgtcggaaccngctaggtgtacggttggtagtttaattaagtttcgtcctccgttacggtaaccaacgtacggaccggacccgggactaacgaccgaaccccctaaaatccgtagttagttatttaacgtaggtacgttcctaacgtaccgaccgttcccggtcccgtacggttacggggtttactaacgttccgttccttcctcgtctcctaactaccgtaacggtcgtacggaccgaaccggtcccgtcccttacccgtacgtacctacgttccggtaccggtccgggtacctccgggtacgggtccggtaacgggaacggggtacggacgttaaccgtttaacgtttaccgtttcgtacgtacctttaacgtacttaacgtaacgtaaccccgtaaccgtaaccgtaacccgtaaccttccgtttaccggtaacgttacccgggtttaaaccgggttccgggggaaacccggggtaaacccgggtaacccgtaaccgggttcccgttaacccggtacccggttaaaccggtaaccgttacccgaacccgggtaacccgggtaccgtcccccggtccccggtttaccccggttccccgg

SEQ ID NO: 241499 - DNA, 999 bp, Homo sapiens
  misc_feature: GYAE6OF01D0ZC0.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggtatttttccttttggcttaattttaaaggcgtccagtgtgaagtgcagtctgggtggagtcggtggggggacgtcgtttcgggtacaggtccgtgggcgtacgggttccctggacgtacctccttccgtggtcaccgacgtcccgttcgtagggttacttccgaggtttcttttaggaacttggttaactttaggtggacctaaggttccggaccgttaacgggttccggggtacccgaacggtaaaccggtccggtaaaccggggacgggggtaaaccggggttccgttgggggtaacgggttcggggtttaacccgttaacgggttaagggtttttaacgttttaaacgggttacgggtaaaaccggttaggggtttaacggggtaaaggtaacggtttacgggtacgttaacgggttcgggaaacccggggttccttttacgggtacggggttaacggggaaaccggggtttaccctaaaggtttaccgagggtaccccttacggttaaccccgtaacggtaaaccggaaaccggtaaaccccgaaacggttaaaccccgtaaaacggttaccccttttaaccggttaacgtttaaaccaaacccggtttaaaacgttaacggtaaacccgtaagttaccggttacggaaggacgtaacggtagttaccgggaaccgtaccgttaaccggtttacgtttacggttaacgtagttaggtaaaccgttaaaagttttaaggtttaattttaacgggtttaaggtttaaggttaaacggggtttaaaggttaacccggggtttaacttaaccgggtttaaacggttacgggttaacgttaccggggtttacgggtacccggggtaacccggggg

SEQ ID NO: 241500 - DNA, 752 bp, Homo sapiens
  misc_feature: GYAE6OF01ET9IX.38.5.A05.1.454.CMB.1.raw
tcagtcgatcacgtcacgaccggtgctcgatttagatagatagacaggggggggtctcaggaggcagcgctctcaggacatctccaccatggcctgggctctgctgctcctcaccctctcactcagggcacgagggtcctgggcccagtctgccctggctcagcctgcctccgtgtctgggtctccgtgacagtcgatcaccatctcctgcactggaaccagcaggtgtacgttggtagttaattaatttgtctcgtacgtaaccaacgacgcgaccggcaacgtcgaaccccaaaatcatagtatttagtaggtacgtcactcacgtccggtcctacgtagggtttactaagtccgtctttctctcgtacctactaccgtaagttccgtacggaccaaacccggtccggtcccttacccgtacgtaacccttacgttccggttccggtcgggtacccgtacccggtacgggtacggttacgggaaccggggtaacggtaaccgggtttaactttaaacttttacgtttaccgtacgtacgtttacgttaactaacgttaacctaaacccgtaaccgtaacgtaaacctaaccgttaccttacgttacgtaccgtttacggttacccggggaaccgggtaaccgggtaaacccgtacgggttacccgtaccggtaaacccgttaccgttaaacggtacccgtaaccgggtaaccccggtaaggcccccgttcccggacccccggtttaccgg

SEQ ID NO: 241501 - DNA, 830 bp, Homo sapiens
  misc_feature: GYAE6OF01DHERL.38.5.A05.1.454.CMB.1.raw
  modified_base (522)..(522): a, c, t, g, unknown or other
  misc_feature (522)..(522): n is a, c, g, or t
tcagtcgatcacgtcacgaccggtgctcgatttagatagatagacgaggggagattcccgaggtgtttccattcagtgatcagcactgaacacagaggactcaccagtggtagttggactgagcttggtactttttccgttttggacttaagttttaaaaggtcgtcctaggttgtagaagtcgctaggcgtggtggagtcggtgggggagtcgttggtaccaggccgtgggccgtacggtcccgtaggacgtaccttccgttccgtggtcgaaccgtcgtcccgttcgtacggtacttccgtagttcgtttaggattagttagttaggtcggtctagtcggtacgtcggtacggtaccgagaccgtaacggtccgtaacggggaacgggtacgggtccgtaggggtacggttacgggttgtaacggttagtttaacgtagggttaaccggaaagtcggggttaacggtaggtaacgtaggtcttaggcgggtactacggtggtaggtacggacggtacgtntacgactacgtaccgttcgaaccgaacgaacgtaacccgaaccggttaacaacgtttaccctccgtataaccgtaacaaacgtaactactacgacgttcgagagtaaccgtacgtaacgggaccgttaaccgacggtttcctttaaaggttcttaaaccgggtagttaaccgaaaaacgtttaaagttttcgggttaaaggtttaaaggtttaacggtaaggggttttaacccgttaaaggttccctttaaaacgggttacggttaacccggggtttaaacggtcgggtttacccgggggtaaaccgg

SEQ ID NO: 241502 - DNA, 757 bp, Homo sapiens
  misc_feature: GYAE6OF01EG1J1.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggtatttttcctttggcttattttaaaggtgtccagtgtgaagtgcagcgtggtggagtcggtgggggagtcgttggtacagtccgtggcctacgggtccctaggacgtacttctccgtgtcgcacgtccctcgtggtacttcgagtctttagatgtattagtcggctagtcgaccgtacggttcggggtcccgactacggtacccgtacgggaacggggtaccgggtccggttaggggacggttccgggtccttacggtaaggtttacgttacgggttaggaacgtagggttacgggtaaggagttacgggacttaggtcggtaacggtcgtttcggtacgggttaagggacggtcccgtagttccacggtactcttaccgacgtaagaccgaacgtaaccgtactaaacggtacccttaccgtagttaacctacgtaaataaagtccgtaacgtagtacggtaagacgtacgtacgtaagggaccggtacgttacggttccttaattacgtacgtgtaacctaaagttaagtttacgtttagggtaacggttaggtaacggttaacgggtaacgttaccccgtaaggttaccggtaggttacggtagggtcccggtagggtaaccccggggg

SEQ ID NO: 241503 - DNA, 758 bp, Homo sapiens
  misc_feature: GYAE6OF01CCV6J.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggtattttccttttggctaattttaaaaggtgtccagtgtgaagtgcagctggtggagtcgtgggggaggcgttgggtacaggccctgggctaggtcccctgacgtactcctccgtggtcgcagtcctcgtggattccagtctttgatgtattagtggtacagtcgccgtacgtcgggtccggacgaacgtccgtaccggaagggggtacgggtcgtagggaggtgggtacctacggtaaggtttaagttaggttacgggaacgtaagggttgggtaagggtaagttacgggtactagtcggcggtacgttcggtggtaacggaacgggtcccgtagtttccgacctacgtaccgtaccgaaggtaccgaaccaaccgtaccgaaacgtaaccgtaccgacgttgggcggtacgtacggaactacgtaacggtacggaacccggtcgtacgggacgggtaacggaccggtaacccggaaccgtaccggttcggtacggtttaccgttaccggtttacgtcgggtacggacccgggaacgtaccccgcccccggtaaggtcggggtacgggtaccctaacgggtacggggtacgggaacgtaccggttaccggttaaccgtttcgggtaacccggg

SEQ ID NO: 241504 - DNA, 767 bp, Homo sapiens
  misc_feature: GYAE6OF01B60MU.38.5.A05.1.454.CMB.1.raw
tcagtcgatcacgtcacgaccggtgctcgatttagatagatagacgagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatccaccatcctcctgccacgtacggacccagcgagtcgtacggttggttaggttaacttaaatttcgtcttccgtacggtaaccaacgtacgccgacccggacaacgtcgaccccctaaatcactagtatttagtaggtacggtacctacgtactaccgtccggtaccccgttacggtacggggtttaccttaacgtccgtcgtttacctcgtcgactacgttaccgtaacggtctacggacccgaaccgtacccggtccccttacccgtacgtaccctagttcccgttcggtcgggtacccgtaccggtacggtcggtacggaacgggtaaccgtacggttaaccgtttaaagttccgtttcgtacggttacgttactttagtaacttacttaaaccggaacccgtaagaaacccgtacgttaaccctacggtacgtaccggttacgttaccggggaccggtaaacgggtaacccggacgttaaccggtacccggtaacccggtacccgtaaccggtaccgtaaccgtaccccggaagtccccgtaccccggcccccggttacccgg

SEQ ID NO: 241505 - DNA, 757 bp, Homo sapiens
  misc_feature: GYAE6OF01C0MJG.38.5.A05.1.454.CMB.1.raw
  modified_base (135)..(135): a, c, t, g, unknown or other
  misc_feature (135)..(135): n is a, c, g, or t
  modified_base (189)..(189): a, c, t, g, unknown or other
  misc_feature (189)..(189): n is a, c, g, or t
  modified_base (211)..(211): a, c, t, g, unknown or other
  misc_feature (211)..(211): n is a, c, g, or t
  modified_base (235)..(235): a, c, t, g, unknown or other
  misc_feature (235)..(235): n is a, c, g, or t
tcagtcgatcacgtcacgaccggtgctcgatttagatagatagacgagggggggggtctcaggaggcagcgctctcaggacatctccaccatggcctgggctctgctgctcctcaccctctcactcagggcacgngggtcctgggcccagtctcgccctggctcacgcctgcctcgtgtcgtcgggtcncgtggacaggtcactccacctntcctctcgacctacgacggaaccnggactaaggtcggttaacggtttgggttaggttttaaatttaacgttttcggtccttccggtacggtaaaccaacggaccggacccggaacccgggacaaaccggttaccccgaaaacccccttaaaagtacctagtttaacggtttaacttttaaggacgggtaacggtacctaacggtcctaaccggttccccggaccgtttacgggtaacgggttttcaactttccgtctttcgtacgtcggaactactacccgtaacgttccgacgtaaaccgaaccggtccggaccctttaccaccgtaaccttacgttccgtaccgggtaccgtcccgttaacccggacgggtacgtaacggggtaacggtaacgtacgggtttaactttaacgtttccggttactacgtaccgttataactactaactaaccacgtacaactaccgtatctacgtctaggtcggacgacgtacgcgtaacgcgtaccgtacgagtaccacgaccgacgtcccgacggtcccctcg

SEQ ID NO: 241506 - DNA, 870 bp, Homo sapiens
  misc_feature: GYAE6OF01D6F45.38.5.A05.1.454.CMB.1.raw
tcagtcgatcacgtcacgaccggtgctcgatttagatagatagacgagggggggggtctcaggaggcagcgctctcaggacatctccaccatggcctgggctctgctgctcctcaccctcctcactcagggcacgagggtcctgggcccagtctgccctggctcagcctgcctccgtgtctgggtctcctggacagtcgatccacctattcctcctgacctacgtacggaaaccaggctaggttcggtaacggttttggggttaggtttaaatttaaagttttcgttaccgttccgttacggtaaccaaacgacggaccgaacccggggactaaaccgttaccgaacccccctaaaaattccaagttacggttaattttaagtcggtaacggtacctacgtacgtaccgtcccgggtaccccgttacgggttacggggttttaaccttaacggttccggtctttaccgttacgtcgtaccgtaactcccgtaaagttccgtaacgggtaccctaaacccggtccgtccccgttacccgtacggaaccctacgttaccgttcggtaccgggtcctacccggaggtccggtaggtaacgggaccggtaacgttacgtttaaactttacgtttacggtacgttacgttacgttaacttacgtaaacttaaccgaaccgtacgtaactaaaccgttaccttaccgttacgttaaccgggttaccggtttacccgggggaaacgggtaacccgggtaaaccgtaccgggtaacccgtacccggttaaacccggttacccgttaaacccggtaccggtaacccgtaaccccggtaaaccgggttccccgtaaccccgtcccccgggtttaacccgg

SEQ ID NO: 241507 - DNA, 635 bp, Homo sapiens
  misc_feature: GYAE6OF01DAP1N.38.5.A05.1.454.CMB.1.raw
  modified_base (151)..(151): a, c, t, g, unknown or other
  misc_feature (151)..(151): n is a, c, g, or t
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (366)..(366): a, c, t, g, unknown or other
  misc_feature (366)..(366): n is a, c, g, or t
  modified_base (571)..(571): a, c, t, g, unknown or other
  misc_feature (571)..(571): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttcctttggctattttaaaaggngtccagtgtagaagtgcagctggtggagtcgtgggggagcgttggacagtcctaggcaggtccctagacgactcctccgtgtcgcacgcctcgtggtatccgagtctttgatgtattagnggacagtcgcacgtgggccgnaacggctcggaagggacggctggcgtgggtcctgagttatacgtggaacaggtggtaagagtacggtactaagnggaccggtactcggtaggtacgggaacggtccgtaattcgacggtactagtacctacgaaggtacgaaccgaccaaccgtaagtaacctttacccgagttaactaacccttaaagaaacgttacgaaacgtactacggtaggaagtcgacgtagggacgtaacccggtgtacctttagtaacttacgaggtacaacgtaaagttnttaggtaacgttagaacgtaggttacgattaacgtaccggttaagtagacggtgtcggtacggg

SEQ ID NO: 241508 - DNA, 696 bp, Homo sapiens
  misc_feature: GYAE6OF01B845M.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggtatttttccttttggcttattttaaaggtgtccagtgtgaagtgcagcgtggtggagtcgtggggggagtcttggtacagccgtggcagggtccctgacgacttctcctgtgcacgcctcgtggtattcgagttcgtttagattgtattagtggactagttcgccgtacggtcggggtcccgacgaacggtccgtaccgggaaggggaacgggtccgtagggtacggttcgggtctacggtaggttagtttaggtacggaaacgtgggtagggtaggtaagtaggtctaagtcggacggtacgtcggtaagggtaacggcctagttcgagactactactaccgaagaacgaaccgaaccgtaccgaaagttaccttaccgtagttaacctactaaacgaagttaacgaacgtacgttacgaggagtacgtcgtaacggacggtacgtaccggttacttagttacgttacgtaggtactaagtaaagttgtttaggtaaggttaaggtaggttaggttacggttataaccgttaggttacggtacgtagggccgttgggaacgggtaaccgg

SEQ ID NO: 241509 - DNA, 877 bp, Homo sapiens
  misc_feature: GYAE6OF01EWE2C.38.5.A05.1.454.CMB.1.raw
  modified_base (283)..(283): a, c, t, g, unknown or other
  misc_feature (283)..(283): n is a, c, g, or t
tcagtcgatcacgtcacgaccggtgctcgatttagatagatagacagggggagattcccaggtgtttccattcagtgatcagcactgaacacagaggactcaccatggagttgggactgagcttggtatttttccttttggacttaattttaaaaggtgtccagttgtgaagtgcagctggtggagtcgtgggggagtcttggtacagccgtggctacggtccctgagtctctccgtgtcgcacgtcctcgtggtacttcgagtcgtttagattgtatttagnggctagtcgaccgtacggttcggggtacccgacgaacggtccgtaccgggaagggggaccggtccggtagggtaggttcgggtacgtacggtaaggtttagttacgggttaacggaacgttagggtagggtaagtagtaggcttagcggcgtactcggtaggtacggtacggtaccgtacgttacgcgtactaccgtacgaccgtaaggaaaccgtaccgaaaccggtaactaaacggttaaccctttacccggtaagtttaaccctaccgttaaaacgtaacgttaaccggaaaccttcgggttaaccaaggggtagtaaccggttaccgttaaagggggaaccccggtttaacgtacccgggttttaccgttttaaaggtttaacccgtttaacgggttaacggtaaacggttaaaacgtttttaaaacgggtttaacggttttttaaaggggtaaaggttttttaaaacccggggaaggttttaaaacggggtttaaaccgggtttaccctttaaaacccggggtttaacgggttaacggggtttaacgttaccggggtttaaacccggtccgggggtttaaaacccgggg

SEQ ID NO: 241510 - DNA, 611 bp, Homo sapiens
  misc_feature: GYAE6OF01A5N4H.38.5.A05.1.454.CMB.1.raw
  modified_base (313)..(313): a, c, t, g, unknown or other
  misc_feature (313)..(313): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacgagggtcctgggcccagtctcgccctggctcagcctgcctccgtgtctgggtctcgtggacagtcgatcaccatctcctgcactggaaccagcagtgacgttggtagttataattgtctcgtacgtaccaacacgccgacccgggcaactccgaacccctaaagtctagtgtaactttagnggacgtacactcagtcccgccgttacggtagggtttactacgtcgtacttctctcgctacgtaccaagtcgtcggtaccaaccgtccgccctacgtaccgactcgttacgtcggtcggactcgtagcgtaggaacggacgtacggttacttaagtttcttacgtgtacgtaacttacagttaaccaacgaaccacgtaacactactcctagtactaggttccggacggaacggtacgaccgtacgtacggtccgtacgacgacctacggaccaacggtcctcccggtcccgtacccgg

SEQ ID NO: 241511 - DNA, 767 bp, Homo sapiens
  misc_feature: GYAE6OF01B6AER.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggatttttccttttggcttattttaaaaggtgtccagtgtgaagtgcagcgtggtggagtcggtagggggagtcgttggtacgagtccgtggacgaccggtcccgtaggacgtaccttccgttccgttggtgaccgtaccgtcccgttcgtagggttacttaccgagtttcgtttagagttaggttattaggcggtactagtcgacctacgggtcggggtcccgacgtaacgcccgtaacgggaaggggacggtccggtagggtacggtcgggtactacggtaggttagtttacgggtacggtaacgtagggtaggtaaggtagtacggtacgtagtcggacggtacgtcgtggtaacggacggtctagttacgacgtctacgtctacgaagtaaccgaacgaaccgaactaaggtacccttaccgtagttaacctaaccgtaaacgtaaagtacgaaccgtgttacgaggaacggtcgtaacgtacggacggtaaccgtcggttatttacgtaacttgtaacggaacgttaaagttaagtttagtttaaggtacgtttaagggaaggtttaacggttaaacggttccttaaacgggtttaggtaacggttaggtcgggtaaccggttcggggtaaacccgggg

SEQ ID NO: 241512 - DNA, 729 bp, Homo sapiens
  misc_feature: GYAE6OF01B8FV7.38.5.A05.1.454.CMB.1.raw
  modified_base (314)..(314): a, c, t, g, unknown or other
  misc_feature (314)..(314): n is a, c, g, or t
tcagtcgatcacgtcacgaccggtgctcgatttagatagatagacagggggagattcccaggtgtttccattcagtgatcagcactgaacacagaggactcaccatggagttgggactgagctggtattttcctttggcttaattttaaaggtgtccagtgtgaagtgcagcgtgggtggagtcggtggggggaggtcgttggtacacggccgtgggcacggtccctggacgactctccgtgtgcacgtcctcgtaggtactcgagtctttgattgtattagtggacagtcgaccgtacggtcggggtaccganaacggtcccgtaccgggaggggtaaccgggtccggtagggtacggtcgggtacgttacggtaaggtttacgttagggtacggaaacgtagggtagggtaaggtaacgtacggtacgtaaggtcgggaccggtactcggtagggtacgggaacgggtcctagtcgacgctacgttccaccgaggacaaccgaacgtacgaaagtaccttccgtatactacgtaaactaagtacgtaacacgttacgagaacgtacgcgtaaggaaccggaccgtacggtaccttaggttaaccttagtacggtaagtaaaccgttaaaggtttctttaagggttaagttaagggtaaggttacggttacgggttaccttaacggttacggttaacggtaggtacggtaccgggtccggtacggggg

SEQ ID NO: 241513 - DNA, 847 bp, Homo sapiens
  misc_feature: GYAE6OF01ES9HV.38.5.A05.1.454.CMB.1.raw
  modified_base (208)..(208): a, c, t, g, unknown or other
  misc_feature (208)..(208): n is a, c, g, or t
tcagtcgatcacgtcacgaccggtgctcgatttagatagatagacagggggagattcccaggtgtttccattcagtgatcagcactgaacacagaggactcaccatggagttgggactgagctggtatttttccgtttggcttaatttttaaaaggtgtccagtgtgaagtgcagctggtggagtcgtggggggagtcgttaggtacnggtccgtggccgtacggttcccctgacgaccttcctccgtagtgccgacgtccctcgtggtattcgagttctttagatagtacttagtcggacagttccgacgaacggttcggggtacccggacaacggtccgtaaccggaggggtaacgggtccgtagggtaggtcggtacctacggtaggtttaacgtttaggtacggaaacgttagggtagggtaggtaagttacggtacttagggtacggtaacccggtagttacggttagggtaacgggaacgggtacccgtttaagttaccgaacgtaccgttaacccgttcgtaaccgaacgggtaaccgtaaaccggaaaccgtaacccggtaaagttaaaccccgtttacccgtaacggttaaaccttaaccgtaaaacgtaacgtaaaccgtaaaccggttagtaccgtaagggtaacacgggtacgtaacggaccggttaacggtaccgtttacccgttattaaccgttaacgttacggaacgttaaaacgttaaaggttaacgtttttagggtaaagtttaaggttaaccgggttaaggtaccggtttaaaccctacggttaacccggttaaggtacgttacgggttaccggtggtaaacccggggg

SEQ ID NO: 241514 - DNA, 897 bp, Homo sapiens
  misc_feature: GYAE6OF01DDLIF.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggtatttttcctttggctaattttaaaaggtgtccagtgtgaagtgcagcgtggtggtagtcgtgggggagtcttggtacacgccgtgggccacgggtcccctggacgtaccttccttcccgtggtcgaccgtacgtccccgttgtcgggtaactttccgtaggttccgttttagggaattaggtaatttacgtcgggacctaacgttcggaccgttaccgggttccgggggtacccggaaccgtaacggtcccggtaacccggggaaacggggggtaaccgggtcccggttaggggggtacggttcgggttccgttcgggtaaagggttttacgtttaacgggtaagggtaacgttagggttagggtaaggtacgtaggtacttaacggtgggacccgttaacgttcggtagggtacgggaaccggggtcctagtttcggacgtacctacgttacccgaacgaacggtaaccaaacccgtaacccgaaccgttaaacggttaccctttacccgttaagtaacctttaaccgaaacgttaaagttaccgaaaccttggtaaccgagtaaccggtggaacgttaagggaaccggtacccgttacggtttaccttaggtttaacgtacgtacggtaacgtaaaggtttaaacgttttggtttaaaggtaaggtttaacgggttaaaggtttaaccggggttaaaccggttactttaaacgggtaaccgtttaaggggttacgttacggggtaacccggttgggtaaaccccggggg

SEQ ID NO: 241515 - DNA, 889 bp, Homo sapiens
  misc_feature: GYAE6OF01BSTKN.38.5.A05.1.454.CMB.1.raw
  modified_base (263)..(263): a, c, t, g, unknown or other
  misc_feature (263)..(263): n is a, c, g, or t
  modified_base (488)..(488): a, c, t, g, unknown or other
  misc_feature (488)..(488): n is a, c, g, or t
tcagtcgatcacgtcacgaccggtgctcgatttagatagatagacagggggagattcccaggtgtttccattcagtgatcagcactgaacacagaggactcaccatggagttgggactgagctggtattttcctttggacttaattttaaaaggtgtcctagtgtgaagtgcagtcgtgggtggtaggtcggtggggggagtcgttaggtacacgtccgtggccgtacgggtccctggacgtaccttcgttccgtggtcgacncggtcccttgtaggtacttcgacgtttcttaaggtattaggtaattttacggcggtactagtacgtaccgtagggtccggggtaccggacgtaacggtcccgtaacggggaacgggggtaaccgggtccggtaggggtacgggttcggtaccgttaacgggtaagggtttaacgttacgggttaacggtaaaggtagggtacggggttaaggtaggtaacgggtntaggtacgggtccggtaacttcgggttaacggaacgggggtaaccgggtccgttaagttacgaaggtcctacgtaccggtaacaacggtaacgaacccgtaacccgtaacttaaacgttaacccgttacgtaaaccgtaaccttaagtaaaaccgtaaacgtaacgttaaccgaggtttaccgaaggtaaccgggtaggttccgaagggtaacccgtaacccgggtttaccggttaactttaggtttaacccgtaggttacgggtaaaccgttaaaaggtttaaatttaacgggttttaagggttaaaggtttaagggaggtttaaacgggtttaaccttaggttaaccgtttaaaggcggtttaaacggggtcggttaacggggaccggttaaccggggg

SEQ ID NO: 241516 - DNA, 745 bp, Homo sapiens
  misc_feature: GYAE6OF01DLKWZ.38.5.A05.1.454.CMB.1.raw
  modified_base (442)..(442): a, c, t, g, unknown or other
  misc_feature (442)..(442): n is a, c, g, or t
tcagtcgatcacgtcacgaccggtgctcgatttagatagatagacgaggggggggtctcaggaggcagcgctctcaggacatctccaccatggcctgggctctgctgcctcctcacccctcctcactcagggccacgagggttcctcgggccctaggttcctcgccccgtggcctcacgccttgcccttcggtgttcgtcgggtcctccgtaggaccaggtcgactccacctagtccctcctagccgtacgtacggaaccagcgtaaggtcggttacgggttggttaggttaattaaatttcgttacctccgtacggtacccaacgtacgccgtaacccgggtacaactccgaaccccctaaaatctaacgtagttattagtacggtacgctactctacgtccggtaccctacggtacgggttctactccgtcttactctanacctactacctaaggtccgtacgaccgacgacccggtcccgtctaccgtaaccgtcctttccgtccggtaccgggtcctacggacggtcgtaacgggacggaccggtaacggttactttaagtttaacgtcgtacgtacgtactagtaactaaacgtacccaaacgcgtaacctaactctacgtcgtacggttaccgtacggggaccgggtaacgtacggacctaccggtacggttaacccgaccgttaacgtacccggacggtaaccccggtacgccccggttcccgtccccgggttacccg

SEQ ID NO: 241517 - DNA, 771 bp, Homo sapiens
  misc_feature: GYAE6OF01ACOBU.38.5.A05.1.454.CMB.1.raw
  modified_base (150)..(150): a, c, t, g, unknown or other
  misc_feature (150)..(150): n is a, c, g, or t
  modified_base (201)..(201): a, c, t, g, unknown or other
  misc_feature (201)..(201): n is a, c, g, or t
  modified_base (553)..(553): a, c, t, g, unknown or other
  misc_feature (553)..(553): n is a, c, g, or t
tcagtcgatcacgtcacgaccggtgctcgatttagatagatagacagggggagattcccaggtgttccattcagtgatcagcactgaacacagaggactcaccatggagttgggactgagctggattttcctttggctattttaaaaggngtccagtgtgaagtgcagactggtggagtcgtgggggaggtcttgggtacngcctgggctagggtccctgagacctctcctggcgcagtcctcgtggtacttcagtctttagatgtatttacgcggtacatcgcgtacgttcggggtcccgataacggtcctaccggtaagggggacggtccgtgggtacggtcgggttactacggtacgttagtttaggtcggtaaaagtcgggttgggtaacggtactaacgggtcgtaacggtcgtacgggtaacttcgggttggtacgggtaaccgggccgttaagttacgaacgtaccgtagttaccgtacccgaagggtaacgtacccgaaaccgggtacctaaacgtaccctttacccgtagtaacctacgtaaanaacgttacgaaccttgaaccgtacggagttacgcgttacggaacgggttaccttaaccgggtccttttaacggttattaaaccggtggtaaacgtaaccgttaaagggtttacggttttaggaaacgttttaacgggtaaggttaacggggttaaatccccgtttaaacgtaggggtttaacccgtaagtcgggtttaaaccgggcggttaccggggg

SEQ ID NO: 241518 - DNA, 753 bp, Homo sapiens
  misc_feature: GYAE6OF01CGFN1.38.5.A05.1.454.CMB.1.raw
  modified_base (220)..(220): a, c, t, g, unknown or other
  misc_feature (220)..(220): n is a, c, g, or t
  modified_base (289)..(289): a, c, t, g, unknown or other
  misc_feature (289)..(289): n is a, c, g, or t
tcagtcgatcacgtcacgaccggtgctcgatttagatagatagacgagggggagattcccaggtgtttccattcagtgatcagcactgaacacagaggactcaccagtggagttgggactggagctggtatttttccgtttggacttaagttttaaaggtgtccaggttgtagaagtgcagtcgtgggtggacggtcgggtagggggagtcgttggtacnggtccgtggcgtacggtcctagacgtctccgtcctaggtcgacgtacgtcctgtaggtacttcgagttnttgagtgtattaggcgtatagtcgacgtacgggtccggcgacgacggtaccgacgggagggtacggcgtggtacgggttcgtacgtaggtaggttaagttacgggtaacggaggttaaggttacgggaaggtacggtacggtagtacggttacggacggtttacgtagggtacggtacgggtaccggattacgtacgagaccgttctaccgtaacgaacggtacgaaccgaaccgtaaccgtaacgttaccttacgaagttacttaaccgaagtaacgtaacgtaagtaacgttcggaagacggtaacgtaggaccggaacggtccggtagttacgttactagtaccgtagtaaccgtaaattacggtttaagttgggttaaacgttaggaacgggtttaaacggttacggttagttaaacggtacgttaggtacgggtacggtacgggtcgggtaacccgggg

SEQ ID NO: 241519 - DNA, 715 bp, Homo sapiens
  misc_feature: GYAE6OF01BIOVO.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttcctttggctattttaaaaggtgtccagtgtgaacgtgcagctggtggagtcggtgggggagtcttggtacagtcctggccaggtccctgacgacctctcctgtgacgacgtcctgtggtcttcgagttcgtttagagttagtagttagtcggactagtcgaccgtacggtcggggtaccggacgtaacggccgtaccgggaggggtaaccggtccggtagggtacgggtcggtacctaggtaggtttagttaggtacggtaagtagggtaggtaggtaggtacggtacgtaggtccgggacgtacgtaggtggtaagggacccgggtcgttacgtacgtacgtactacgttccgaacgaacggtacaaaccgtacaaccgtaacttaccgttacctagtaacctacctaaataacggtaactacgtaaccgttcgaggtaagcgtaacggacggtacggaacccggtcgttacgtttagtacccgttagtacgtaacgtaagttaagttagtttacggttaagttaaggtagttacgggtacttacgtacgttaggtacgttggacgggtcgtacgggtaccggg

SEQ ID NO: 241520 - DNA, 862 bp, Homo sapiens
  misc_feature: GYAE6OF01BIG43.38.5.A05.1.454.CMB.1.raw
  modified_base (212)..(212): a, c, t, g, unknown or other
  misc_feature (212)..(212): n is a, c, g, or t
tcagtcgatcacgtcacgaccggtgctcgatttagatagatagacagggggagattctcaggtgtttccattcagtgatcagcactgaacacagaggactcaccatggagttggactgagctggtatttttccgtttggtcttaagtttttaaaaggtgtaccagttgtagaagtgcagctgggtggagtcgtgggggagtcgttggtaccnggtcctggctacggtccctgacgtctccgtctgtcgctacgccttcgtggtacttccgagttcgttttagagttgtaatttagcggatagtcgaccgtacgggtcggtaccggactaacggccggtaacgggacggggtaaccgggtccgttaggggacggtttcggggaccttagggtaaaggtttacgtttagggtaacggaaacgggtgggttaggaaggggtaacgtaggccttaggtacggtaccggtagttcggtaggggtaacggtaaccgggggtcctaagttccggacggtacctacgtaccgtacgaaacgaaccggaaccgtaaacgtaacccggtaaacgtttaaccgttaccgttagttaacctaacgttaaaacgtaaacgttacgtaacgtacgttaacgaacggaagtaaccggttaggaaccgggtacgggtaacccgtaacgggttttacccgtttacgttaggtttaacccggttaggtaaacccggtaaaggttttaaaacggttttaggtttaacggttaagggttttaaaggtaaaggggtttaaccgttaaaccgggtttacgtttaaaccgggtttaacgggaacgggtttaacgggttaaccgggttccggggttaaaccggggg

SEQ ID NO: 241521 - DNA, 819 bp, Homo sapiens
  misc_feature: GYAE6OF01DCKQR.38.5.A05.1.454.CMB.1.raw
  modified_base (266)..(266): a, c, t, g, unknown or other
  misc_feature (266)..(266): n is a, c, g, or t
tcagtcgatcacgtcacgaccggtgctcgatttagatagatagacagggggagattcccaggtgtttccattcagtgatcagcactgaacacagaggactcaccatggagttgggactgagctggtattttcctttggcttagttttaaaaggtgtccagtggttagaagtcgcagtcgtgggtggagtcgtgggggaggtctttagggacaggtccgtgggccgtacggtcccttaggacgtacctctccgtgtgccgagtcctntggattcgtagtcttttagagttagtaatttgtacggctagtaccgtacgtacggtccggggtacccggagtaacggtcccgtaacgggaacggggttacgggacccggttgggtaacggggttacggtaccgttacggtagggtttaacgttaacgggtttagggaaactagggttacgggtaaggtacggttaacgggttacgtaacggttagggacccgggttaacttcggttagggtaacgggaaccgggggtaccttacggttaccggataccgtacgttaccgtaccgtaacggaacgaaccgtaacgaaaccgtaaacgttaaccttaccggtatacgtaacgtaaactaaacgttaacgaactacgtacgtacaaggtacgccgtaaggaccgacgtaccggttccgttaagttacttacgtacgtaacgtacgttaaagttaccggttaggtttaaagttagggttaaacggttaggttaaacggttaccttaaacgttaacgttacgggttaataccggggttgtaacccgggttaaccgggg

SEQ ID NO: 241522 - DNA, 717 bp, Homo sapiens
  misc_feature: GYAE6OF01A8XXG.38.5.A05.1.454.CMB.1.raw
  modified_base (468)..(468): a, c, t, g, unknown or other
  misc_feature (468)..(468): n is a, c, g, or t
  modified_base (509)..(509): a, c, t, g, unknown or other
  misc_feature (509)..(509): n is a, c, g, or t
tcagtcgatcacgtcacgaccggtgctcgatttagatagatagacagggggagattcccaggtgtttccattcagtgatcagcactgaacacagaggactcaccatggagttgggactgagctggtatttttccttttggcttaattttaaaaggtgtccagtgtgaagtgcagcgtgggtggaggttcggtggggggaggtcgttggtacaggtccgtggccacggtccctggacgtacctccttccgtgtcgaccacgtcccttcgtggtacttcgagtcttttgattgtattagtggactagtcgcctacggtcggggtccgacacggtccgtaccggaaggggacggtcgtagggtagggtcggtctacggtaaggttagtttaggttacgaacggtaggtagggtaaggagtagctagtcggcgtacgtcgtaggtacggaacgggcctagtcgagctctacncgaagacgacaacgacaaagtacttcctagtactacgtaanactacgaactagtcgtagagtacgcgtacgggaacgtaccgtaccggttagtttcgttaacgttacgttgtaaaccggtaattaaaggtttgttttaagggttaaacggtttaaggtaaggtttaaacggggttaacggtttacccttaaacgggttaacggttaacggttaaggttaccgggtaacggtttcccggggtaaacgggg

SEQ ID NO: 241523 - DNA, 844 bp, Homo sapiens
  misc_feature: GYAE6OF01A3W3W.38.5.A05.1.454.CMB.1.raw
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctcgccctggctcacgtcctcgcctccgtgtcgtcggggtcctccgtaggactacgtcgactccaccattcctcctcgactaacgtacggaaccagcgtagtcggtacggtttggtaggttaattaaagtttcggtccttaccgtacggtaaccaacgacgtaccgaacccgggactaaccgtacccggaaccccctaaaatccaattagttaactttagtacggtacgtacctactaccgtacgtcccggacccgttacggttacggggtttaactacgtccgttacttcgtctcgtactactacctacgtctacgaaccgtaaccgtacccgtcccttaccgacgtaacctcgttaccgttcggtacggtccctacggacggtaccgtaaggaccgggtaacggtacgttacgttttaaacgtttctttacgtacgttagttacgttaactacgttaaaccttaacccgaaaccgtaccgtaacctaaccctttaccgttaacggtaccgttaacgttacccgggttaaccggggtacccggggtaaaccgggttaaacccggttaaccgggttaaccccggttacccccgggttaaaccgttaaaccggtaccccgggaacccggtaacccccggtaaacggttccccccggtttaacccccggtcccccccggtttaccgggttaaccccc

SEQ ID NO: 241524 - DNA, 788 bp, Homo sapiens
  misc_feature: GYAE6OF01ARDQJ.38.5.A05.1.454.CMB.1.raw
tcagtcgatcacgtcacgaccggtgctcgatttagatagatagacagggggggggtctcaggaggcagcgctctcaggacatctccaccatggcctgggctctgctgctcctcaccctcctcactcgagggcacgagggtcctcgggcccagtctcgcccctggctcacgcctgcctccgtgtcgtgggttcctcgtggacagtcgatccaccatcctcctgcacgtacggaaccagcaggtggtacgttggtgttaattaagtttcgtctccgtggtaaccaacgacgccgacccgggactaacgtccgaaccccctaaaatctaagtgttaattttacgtgtaacggtacctacgtacacgtccggcccgttacggtacgggttttactaacgttccgtccttcgtctcgacctactaccgtacgttcgtacgaccaaacccgtccggtcccttacccgtaccgacccttacgttcccgtacggtaccggggtccccttaccggaacgggtccggttacgggaacgggtaaccgggttagtaaccgttttaaattttacgtttccgtacgtaccttaaggttaccgttaagttaaccgtaaccctaaaccgtacgtaacctaacctaccttcggttacctccgtttacgggtacccggggtaacgggtaaacccgggtaaccccgtaacggttacccgttaaacccggttaacccgttaacggtacccgaacccgtaacccgggtaaccggccccttacccggtccccccgggttcctaacccggg

SEQ ID NO: 241525 - DNA, 1074 bp, Homo sapiens
  misc_feature: GYAE6OF01DZMEU.38.5.A05.1.454.CMB.1.raw
  modified_base (235)..(235): a, c, t, g, unknown or other
  misc_feature (235)..(235): n is a, c, g, or t
tcagtcgatcacgtcacgaccggtgctcgatttagatagatagacagggggagattcccaggtgtttccattcagtgatcagcactgaacacgagaggactcaccatggagttgggactgagctggtatttttcctttggcttaattttaaaggtgtcagtgtagagtgcagctggtgagtcgtgggggagcttggacagccgtggcacggtccctgagccttctccttggtacncgacgcccgttcgtggtaacttcgtacgtcttttagatagttaacttagtggactagtcgacctaggtcgggtacccgtacaacggccgtaccggaaacgggggacggtaccggtgggtacgggtttcggggacttacggtaagggtttaaagtttcgggtaaacggtaaacggtaagggttaggggtaaagggtaagtaccgggtacgtttaaggtacggggtaaccgttaacccgtttggtaacggggttacgggtaaacccggggttcgtaaaccgttttacggaaacccgtaccgttaaaccgtttacccgaaccggttaaacggaacccgtaaaacccgggttaaaacccccgggaaacccggttaaaaaccgggttttaacccctttttaaacccccgggtttaaaacggttaaacccgtttttaaaccccttaaaaccggttaaaaacggttaacccccggttaaagggtaaccgttttaccggtaacggtaccggggtaaaccgttcgggttaaacggggtaaaacccgggttaccccgggttaacccgggtttaacccgttttaacgggtttaaccccgtttaaggttacccgggttaaaaacggtttaaaaacccggttaacgggttttttaaaaaggggtttttaacggggtttaaaacgggtttttaaaagggtttaaaacggggtttaaaaccggggggtttttaaaaccgggtttaaacccgtttaaaaccggggtttttaaaccgggtttaaacccggggtttaaggggtttaaacccggggttaaccccgggttttacgggggggttaaaaccccccgggggg

SEQ ID NO: 241526 - DNA, 723 bp, Homo sapiens
  misc_feature: GYAE6OF01AHZXP.38.5.A05.1.454.CMB.1.raw
tcagtcgatcacgtcacgaccggtgctcgatttagatagatagacgagggggggggtctcaggaggcagcgctctcaggacatctccaccatggcctgggctctgctcgctcctcaccctcctcactcagggcacagggtcctgggcccagtctcgccctggctcagcctcgcctccgtgtctgggtctcgtggacagtcgatcaccatctcctgcacgtacggaaccagcagtcggtacggttgggttagttaattaaattttcgtccttaccgttacggtaacccaaacgacggccgtaacccggggacaaacgtcccgaacccccaaaattctattagtatttagaggtacggtactacctcgaccggtccggcccgttacggtagggttttactacgtccgtcttacgtctcgactactacgtacgtctacggaccaaccgcccggtacctcctacgacctattccgtccggtcggaccgtccgaggtacggtagggaacgggacgtaacgggttcttttaaacgtttacgtttaccgtcggtaagttaccgttaactacttaaacctaaccgaaccaactaaccctaacctacgttcgttacgaccggttaggttcccggggacggtaacccgggacggtaaaccgtccgtaaccggttacctaaccgtaccgttacgaaccgtacccggtaccgtccccgtccccgtcccggttacg

SEQ ID NO: 241527 - DNA, 811 bp, Homo sapiens
  misc_feature: GYAE6OF01C8UR8.38.5.A05.1.454.CMB.1.raw
  modified_base (658)..(658): a, c, t, g, unknown or other
  misc_feature (658)..(658): n is a, c, g, or t
tcagtcgatcacgtcacgaccggtgctcgatttagatagatagacagggggagattcccaggtgtttccattcagtgatcagcactgaacacagaggactcaccatggagttgggactgagctggtattttccttttggcttaattttaaaaggtgtccagtgtgaagtgcagctgggtggagtcgtgggggaggtcttggtacagccgtgggcacggtcccctgacgtacctcctccgtgtcgccacgcccttcgtggtattcgacgttcgtttgattgtaatttacgtggtcctaagttcgaccgtaccggttccggggttacccgtaaccgtaaaccggtcccggttaacccgggaaacggggggtaaaccggggtcccggttagggggtacgggttcggggtccttaacgggtaagggtttaagtttagggtaacgggaacgtagggttagggtaaggtaacgttacgggtacttaggtacgggtaccggtacttcggtagggtaacgggtaaccggggtcctagtttacgacgtaccgtacgtccgtaaccgaagtaaccggaacccaaaccggacccgttaaaagttaaccctttcccgtaagttaacctaccgtaaaactaaagtacgaacgttacgtacgagacggtacnccggtaaggaacccgtacggtccgtttactttagttacgtttacgagtaacgaaacgttaaagtttgtttaaggtacgtttaaggtaaaggtttaacgggtaacgttccttaacggtagttaaccgggagttaccgggcgttcgggaaccggg

SEQ ID NO: 241528 - DNA, 842 bp, Homo sapiens
  misc_feature: GYAE6OF01DESK0.38.5.A05.1.454.CMB.1.raw
  modified_base (208)..(208): a, c, t, g, unknown or other
  misc_feature (208)..(208): n is a, c, g, or t
  modified_base (289)..(289): a, c, t, g, unknown or other
  misc_feature (289)..(289): n is a, c, g, or t
  modified_base (459)..(459): a, c, t, g, unknown or other
  misc_feature (459)..(459): n is a, c, g, or t
tcagtcgatcacgtcacgaccggtgctcgatttagatagatagacagggggagattcccaggtgtttccattcagtgatcagcactgaacacagaggacctcaccatggagttgggactgagctaggtattttccttttggcttaatttttaaaaggtgtccagtgtagaagtgacagctgggtggagtcgtgggggagcttggtacngcctggcaggtccctgacgcctctccttggtagccacgtccttcgtaggattcgacggttctttaggattgtaacgttagngtacgtaacgttggtactacgggtccggggttaccgacaaccgggtccttaaacccggggaaggggaaaccgggttccggaagggggttacggttcggggttctaacgtggggttaaattttacggggaacgtaacgtaggggtttaggtaacgggtaagtttaccgggntttaaacggcggtccggtaactttcggttaggtaacggaaccggggtacttacgtaccgaggtaccttaggccccgtacgaacgaacgggaacccaacggtacctaaaacggttaccttaccccgggtaatttacccgtacgttaaacgtaaacgtacgaacgttaacggtttccagggtaaacgccggttaaacgacgggttaaacccgtacccggttaggtacctttaacgggtttaagttccgttaaggtactaaacccgggtaaagtttttagttacgggtttaacgttaaggttaacggttaaacgggttcgttaacccgttaaacggttcgtttaaacgggtcgggtttaacgtcccgggtggttaaaccccggggg

SEQ ID NO: 241529 - DNA, 945 bp, Homo sapiens
  misc_feature: GYAE6OF01CLRD5.38.5.A05.1.454.CMB.1.raw
tcagtcgatcacgtcacgaccggtgctcgatttagatagatagacagggggggggtctcaggaggcagcgctctcaggacatctccaccatggcctgggctctgctgcctcctccaccctcctcacctcgacgggaccacgacgggtcccgtcggggacccctaggttcctccggccccgttgggcctcgacgtccctcgcccgttcggtcgttcgtcgggttcctccgtaggactcgtcgactccacctcttcctccgtcgactacggtacggaacccaggtacgtaggtacgggttacgggtttgggtttaaggttttaaatttaacgttttcggtcccttaccggttacggtaacccaaacggtaccggaccggaacccggtactaaccgtaccccgtaaaaccccctaaacgtacctaagttacgttacgtttacgacgggtaccgtacctaaccttccgtaccggttaccccgggttacccgtttacgggttacgggtttaacctaacgttccgttcgtttctcgtcgtaacttacgtaacgtacgtacggtaccgacccgtaacccggaccccgttcccgtacccgtacgtacctaccgttcccgttgggtccggtaccgtcggtacggaccggtacgggtaacgtacggttaccgtaacgttttagtttacgttcgtaacgtaccgttaattaccgtaacttaaccgtaacctaaaccgtcgtaaaccctaccgttaccggtactttaccgggtaaccgttaacgggtacccggggtaaaccgggtaaccggtaaacccggttaaccgggttacccgttaaaccccgggttaccccgggtttaaaccgtaaaccccgggttccccggtaaaccccgggacccggttacccccgggttaccccccggttacccccgggttccccgggtttacccccggg

SEQ ID NO: 241530 - DNA, 873 bp, Homo sapiens
  misc_feature: GYAE6OF01BTH3W.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagccgtggccacggtccctgagtctctccgtgtgcacgcctcgtggtattcgagtctttgatggtattagtggctagtgcctacggtcggggtcccggacaacgtccgtaccgggaggggaacgggtccgtaggggtcggttacgggtcctacggtagggtttaacgtttaggttacggaacgtgggttagggtaaggtatacggtcgttagtcgggacggtcttggtacggtaggtaaccgggccgttagttcgacgtactacgttccgtacccgaaggtaaccgaaccgaaccgtaacccgaaagtttaaccgtttccccgtaagttaaacctttacctaaaacgaaacgttaccgtaaacttaccgggttacgttaagggaaacggtacggtacccggttaacgggtaaacccgggaacccggtttacccgggtttaaccgtttacggtttaaaccgttttaccggtaacgggttaaccggttaaaaaccgttaaaaaccgggtttttaaggttttttaaaccgggtttaaaggggttttaaaacccggtttaagggggtttaaaaacgggtttacccgggttaaaacgttttacccgtttaaacggggtttaaccgggtttaccggtttaaaccgggggtacccgggtttacgggggtaaaccccgggggg

SEQ ID NO: 241531 - DNA, 872 bp, Homo sapiens
  misc_feature: GYAE6OF01DHXXB.38.5.A05.1.454.CMB.1.raw
tcagtcgatcacgtcacgaccggtgctcgatttagatagatagacgagggggagattcccaggtgtttccattcagtgatcagcactgaacacagaggactcaccagtggagttggactgagctggtattttccgtttggacttaagttttaaaggtgtacctagtgtgaagtgacagtcgtggtggtaggtcggtagggggaggtcgttaggtaccgacggtccgtacgggtccgacgggttccccgtagacgtacccgttccgttaccgtgtacggtaccgacgtcccgtcgttagggtactttaccgacggtttccgtttagagttaggttaagtttcggtacggtacctaggtacgtaccggttaccgggttaccggggaccggtaccggaaccggttccgtaaccgggggtaaacggggtaccgggtccggttaacggggtcgggtttcgggttaccgtaacggtttagggtttaacgtttaggtaaccgggtaagtacgggttagggtaagggtaacggttacggttacgtacgggtacggacccggttaacgtggtacgggtaaccgggtaaccggggtctaacgttaacggacgttacgccgttaccgaaccgaacggacgaacccgtaacgaacgttaaccgttaaccttacgtacttaactaaccgtaacgtaaagtacgtaacgttacgggttaacgaaggtaccgtaaggtccgtacgggtaacgtacccggtacgttaccgttattaccggtagttagtaacgttaagtaaagtttacggttagttaaaggttaggtaacgttaggttaacgttacttacggttaaacggttgtaaccggttcggaccgtggaaccggg

SEQ ID NO: 241532 - DNA, 743 bp, Homo sapiens
  misc_feature: GYAE6OF01BTTGA.38.5.A05.1.454.CMB.1.raw
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
  modified_base (444)..(444): a, c, t, g, unknown or other
  misc_feature (444)..(444): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacgacgggtcctgggcccagtctcgcccgtggctcagcctgcctcgtgtcgtggtctccgtggcagtcganccaaccnttcctcctagcctacgtacggaaccacggacgtaggtcggtacggtttggggttaggtttaaattaaatttcgttccttccgttacgtaacctaacgacggtccgacccggacaaccgtaccgaacccccaaaatccaagttgtaatttcgtaggtacgtctactcgtacgtcccggtccgttacggttacggtttactacgttcgtcctttcgtctcgactactacgtacgtcncggacaccgcctccgtctacgactcgttctacggtcggcctacggtcggtacgacggtaacggacgtacggttactttaaacgttcgtttaccgtagtacgttacgttacgtaacttaacgtaaaccctaaccgaacgtaccctaaaccgttaccttacggtacctaccggtttacggttacccgggggtacggaaacccgggtaaccgtacggtcccgttaaccgggtcccgttaacgtaaaccgaccgtaccggaacccgttacccggtcccgttccccggtccccggttaacccgg

SEQ ID NO: 241533 - DNA, 860 bp, Homo sapiens
  misc_feature: GYAE6OF01CCJ4O.38.5.A05.1.454.CMB.1.raw
  modified_base (354)..(354): a, c, t, g, unknown or other
  misc_feature (354)..(354): n is a, c, g, or t
tcagtcgatcacgtcacgaccggtgctcgatttagatagatagacgagggggagattcccaggtgtttccattcagtgatcagcactgaacacagaggactcaccagtggagttgggactgagctggtatttttccgttttggtactttaaagttttaaaagggtcgtccgtaaggttggttaggtaaaggttgacgtaggtcgttggggtgggtacggttcgggtgggggggaaggtcgtttgggtaaccgacggtcccgtgggccgtacgggttccccgtaggaacggtccttccgttcccgtggtacgcgacgtccttacgtggtattcgagttctttagagttgtattgnggtactagtcgacgtcggtcgggccgagaacggtccggacggaaggggacggtccgtgggtaggttcggtcgttacggtaaggttaagttacgggtaagggaaacgtagggtagggtaaggtagtacggtctaagggtcggtacggtaacgtttcgggagggttaacgggaacgggtacccgtagtaaccgtcgacctacgttacccgagtaacggaacgaaccgaacgaaccgtaaagtaccgttacgtaacgttactaacgtaaaccgtaaagtacgtaaacgtcggtaacgtaggaacgggtacgtaacgtacgggaaccgttaccggaaccggtttacgttaagttaacccgttagtacggttaaacgtaaaagtttaaacgttttaggtttaacggtaaaggtttaaaggtaacgggtttaagggttaaaacccgtttcggttaaacggttaacgggtaagggtttacgacccgggtttaggggtaccggtaacccggggg

SEQ ID NO: 241534 - DNA, 990 bp, Homo sapiens
  misc_feature: GYAE6OF01DEXJQ.38.5.A05.1.454.CMB.1.raw
tcagtcgatcacgtcacgaccggtgctcgatttagatagatagacgagggggagattcccaggtgtttccattcagtgatcagcactagaacacgagaggactcaccagtggtagttgggactggagtcgttggttacgttttttccgttttggtacgtttaaatttttaaaggtgttaccgtagttgtagaaggtgactaggtcgtgggtgggtaggttcgggtagggggtacgtcggtttagggtaacgccggtccggtcgggacgtacgggtcccgtaggaaccgtccttccgtccgtaggtcgccgtacgtccgttagtacggttactcgttacggttacgtttaggtagttagttaagtttaaggtcggtactgttacggacccggtacggggttaccgggtaccccggaagtaacccggttaccggaaccgggggtaaacgggtaccgggtcggtaaggggtcggttacggtacccggttaaggtttagggtttaaacgttagggtacggtaaacggttggggttaagggtaagtacggtaaggttctagggtaccggacgttacggttcggtaagggtaacgggtacgtaccgttaacgtaccgtagtaccgttactacggaaccggaaccggtaacaacccgggaacgtaacgttaacccctttacgttaccccgaatttaaccgtaaccgtaaagtaaaggaaccccttaggtacggttaccaaggggtaacctacgggtcggttaaacgggacccggtaaacccgttttaggtacccgttttaaagggtttcccgaaacggttaaggttaaaccgttaaaggtttagggtttttaaaatacggggtttttaaacgggggttaaatttaacgggggttaaaagtttacccgggtttaaacccggtttacccggtaaacggggttaaacgggttacccgggtttaaacggggaaccggggtccggggtttaaaccccggggg

SEQ ID NO: 241535 - DNA, 870 bp, Homo sapiens
  misc_feature: GYAE6OF01BRWZ5.38.5.A05.1.454.CMB.1.raw
  modified_base (213)..(213): a, c, t, g, unknown or other
  misc_feature (213)..(213): n is a, c, g, or t
  modified_base (669)..(669): a, c, t, g, unknown or other
  misc_feature (669)..(669): n is a, c, g, or t
tcagtcgatcacgtcacgaccggtgctcgatttagatagatagacagggggagattcccaggtgtttccattcagtgatcagcactgaacacagaggactcaccatggagttgggactgagcttggtatttttcccttttggcttaagttttaaaaggtgtccagttgtgaagtgcagcgtggtgggagtcggtggggggagtcgttggtacncgccgtggccgacgggttccctagagtaccttccttcctggtcgcctacgtcccttgtaggtattcgtagttctttagattcgtatttggtcggactatcgaccggtaccggttcgggggtacccgtaacgaaccggtcccggtaccgggaacggggggtaccgggtaccgggtggggtagggttcgggttacccgtaggttaacgggttttaagtttaacgggttaacgggtaaacggttaggggttaacgggttaaggtacggtacggtccgttaggtaccggggtaccggtacgtttcgggtcgggtaacggggtaccgggtacgtacgtaccggtacgaccgtacttacccgaccgtaaggtaaacccgaaccgtaaacggaccctaaaacggttacccttccgtaagttaaccgtaacctaaacttaaaggacccgtaacgaggttaccgngaaaccgtcggtccggtaaggacggtaccgtaccggttatttagggttaactcgttaaggtaactaaggttaaaaggttagtttttacgggtaaacgggttttaggaaacgggtttaacgggttaacgggtttaaccgttacggttaaaccgggtttagggtttaaacggtcgggttaaggtcccgggggtaaaccggggg

SEQ ID NO: 241536 - DNA, 788 bp, Homo sapiens
  misc_feature: GYAE6OF01EBK3R.38.5.A05.1.454.CMB.1.raw
  modified_base (252)..(252): a, c, t, g, unknown or other
  misc_feature (252)..(252): n is a, c, g, or t
  modified_base (376)..(376): a, c, t, g, unknown or other
  misc_feature (376)..(376): n is a, c, g, or t
tcagtcgatcacgtcacgaccggtgctcgatttagatagatagacaggggggggtctcaggaggcagcgctctcaggacatctccaccatggcctgggctctgctgctcctcaccctctcactcgagggcacgtacgggtcctcgggccctagtcgtcgccccgtggcttcacgcctcgcctcgtcgttcgtcgggtcctcgtcggactcgtcgacactacccgtattccttcctgactacgtacggaaccncgcgtaggtcggtacggttaggtagtttaacgttaagtttcgttccgtaccgttaccggaaccaacgaccggaccgaccggacaactacccgaaccctaaacttctacgttagttacgtttagnggtacgttaccactcggtacgtacccgtccgttacggttacgggttttacctaacgttctccttcgtagtccgtacttacgtaccgtaattcccggaggtaccacggtcccgtccctcgtactaccgtacgtctacggaccgtccgtaccggtaggttacggaccggtaagggttaccggacgggtttaactttaacgtttccgttagttaccggtactttaactaccgtaacttaaacccgtaacggtaaccattaaacccgtaacgttcccgttaacggtccggttacgttaaccggggaccggttaacggaacccgtaacgtcggtaaccgttaaccggttaaccccttacgggtaccacggtaacccggtcccgtaaaggttcccccggccgttaaccccggtcccgg

SEQ ID NO: 241537 - DNA, 750 bp, Homo sapiens
  misc_feature: GYAE6OF01ANYA3.38.5.A05.1.454.CMB.1.raw
  modified_base (235)..(235): a, c, t, g, unknown or other
  misc_feature (235)..(235): n is a, c, g, or t
tcagtcgatcacgtcacgaccggtgctcgatttagatagatagacgagggggggggtctcagggaggcagcgctctcaggacatctccaccatggcctgggctctgctgctcctcaccctcctcactcgagggcacgagggtcctgggcccagtctcggccctggctcagcctgcctcggtgtcgtgggtctccgtggacaggtcatccacctatcctctcgacacgtagaaccngcaggtgtacggttggtagttaattaagtttcgtctcgtacggtaaccaacgtacgaccgtacccgggactaacgtaccgaacccccaaaagtcctaagttacgttaatttagtaggtacggtacctacctaccgacgtcccggtaccccggttacggttacgggtttactacgtccggtcttcctcgtacgtcgtactacgtacgtacgtcggacctaaccgtccggtcctacccgtacaccgtacttccgttacggtcgggtaccgtacggtcggtacgttacgggtaaccgggtacgttaacgggtacttttaaacgtttacgtttcgtactacccgtttacgttaactaacgttaaccgtaacctaaccgtacgtaacccgaaccttccgtacgtacggtaacggtttacgggccgggtaaacggggaaccgtaaccgacggttcgtaaccggccgttaaccggtacgaccgtaaccgacccgggagttcccgtacccgtcccggttaccg

SEQ ID NO: 241538 - DNA, 867 bp, Homo sapiens
  misc_feature: GYAE6OF01B03XO.38.5.A05.1.454.CMB.1.raw
  modified_base (255)..(255): a, c, t, g, unknown or other
  misc_feature (255)..(255): n is a, c, g, or t
  modified_base (369)..(369): a, c, t, g, unknown or other
  misc_feature (369)..(369): n is a, c, g, or t
tcagtcgatcacgtcacgaccggtgctcgatttagatagatagacgagggggggggtctcaggaggcagcgctctcaggacatctccaccatggcctgggctctgctgctcctcaccctcctcactcgacgggcacgacgggtcctcgggccctagtcctcgtcccgtggcctcacgcctcgtccgtcggtgttcgtcgggttcctccgtggactacgtcgactccacctacttctccgtgacacgtacgaaccngcgtagtggtacggttggtagttaattagtttcgtccttaccgtacggtaaccaagccgaccggacccggacaccgtaccccgaaacccctaatctaagttacgttatttacgnggtacgtactacgtcaccggttccggtaccgttaggttaacggttaccttacgtccgtcgtttctccgtcgtactaccgtacgtacgttccggacgtaccctaaccggcccgttcccctaacccgtacgtaacccgttcgtaccggttccggtacggtacccgtaccgggtcggtaccggtaagggtaaccgggtaaaccgtagtttaacctttaacgttttccgtacggtaacgttacccggttaaacgttacctaacgttaaacccgtaaaacccgacccgtaaacgtaccccgttaaacttacccgttaccgttacccgggttaccggtttaaccggggtaccccgggggaaaccgggtaaccggtaaaccccgtacgtttaccccggttaaccccgggtaacccgttaccggtaaaccggttaccccggaaccccggttacccggttaaaccccggtccccgggttaaacccccggtccccgggtttaaacccg

SEQ ID NO: 241539 - DNA, 935 bp, Homo sapiens
  misc_feature: GYAE6OF01DU089.38.5.A05.1.454.CMB.1.raw
  modified_base (235)..(235): a, c, t, g, unknown or other
  misc_feature (235)..(235): n is a, c, g, or t
  modified_base (762)..(762): a, c, t, g, unknown or other
  misc_feature (762)..(762): n is a, c, g, or t
tcagtcgatcacgtcacgaccggtgctcgatttagatagatagacagggggggggtctcaggaggcagcgctctcaggacatctccaccatggcctgggctctgctgcctcctccaccctcctcacctcgagggccacgacgggtcctcgggcccaggttcctcgccccgttggcctacacgtcctcgcccttccgtgtccgtcgggtctccgtggactagtccgatccgacctntacctccgtcgcctaaccgtacggaacccgtgaccgtaggtcggtacgggtttagggttacgtttaacttaaattttccggtaccttccggttacggtaaacccaacggaccgtaccgaaccccggggaactaaaccggtaccccgtaaacccccctaaagttaaccacgttaacgtttaacggttttaaccgtacggggttaccgtacctaaccgttccgtaccggtacccggttaccccggttacggttaaccgggggtttaccttaacggttcccggttccctttaccgttactaccgtaccgttaaccgttacccgtaacggtccgttaccggaacccgtaaccgtacccccggttccccttaccccgtaacgtaaccccttacgttcccgttaccgggtccggtacccgtaccggtacgggtacggtaccgggaacgggtaccgtaagggtttaccctttaaagttccgttttacgtacgaactttacggtacctaaccgttaacgtaaccaacccggtaanacccgttaacctaccgttcgtacggttacccggttacgggttaacccgggaaacgggttcccgggtaaaacgttccggtaaggggtttaccccgaacccgggtttacccaagggtaccccgtaaaccggcccgggtaaccggtcccccgttaacccggcccccggttaacccg

SEQ ID NO: 241540 - DNA, 681 bp, Homo sapiens
  misc_feature: GYAE6OF01BJTQX.38.5.A05.1.454.CMB.1.raw
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacgagggtcctgggcccagtctgccctggctcagcctgcctccgtgtctgggtctcctggacngtcgatcacctntcctctgcactggaaccngcagtgacgttggtgttaataattgtctcgtcgtaccacagccgacccggnaactcgaacccccaaaatcagtagtatttagnggacgtcactcacgtccggtacccttcggtacgggtttactaacgtccgtcttctctcgactactaccgaacgttcgtacggacctaaccgaccggtccctacccgtacgaccctactccgttcggtacggtccctacggaggtacgtaggacggacgtacggtactttaattacgtttcgtcgtacgttacttaccgtaacttaaccaacctaaaccgaccgtaaccgtaacctcccgttacgtaccggtacttaaccgggttaccgggacgggtaaccggtaaccgtacgggttaccgtaccggtaaccccgttaccgtaaggtacccgacggtaaccccgacggtccccggttaccccgccccggttaccgg

SEQ ID NO: 241541 - DNA, 920 bp, Homo sapiens
  misc_feature: GYAE6OF01DCAQW.38.5.A05.1.454.CMB.1.raw
tcagtcgatcacgtcacgaccggtgctcgatttagatagatagacgagggggagattcccaggtgtttccattcagtgatcagcactgaacacagaggacctcaccagtggtagttgggactgagtcttggtattttttccgtttggactttaaagtttttaaaaggtcgttacccgtagttgttaggaagtcgcgtaaggtcgttggggtgggaggttcgggtaggggggagtcggtttaggtacgtcgggtaccggggttcgggggttccctggacggtccttccgtccgttaggtcgtccgtcgttcttcggtaggttaaacctttttaaccgttaggtactaacgttagtccggtacctaagttcggtacggttccgggtacccgggttcccgaccggtaccggggtacccgtaaccgggggaaagggggggtaaggggttccggtaagggggtggggtttcgggtaccttaccggaaggttaccgttaaaaggtttcgggggttaacgggggtaggtttaacttaaccccggtttataaacccggtagtttaacccgttagggaaccggtaaacgggttccccggggtcccggggggggtttacggggtacccttaaccgaaccccgtaccgtacccgtaaccgaaaggacccggtttaaacccaccggtaaccggagggaccgaccgaacttaacgtacttaaccaacgttaaacaacgtaacgaccaacgtaccgtacgtacggacggttaccgacggtaaccgggaggtaccggtacggttattacgttagtggtagaacgcggaaccgtaccgacccgtagtacccgtaccgttggttacgttacgtttgttacgtcgtttgggtaccggttacgacgggtagttaaccgcgttcccgggtccttacccgg

SEQ ID NO: 241542 - DNA, 500 bp, Homo sapiens
  misc_feature: GYAE6OF02G6JPI.38.5.A05.1.454.CMB.1.raw
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatgcccccaaaatcatgatttatgaggtcactcatcggccctcaggggtttctaatcgcttctctgcatccaagtctggcaacacggcctccctgaccatctctgggctccaggctgaggacgaggcttaattatttctgctagttcatatacaaccagacaacactctgctagttcggcgaggaccaagctgaccgtctaagtcagcccaaggctcgcccctcgg

SEQ ID NO: 241543 - DNA, 501 bp, Homo sapiens
  misc_feature: GYAE6OF02H5TI7.38.5.A05.1.454.CMB.1.raw
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatgccccaaaatcatgatttatgaggtcactcatcggcctcaggggtttctaatcgcttctctgcatccaagtctggcaacacggcctcctgaccatctctgggctcgagctgaggacgagtctaattattctgcagttcatactaacaaccagaccaacactctgctagttcggacggaggaccaagctgaccgtctaagtcacgcccaaggctcgcccctccgg

SEQ ID NO: 241544 - DNA, 670 bp, Homo sapiens
  misc_feature: GYAE6OF02G66YS.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttcctttggctattttaaaggtgtccagtgtgaagtgcagctggtggagtcgtgggggagcttggtacagcctggcaggtccctgagactctcctgtgcagcctctggattcagtctttgatgattatggcatgcacgtgggtccgcaagctaccgaggggacggccgtgggagtgggtctacggtaggttagttggtaggaagtaggtagggtaggtagtaggtactagtggacggtacttcgtggtagggaacgggtccgtattacgagctactcctacgaaggacgaaccgaaccgacctaaagtaaccttccgtagtactactaaactaaagtacgaactagtactaggagtacgcgtaaggacggtaccgaccggttacgtttagttaacgttacgttacgtacgtaaacgtaaaggttttagttttaacggttaaggtttaacggtaaggttaaacgggttaacggttaaccgtttaaccggttaacggttaacgggttaacggttacggggttaccgttacggggtaaccggggg

SEQ ID NO: 241545 - DNA, 509 bp, Homo sapiens
  misc_feature: GYAE6OF02GO0W6.38.5.A05.1.454.CMB.1.raw
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
tcagtcgatcacgtcacgaccggtgctcgatttagatagatagacagggggggggtcgtcaggaggcgagacgctctcaggacatcctccaccatcggcctgggctctgctcgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatcgcccccaaaatcatgatttatgaggtcactcatcggccctcgaggggtttctaatcgcttctctgcatcaagtctggcaacacggcctccctgaccatctctgggctccgagctgaggacgagctaattattctgctagttcatatacacagcaacnctctnctagtcggaggaggaccaagctcgaccgtacctaagtcacgacccaggctccgccccgtcgg

SEQ ID NO: 241546 - DNA, 532 bp, Homo sapiens
  misc_feature: GYAE6OF02H34TY.38.5.A05.1.454.CMB.1.raw
  modified_base (303)..(303): a, c, t, g, unknown or other
  misc_feature (303)..(303): n is a, c, g, or t
  modified_base (424)..(424): a, c, t, g, unknown or other
  misc_feature (424)..(424): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttaataaatttgtctcctggtaccaacagcacccgggcaatcgacccccaaaatccatgatttangaggtcactcatcggccctcgtaggggtttctaatcgtcttctctgcatcaagtctggacaacaccggcctcctgaccatctctgggcctccgaggctggacggacgaggtacttaatttntttctgctagtcatactacaacagaccaacactcagtcttagttcggacggacggaccaagcctagacccgtaccgtaagtcacgcccgaaggcctccggcccctcgg

SEQ ID NO: 241547 - DNA, 510 bp, Homo sapiens
  misc_feature: GYAE6OF02FLU9E.38.5.A05.1.454.CMB.1.raw
  modified_base (399)..(399): a, c, t, g, unknown or other
  misc_feature (399)..(399): n is a, c, g, or t
  modified_base (414)..(414): a, c, t, g, unknown or other
  misc_feature (414)..(414): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatgcccccaaaatcatgatttatgaggtcactcatcggccctcaggggtttctaatcgcttctctgcatccaagtctggcaacacggcctccctgaccatctctgggctccaggctgaggacgnggcttaattatttcngcagttcatatacaaccagcaacactctagctattcggcggagggaccaagctacggaccgtctaagtcacgcccaaggcctcgcccccttaccgg

SEQ ID NO: 241548 - DNA, 494 bp, Homo sapiens
  misc_feature: GYAE6OF02IV6CS.38.5.A05.1.454.CMB.1.raw
  modified_base (274)..(274): a, c, t, g, unknown or other
  misc_feature (274)..(274): n is a, c, g, or t
  modified_base (317)..(317): a, c, t, g, unknown or other
  misc_feature (317)..(317): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctcctggtaccaacagcacccgggnaatgccccaaaatcatgatttatgaggtcactcatcggccctnaggggtttctaatcgcttctctgcatccaagtctggcaacacggcctccctgaccatctctggctcagctgaggacgaggcttaattatttcngctagttcatatacaaccngacaacactctgctattcggcgaggacaagctgaccgtctacgtcagcccaggctcgcccctcgg

SEQ ID NO: 241549 - DNA, 642 bp, Homo sapiens
  misc_feature: GYAE6OF02FNAJP.38.5.A05.1.454.CMB.1.raw
  modified_base (227)..(227): a, c, t, g, unknown or other
  misc_feature (227)..(227): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcaggcacagggtcctggggcccaggtctaggccctggactcgagcctgcctccgtgtctgggtctcctggacagtcgatcaccatctcctgcactggaaccngcagtgacgttgtgttataattgtctctggtacaacagcacccggcaatcgaccccaaaatcatgatttatgaggtcactcactcggccctcgtaggggtttctaatcgtctttctctgcactcaagtctggacaaacacggccctaccctcgaccctatcgtctcgggctccgaggctaggacggacggaggtacttaatttactttctgtctacggttaccagttaactaaccaaaccgtacgaaccaacctacttccgtacgtaccttaacggttccggggacgggtaacgggtaaccccgtaaaggtcccgttaccggtaaaccccggttacccgtttaaacggttaccccgaacccggtaacccccggtaaacgggtcccgttaccccggtacccccccggttacccggg

SEQ ID NO: 241550 - DNA, 513 bp, Homo sapiens
  misc_feature: GYAE6OF02GT698.38.5.A05.1.454.CMB.1.raw
  modified_base (222)..(222): a, c, t, g, unknown or other
  misc_feature (222)..(222): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctcctggtaccaacagcacccgggcaatgcccccaaaatcatgatttatgaggtcactcatcggccctcgtaggggtttctaatcgtcttctctgcatccaagtctggcaacacggccctccctgaccatcctctcgggctccaggctggaggacgaggcttaatttatttctgctagttcatatacaaccagacaacnctctnctattcggcggaggaccaagctcgaccgtctaagtcacgcccaaggctcgccccgtccgg

SEQ ID NO: 241551 - DNA, 553 bp, Homo sapiens
  misc_feature: GYAE6OF02GLTIC.38.5.A05.1.454.CMB.1.raw
  modified_base (489)..(489): a, c, t, g, unknown or other
  misc_feature (489)..(489): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagctttgatgattatggctatgcacgtggggtccggcaagcctccgaggggaagggcctgggagtgggtctcgaggtattaggtggaactggtggtaggataggctatgcggactgtggtggaagggccgattcgagcatctccagacgacaacgccaaagtacttcccagttactctaacaaatcgaactagtctagaggagctaggaggacaccggtcctttagtacttactgtcgaactaagtntttaggaagtttagagttaaggtaggtacttaacgtacgtacggtatagggtacgtgtacgggg

SEQ ID NO: 241552 - DNA, 505 bp, Homo sapiens
  misc_feature: GYAE6OF02FFM8B.38.5.A05.1.454.CMB.1.raw
  modified_base (222)..(222): a, c, t, g, unknown or other
  misc_feature (222)..(222): n is a, c, g, or t
  modified_base (375)..(375): a, c, t, g, unknown or other
  misc_feature (375)..(375): n is a, c, g, or t
  modified_base (405)..(405): a, c, t, g, unknown or other
  misc_feature (405)..(405): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctcctggtaccaacagcacccgggcaatgcccccaaatcatgatttatgaggtcactcatcggccctcaggggtttctaatcgcttctctgcatccaagtctggcaacacggcctcctgaccatcnctgggctccaggctgagacgaggctaattntttctgctagttcatatacaaccagacaactactctgctagttccggcggaggaccaagctagacccgtcctaagtcacgcccaaggcctcgcccctcgg

SEQ ID NO: 241553 - DNA, 747 bp, Homo sapiens
  misc_feature: GYAE6OF02JVQ32.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggatttcctttggctatttaaaggtgtccagtgtgaagtgcagctggtggagtcgtgggggaggcttggtacagcctggcaggtccctgagactctcctgtgcagcctctggattcagctttgatgattatggcatgctacgtgggtccgctaagcctaccgagggaggcctggaggtgggtactcgaggtacttaggttggaactggtagggtaggtagtaggcttagtcggtaccggtactcgtaggtacggaaaggggtcccgtaagttccgaaggtcctaagttcccgtaccgaaggtacggaaaccaaaccggacccgtaaaaggtaacctttaccccgtaggttaacttaccgtaaacgtaaacgtacgtaaactacggttactaggaacgggacgtaccggtaacgggaaccggtaaccgtaaccgggtacccgttttaggttaacgtttacgttaacgggttacgtaaaccgttaaagttaggttttttaacgggtaagggttttaaacggtaagggttaaacggggtttaaacgggtttacccgttaaccggttttaaccggttaaacggggttacgtttaacgggggtacccggtttaccggtaaccggggggg

SEQ ID NO: 241554 - DNA, 527 bp, Homo sapiens
  misc_feature: GYAE6OF02FZQOB.38.5.A05.1.454.CMB.1.raw
  modified_base (418)..(418): a, c, t, g, unknown or other
  misc_feature (418)..(418): n is a, c, g, or t
  modified_base (450)..(450): a, c, t, g, unknown or other
  misc_feature (450)..(450): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctctggtacaacagcacccgggcaatgacccccaaaatcatgatttatgagtcactcatcgccctctaggggtttctaatcgcttctctgcatccaagtctgcaacaccggcctccctgaccatctctgggcctccaggctaggaggacgaggacttaaattattttcngtcagttcaatataaccaacagacaacactcngtctagtcggcggaggaccaagcgtacgaccgttacctaagtacgacgtcccgaaggtcctaccgccccgttaccgg

SEQ ID NO: 241555 - DNA, 759 bp, Homo sapiens
  misc_feature: GYAE6OF02IIXIU.38.5.A05.1.454.CMB.1.raw
  modified_base (299)..(299): a, c, t, g, unknown or other
  misc_feature (299)..(299): n is a, c, g, or t
  modified_base (492)..(492): a, c, t, g, unknown or other
  misc_feature (492)..(492): n is a, c, g, or t
  modified_base (619)..(619): a, c, t, g, unknown or other
  misc_feature (619)..(619): n is a, c, g, or t
tcagtcgatcacgtcacgaccggtgctcgatttagatagatagacaggggaggagttccaggtgtttcctattcagtgatcagcactgaacacagaggactcaccatggagttgggactgagctggactttctttggctatttaaaggtgtccagtgtgaagtgcagctggtggagtcgtggggggagtcgttggttacgacgtccgtggcgtacggtccccgtgacgacgttcctccgttgtcgcgtacgcccttcggtggactttccgattccgttagataggttattagtcggtcntacgcggtacgttccgggtccggagtaccgtccgtacggggaactttacggggacggtcgggtacggttcgggtccttagggtaacgttggttaagggtagggtacggtacgggttagggtacggtaggttaaggtcgtaagtcgtacgggtctacggtacggtcgggaacggtacgtacggtatacccggtnaaccgttacccgacggtaacgaacgaaacccgggtaaccgtaaaccgtaaccggttaccgttaaccgttacttaaccgtaactaaaccgtaagtaaccgtaacgtacgtaacgtcgtaaggcggtanaccgggtaagaccgtaccgttcggttaagttcttaaaggcgttacgtaaggttaacgttagtttacggttaggtttaagacggtttaacgagtttaaccgttacggtacttaggtacggtagttaccggagtaacccggg

SEQ ID NO: 241556 - DNA, 666 bp, Homo sapiens
  misc_feature: GYAE6OF02I4RNG.38.5.A05.1.454.CMB.1.raw
  modified_base (450)..(450): a, c, t, g, unknown or other
  misc_feature (450)..(450): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagtctttgatgattatggcatgctacgtgggtccggcaagccgtccgaggggaagggccgtgggaggtgggtctcgaggttattaggttggaactaggtggtaaggataggctagtggcggacttcgtggtaggaacgggccgtaattcgaagctaatctaccgaagacgaacaaccggccaaagtaacttcccgtagtactcctaanaaatcgaaacgtagtactaggaagacgtacgtacggaacggaccgacgggtccctttaggtttaacttaacggtttcgtacggtaactaaaacggtttaggttttttaaggaaggttttttaaacgggaaggtttaaaggggttaacggggtttactttaaccggttaacggtttaccgggttaacgtggggttaaccggttcggttaaccggggg

SEQ ID NO: 241557 - DNA, 907 bp, Homo sapiens
  misc_feature: GYAE6OF02H3MJF.38.5.A05.1.454.CMB.1.raw
  modified_base (759)..(759): a, c, t, g, unknown or other
  misc_feature (759)..(759): n is a, c, g, or t
tcagtcgatcacgtcacgaccggtgctcgatttagatagatagacagggggggggtctcaggaggcagcgctcctcgaggacactcctacccaacctagtcggtccggtcgggtccttcgtcgtcgtcgtcccttcctaccctacccccttcctacctactcggacgggaccaacgggtaccgggttccggtccgggacccgtacgttcgtccgtcccggtcggtcctacgccgtccgtccgtcccgttcggtcgttcggttcggttccttcggtacggacgtacggtacgtacctaccaactacttcctccgtcgacctacggtaccggaaccgacgacgtagtacggttacggtttgggttaagtttaaatttaagtttcgtccttaccggttacggtaaccaacgcgacccggtacccggaataccgtaccccgaaaaccctaaatcttagtagtttaacttttaggacgggtacgttacctaccgttacgtaccgtcccggtaccgttacgggtttacgggtttaccttaccgtccgtttcctttcgtcgtacgtacctaccgttaacgtacgtttcggaccgaacgtaacccggtcccgtaccccttcccgtaactaaccctcgttcccggttcggtcccgggttaccctaccgggtacggtcgtaaggggaaccgggtaacggtacgttttaaactttagtttttcgttacgcgttacgtttaacgtacttaaacttaaccgtaaccgaaacnccgtaaaccaactttaccgtcgttacggttacttaccgggggtacgggaaccgggtaacgaaccgtacgttaccggtacccgtaacccgtttaaccgtacggaccggaaccgtacccgtacggtccctacccccggttccggttaccg

SEQ ID NO: 241558 - DNA, 526 bp, Homo sapiens
  misc_feature: GYAE6OF02HF307.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagctttgatgattatggcatgcactgggtccgcaagctccgagggaaggcctggagtgggtctcgaggtattagttggaacaggtggtaggataggctatgcggactcgtgtgaagggccattcagcatctcagagacaacgccaagaacttccctagtactactaacaaatgaacagtactagagagctagagacagtggtccttgtattacgtgtagactaaagtagttttaggagtttagaagttaggtaaggtactacgtacgtacggtagtggagtcgg

SEQ ID NO: 241559 - DNA, 538 bp, Homo sapiens
  misc_feature: GYAE6OF02I5YEK.38.5.A05.1.454.CMB.1.raw
  modified_base (221)..(221): a, c, t, g, unknown or other
  misc_feature (221)..(221): n is a, c, g, or t
  modified_base (413)..(413): a, c, t, g, unknown or other
  misc_feature (413)..(413): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttaataaatttgtctcctggtaccaacagcacccgggcaatgcccccaaaatccatgatttatgaggtcactcatcggccctcaggggtttctaatcgtctttctctgcatccaagtctgcaacacggcctccctgaccatctctcgggctccaggctagaggacgagtctaatttntttctgctagttcatactacaaccagacaacactctgtactagttccggacggacggaccgaagtcctacggaacccgttcctaacgttcacggacccgaaggcctaccggtcccccgttaccgg

SEQ ID NO: 241560 - DNA, 548 bp, Homo sapiens
  misc_feature: GYAE6OF02IVFWT.38.5.A05.1.454.CMB.1.raw
  modified_base (222)..(222): a, c, t, g, unknown or other
  misc_feature (222)..(222): n is a, c, g, or t
  modified_base (300)..(300): a, c, t, g, unknown or other
  misc_feature (300)..(300): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctcctggtaccaacagcacccgggcaatcgacccccaaaatcatgatttangagtcactcatcggcctcgaggggtttctaatcgtcttctctggtctcaagtctggacaacgacggcctccctgaccatcctcgtcggctccgaggtctaggacggacgaggcttgaatttattactgcagcttctaatagaagaagtagactacttcgtggtgttacgggacggaggtaccaaggcgtacgtaaccgtccgtaagtaccgacgacccgaacggtccgtaccgcccccgttggtaccc

SEQ ID NO: 241561 - DNA, 565 bp, Homo sapiens
  misc_feature: GYAE6OF02G9NGE.38.5.A05.1.454.CMB.1.raw
  modified_base (222)..(222): a, c, t, g, unknown or other
  misc_feature (222)..(222): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataatttgtctctggtaccacagcaccggcaatcgaccccaaaatcatgatttatgaggtcactcactcggccctcgtaggggtttactaagtcgtcttctctgcactccaagtctgacacgaccggcctccctgaccatctcgtcgggctccgaggctggacggacgacggctagtacttacgtactgactagttcaattactacaacgcctacttaccttccttctttcgtagtttacgttcgggacgggtacgggaccgtaggggtacacccgttacgtaacgttccgaccgtacccgaaggtcctacccgccccgttaccgg

SEQ ID NO: 241562 - DNA, 576 bp, Homo sapiens
  misc_feature: GYAE6OF02ITOIP.38.5.A05.1.454.CMB.1.raw
  modified_base (222)..(222): a, c, t, g, unknown or other
  misc_feature (222)..(222): n is a, c, g, or t
  modified_base (353)..(353): a, c, t, g, unknown or other
  misc_feature (353)..(353): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataactatgtctactggtaccaacaacacccaggcaaacgccccaaatcatgatttatgaggtcactaatcgcctctagggttctaatcgcttctctgctcaagtctggcaacncgcctcctgaccatctctggctcgaggctgaggacgaggctgattacttactgcagtctacttataagaagtagtagactacgttcgttgggttcggttccgggacgggtaacgggaccgtaaaggtcccgttaacgggtaaccccgttaccgttaaacggtaccgaacggtaccccgaaagggtcccgttacccggaccccccgttcggtacccttaccccg

SEQ ID NO: 241563 - DNA, 620 bp, Homo sapiens
  misc_feature: GYAE6OF02H9UUP.38.5.A05.1.454.CMB.1.raw
  modified_base (280)..(280): a, c, t, g, unknown or other
  misc_feature (280)..(280): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttcctttggctattttaaaaggtgtccagtgtgaagtgcagctggtggagtctggggggaggcttggtacagcctgggcagggtccctgagactctcctgtgcagcctctggattcagtctttgatgattatggcatgcacgtggggtccgnaagctccgaaggggacggcctgggagtgggtctcgaggttattaggtggaactaggtggtaggataggcttagtggcggactcgtaggtacggaagggcctattccgagcacttctaccgaggaacgaaccgaaacgacccaaaggtaacttcccgtagttactacgttaaaccaaattcgaaactagtactaggaaggtacgcgtaggaacggtaaccgaccggtacccttttagtaacgttactaggtacgactaaaagttgtttttaggagttttaacggagttaaggttaacggtcttaacgtactaaccggttagtacggtaccgtggtacgggg

SEQ ID NO: 241564 - DNA, 509 bp, Homo sapiens
  misc_feature: GYAE6OF02F7SEL.38.5.A05.1.454.CMB.1.raw
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatgcccccaaaatcatgatttatgaggtcactcatcggccctcaggggtttctaatcgcttctctgcatccaagtctggcaacacggcctccctgaccatctctgggctccgaggctggaggacgaggcttaaattatttctgctagttcatatacaaccagacaacactctgctagttcggcgaggaccaagctcgaccgtacctaagtcacgcccaaggcctcgcccctcgg

SEQ ID NO: 241565 - DNA, 553 bp, Homo sapiens
  misc_feature: GYAE6OF02FU0II.38.5.A05.1.454.CMB.1.raw
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatcctcctgcactggaaccagcagtgacgttggtgttataaatttgtctctggtaccaacagcacccgggcaatcgacccccaaaatcatgatttatgaggtcactcatcggccctcgtaggggtttctaatcgcttctctgcatccaagtctggcaacgacccggcctccctcgaccattcctcgtcgggcctccgaggtctggaggaccgaggacttaattatttcgtgctagttcaattactaacaaccagacaactactctgtctacgttcgggacggacggaccgaaggctacggtaccgttaccgtaagtccgacgacccgaaggcctccggcccccttaccgg

SEQ ID NO: 241566 - DNA, 527 bp, Homo sapiens
  misc_feature: GYAE6OF02GVUC6.38.5.A05.1.454.CMB.1.raw
  modified_base (274)..(274): a, c, t, g, unknown or other
  misc_feature (274)..(274): n is a, c, g, or t
  modified_base (472)..(472): a, c, t, g, unknown or other
  misc_feature (472)..(472): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttccttttggctattttaaaaggtgtccagtgtgaagtgcagctggtggagtctgggggagcttggtacagcctggcaggtccctgagactctcctgtgcagcctctggattcagctttgatgattatggcatgcactgggtccgnaagctccgagggaaggcctggagtgggtctcgaggtattaggttggaacaggtggtaggataggctagtgcggactcgtgtgaagggccattcagcatctcagagacaacgccaagacttccctagtactctaacaaatcgaaacagtctagagagctagacggacacggtccttagtaacttacgtgtgacaaagtntttagaagtttagagttagtaaggtctacgtacgtaggtatggtacgtgtacggg

SEQ ID NO: 241567 - DNA, 712 bp, Homo sapiens
  misc_feature: GYAE6OF02H1Z3U.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttcctttggctattttaaaaggtgtccagtgtgaagtgcagctggtggagtctgggggagcttggtacagcctggcaggtccctgagactctcctgtgcagcctcgtggattcagtctttgatgtattagtggcatgcgtacgtcgggtccggacgaacgcgtcccgaaggggaacggtccgtggaggtcggtcgtcgaaggttacgttaggtaggtaacgtaggtaggtaggtagtaggtacgtagtggacggtacgtcgtggtaggtacgggccgtagtacgacgttttcgacgttaccgtaccgaacggtacgaacgaaaccgtaaccgaaacgtaacttacccgttacgttacgtacctaaacgtaaacgtaacgtaaacgtacgtacgtacggtaacggtacggtacgtacggaacggaaccgtaaccggtaccgtttagttaaccgtttaacgtagtacgtaacgtaaaagttagtttttaggtaaggtttaaggttaaggttaaaggttaacgggttaacgtttacgttaaccggttaacggttaacggtacgggttaccggtacggtaaccggggg

SEQ ID NO: 241568 - DNA, 634 bp, Homo sapiens
  misc_feature: GYAE6OF02F7Y3U.38.5.A05.1.454.CMB.1.raw
  modified_base (225)..(225): a, c, t, g, unknown or other
  misc_feature (225)..(225): n is a, c, g, or t
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
tcagtcgatcacgtcacgaccggtgctcgatttagatagatagacaggggggggggtcgtcgaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactcggaaccngcagtgacgttggtggttaataatttgtctctggtaccaactgcaccggnaactcgacccctaaaatccatgtatttangacggtcactacacgtcggcccctacgtaggggttttacctaatcgtcctttactcgttcgctactaccctaacggttctacggactaaccgaccgggtcctacccctggaaccctacttcctccgtcgggtaccgttcccaagggtcctaagggacggaacgaggtcttaaagttactttcgtagtactacgtttccaacgttactaaacctaaccgtaagaccctaaacaccgttactgtaccttaacgttcgggacgtaacgggacctaaggtcctacggtacccgtactaagtccacgacccgaagtccgtaccgcccccgttacg

SEQ ID NO: 241569 - DNA, 572 bp, Homo sapiens
  misc_feature: GYAE6OF02GDJQQ.38.5.A05.1.454.CMB.1.raw
  modified_base (392)..(392): a, c, t, g, unknown or other
  misc_feature (392)..(392): n is a, c, g, or t
  modified_base (492)..(492): a, c, t, g, unknown or other
  misc_feature (492)..(492): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttcctttggctattttaaaggtgtccagtgtgaagtgcagctggtggagtcgtgggggaggcttggtacagcctggcaggtccctgagactctcctgtgcagcctctggattcagtctttgatgattatggcatgcacgtgggtccggcaagctccgaggggaacgggcctagggaggtgggtctcgaggttattaggttggaacgaggtggtaggagtaggctagtgcggactcgtgtggagggccattcgagcatcacaganacaacgccaagacttccctagtactctaacaaatgaacagtcagagagcgtaggacggaccacggtcctttagtaacttcgtaggtacgaactaaagttnttttaggtagttttaaggaaggttaaggttaaggttactaacgttacggtacggttagtacgggtacgtcggtacggggg

SEQ ID NO: 241570 - DNA, 578 bp, Homo sapiens
  misc_feature: GYAE6OF02GJOAO.38.5.A05.1.454.CMB.1.raw
  modified_base (222)..(222): a, c, t, g, unknown or other
  misc_feature (222)..(222): n is a, c, g, or t
  modified_base (439)..(439): a, c, t, g, unknown or other
  misc_feature (439)..(439): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttaataatttgtctctggtaccaacagcacccgggcaatcgacccccaaaatcatagtatttatgaggtcactcatccgcctcgtaggggtttctaatcgtcttctctgctatccaagtctgacaacgaccggcctccctagacctatcctcgtcggcctccgaggtctagggacggaccgaggtacttaatttactttcgngtactagttacattaactaaccaaccagaccaactacttctagtacttacgttcgggacggtaacgggaccaaggtcctaccggtaccgtaccgtaagtccacggaacccgacggtcctacccggtcccccgttaccgg

SEQ ID NO: 241571 - DNA, 665 bp, Homo sapiens
  misc_feature: GYAE6OF02H5YV4.38.5.A05.1.454.CMB.1.raw
  modified_base (326)..(326): a, c, t, g, unknown or other
  misc_feature (326)..(326): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctcctgggggggtctgggtctcctggacagtcgatcaccatctcctgcactggaaccagcagtgacgttggtggttaattaatttcgtcttccgtaggtaaccaacacgccgacccgggacaacgtccgaacccccaaaatccaattgtaatttagngtacgtcactactacgtccggccctgtacggggtttctaacgttcgtcttctctgctactacctaagtctcggaccaaacgccggtccctcctacgacctactcgtcgtcggtcctccgaggtcgtagggacggtacggaacggtacttaaacgttttactttacgtgtactacgttactaacgttaaacctaaccaacctacgtaacctaacctacgttctacgtaccgtttacgtaccgggaccgggtaacgggaccgaacggtaccgtacggtacccgttaccgtaacgtacgaacccggtaccgaaccggccttaccccggtccccgttacccgg

SEQ ID NO: 241572 - DNA, 540 bp, Homo sapiens
  misc_feature: GYAE6OF02GKQSY.38.5.A05.1.454.CMB.1.raw
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (364)..(364): a, c, t, g, unknown or other
  misc_feature (364)..(364): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttaataaatttgtctctggtaccacagcacccgggnaatcgccccaaaatcatgatttangaggtcactcatccggccctcgtaggggtttctaagtcgtcttctctgcatccaagtctggcaacncggcctcctcgaccatcctcgtcgggctccgaggctggaggacgaggacttaattacgtttctgtctagttcataactaacaaccagacaactactctagcttacgtcggacggacggacaagcgtcgtaccgtaccgtagtccgacgtcccgaaggtccctacggcccccttcgg

SEQ ID NO: 241573 - DNA, 698 bp, Homo sapiens
  misc_feature: GYAE6OF02GMDHG.38.5.A05.1.454.CMB.1.raw
  modified_base (223)..(223): a, c, t, g, unknown or other
  misc_feature (223)..(223): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctccgtggacagtcgatcaccatcctctgcactggaaccngcagtgacgttggtagttattaattgtctctgtacaacagccgaccggcaatcgaccccaaatcatagtatttagtagagtcactcacgtcgcctcgtacggggtttctaacgtcgtacttctctcgactactaccgtaacgttcgtacgacctaaccgaccggtcccgttacccacgtaccctacttccgttcgtccgggtcctccggacggtcgtaggaacgggtaccggtaacggttacttaaacgtttcgtttacgtacgtacgttacgttacgtaaacgttacttaaaacccgaaccgaaacgtaacctaaaaccgttacgttccgttacgttacgtttaacggtaccggggtaccgggtaaaccgggaaccgtaaacggtccgttacccggtaacccgttaaccgttaaacgtaccggtaacccgaacccgggtacgtaccccggttccccgtaccccggtttacccgg

SEQ ID NO: 241574 - DNA, 606 bp, Homo sapiens
  misc_feature: GYAE6OF02G95DS.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagtctttgatgattatggcatgcacgtgggtccagcaagctccgagggacggcctgggagtgggtctcgaggtattaggtggaactaggtggtaggatagggctagtggcggactcgtgtaggaacgggccgtattcgagtcatcgtccaggacacgaacgccaaagtacttacctagtactactaaacaaactagaactagtctaggacgtacgcgtaggaacggacgtacggtcctttagttaactttaacgtgttagacttaaaaggttacgtttttaggtaacggttttaaggtaagttaagggtttaacgggttcttaaccgttacgttaaccgggttaagttacgggtacgtacgggg

SEQ ID NO: 241575 - DNA, 710 bp, Homo sapiens
  misc_feature: GYAE6OF02JGXNK.38.5.A05.1.454.CMB.1.raw
tcagtcgatcacgtcacgaccggtgctcgatttagatagatagacaggggaggagttccacggtggtttcctattcagtgatcagcactgaacacagaggactcaccatggagttgggactgagctgggattttccttttggtcttagttttaaaggtgtccagtgtgaagtgcagctggtggagtcgtgggggaggcgttggtacagccgtggcaggtccctgagactctcctgtcgcagcctctggattcagtctttgattgattagtggcatgcctacgtcggggtccgcaagccgtcgagggggaacgggcctgggaggttcggggtactccgagggttaacttaggtttcgggaaaccgtaggttcggggttaagggcttaagggtctaaggtttcgggacggttacctcgttagggtggaaaccggggtccgtaatttccgaggcctagttccgaccgtagacggtacaaaccggccctaagaacgtttccctgttaactaccttaacaaagtcgaaacttagcttaggaactagggtactggacgggaacctaccgggtacgttagtaacgtttacgtacgtacgaacgttaaagtagttttacgggttaacgttttaaggagggttaaacggtttaagggtaccgttaacctttaacgggttaccggttaggtacggggtaaccgttcgggttaacgggggg

SEQ ID NO: 241576 - DNA, 635 bp, Homo sapiens
  misc_feature: GYAE6OF02G2E4A.38.5.A05.1.454.CMB.1.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctccgtggacngtcgatcaccatctcctgcactggaaccngcagtgacgttggtgttataatttgtctcctggtaccaacacgcacccggcaatcgaccccaaaatcatgtattatgacgtcactcatccggtcctcgtagggttactaatcgtcttctctgctactacagtctagacacgacggtaccctcctacgacctatcctcgtggtcctaccgacggtcgtagggaacggacggtacggtactttaaacgtttagtttccgtgtacgtagtttacctaagtaacttaaccaacccgtagaaccctaaacgtacccttgttaccgtaacgttacggttaccgggtacgggaacgggtaaccctaacggtaccgtaccggtaacccggtaaccgttaacgtaccgtaccggacccgtaaccgggtccctacccggcccccgttaccgg

SEQ ID NO: 241577 - DNA, 589 bp, Homo sapiens
  misc_feature: GYAE6OF02H13MA.38.5.A05.1.454.CMB.1.raw
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
tcagtcgatcacgtcacgaccggtgctcgatttagatagatagacagggggggggtctcaggaggcagcgctctcaggacatctccaccatggcctgggctctgctgctcctcaccctctcactcagggcacagggtcctgggcccagtctgccctggctcagcctgcctccgtgtctgggtctcctggacagtcgatcaccatctcctgcactggaaccagcagtcgacgtttggtgtttaataaattttgtcttcctggtaccaanagcacccggnaatcgaccccaaaatcatgatttatgagtcactcatcggccctcgtacggggtttctaatcgtcttctctancactccaagtcncggtacaacaccggtccctccctcgaccctatctcgtgggcctccgagctgacggacgtaggtacttaagtttctttctcggacttagtcctaagtacttaacaaaccctgtaacaactacctctagcctttaacgttccggacgggaacggtaccgaaaggtcctacggtacccgttaacgtacgtaccgtaacgccccgtaaggtccctacccgcccccgtacgg

SEQ ID NO: 241578 - DNA, 808 bp, Homo sapiens
  misc_feature: GYAE6OF02JOBFI.38.5.A05.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (230)..(230): a, c, t, g, unknown or other
  misc_feature (230)..(230): n is a, c, g, or t
  modified_base (261)..(261): a, c, t, g, unknown or other
  misc_feature (261)..(261): n is a, c, g, or t
tcagtcgatcacgtcacgaccggtgctcgatttagatagatagacaggggggggtcgtcgaggaggcgagcgctctcaggacatctccaccatggcctgggctctgctgctcctcaccctcctcactcagggccacagggtcctgggcccagtctcgccctggctcagcctgcctcgtgtctgggtctcctggaacngtcgatccaacgntctcctgccactcggaaccngccagtgtacggttggtagttaataaatttntcttccgtggtaaccctaacagaccgtcccggataactcgaccccctaaaaatcgactacggttaactttagtaccggtaacggtcctaacgttacacgtccggtcccttacggttacggggtttactaacgttccggtacttttctaccgggttctccgtaaccttccgttaaaacggtcgttaccggacgttaaaccccgccgggtcccctttacccgtaccggtaacctaccgttcccgttaccgttcggggccttttacccggaccgttcgtaacggaacggggaccgtaaccgggttatttaaaacccgtttcttttcccggttagacgtttaccgggttttaccaacgttaaactttaaacccgaaaccttacgaacccttaaaccgtcctttacgtccccgttaaaagttccgttacggggggtaccggtaaaaccgggtcccgtaaaccgtttcggtaaaccgtaccccgttttacgtaaaacgggttcccaagaccccccggtaagggtcccttccccggtacccccgtaacccgggg

SEQ ID NO: 241579 - DNA, 612 bp, Homo sapiens
  misc_feature: GYAE6OF02FIITP.38.5.A05.1.454.CMB.1.raw
  modified_base (223)..(223): a, c, t, g, unknown or other
  misc_feature (223)..(223): n is a, c, g, or t
  modified_base (280)..(280): a, c, t, g, unknown or other
  misc_feature (280)..(280): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatcctcctgcactggaaccngcagtgacgttggtagttaattaattgtctcgtcggtaccaacgacgccgacccggnaactccgaaccccaaaatcatgtatttagtgacggtcactcacgtccggtcctcggtaggggtttactaagttccgtcttctctgactactactagtcgtagaccaaccgtaccggtccctccgtacacctacgttcgtcgtcggctccgaggtcgtagggacggagtacgttacttaagtttacttcgtacgtacttacgtactaactaacctaacaaccgaactaccaacttactcgtactaccgtacggtcggacggacgaccgtagtccgtaccgtacctacgtaacgaccgtaccgaccgtacggtccctacccggtcccgttaccg

SEQ ID NO: 241580 - DNA, 742 bp, Homo sapiens
  misc_feature: GYAE6OF02HELN1.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttcctttggctattttaaaggtgtccagtgtgaagtgcagctggtggagtcgtgggggaggcttggtacagcctggcaggtccctgagactctcctgtgcagcctctggattcagtctttgattgtattagtggactatgaccacgtggggtcccaggcaacggcctaccggaggggaacgggccgtgggaggtcggggtctcgaggttagtttaggttaggaacgtaggtaggtaggagtagggctagtggacgggtacttcgtaggtggaacggggtccgtaagttcgacgtcctaacgttcccgtaccgaaggtaacggaacccgaaaccggacccaaaaggtaaaccctttaccccgttaggttaaaccttacctaaaccgtaaaagttacggaaaaccgtacggttactaacgggaacggtacggtaccgtaggaaacggggacccgtaaccgggttaccgtttacggttaaacgtttacgtcggttacgtaacgttaaaggtttagtttttaaggtaaggtttttaaggaaagggtttaagggttaacgggttccgtttaacgttaaccggttaacgggtttacggttacggggttaccgttacgggg

SEQ ID NO: 241581 - DNA, 680 bp, Homo sapiens
  misc_feature: GYAE6OF02HFVUO.38.5.A05.1.454.CMB.1.raw
tcagtcgatcacgtcacgaccggtgctcgatttagatagatagacaggggggggggtctcaggaggcagcgctctcaggacatctccaccatggcctgggctctgctgctcctcaccctcctcactcagggcacagggtcctgggcccagtctgccctggctcagcctgcctccgtgtctgggtcctccgtggacagtggatcaccatcctcctgcactggaaccagcagtcgacggtttggtgttatgtactattgtcctccgtggtaacccaaaccaacccaacccccgaccaaaacccgacccccaaaactcactagtaactttagtggaacggtctaagtaacgtccggtcccgttacggggtttactaacgttccggttctcgtcggtcctaccgagtcgtggacaacgccggtcctccgtcacccgtctcgtcgtcggtcctccgacgtacccgtagaacgggacggtaggtcttagtacgtttactacgtcgacgtaacgtcctagtaatactaacgtacgacgacgtactattccgttacgggtttgggttacggggtaccggggaccggggtactacggtcggtccggtaaccggttaccggtacggtaccgaccggacccggtaccggtccggtaccccgtccccggtacgttcccgtaccctttcccgg

SEQ ID NO: 241582 - DNA, 773 bp, Homo sapiens
  misc_feature: GYAE6OF02JH5RH.38.5.A05.1.454.CMB.1.raw
  modified_base (648)..(648): a, c, t, g, unknown or other
  misc_feature (648)..(648): n is a, c, g, or t
tcagtcgatcacgtcacgaccggtgctcgatttagatagatagacaggggagagttccaggtgtttccattcagtgatcagcactgaacacagaggactcaccatggagttgggactgagctgggattttcctttggcttaattttaaaggtgtccagtgtgaagtgcagctgggtggagtcgtgggggagcgttggtacagcctggcagggtccctgagactcctcctgtgcaggcctcgtggattcagtctttgaatgtattagtggacctagtgacctacgttgggggtcccgactaaaggcccttacccggaaggggggtaacggtcccgtaggggacggttgggtacctaccggtaaggttaagtttaggttaggaaccgtaggttggggtaaggtagtaacggtccttaagtgggaccgggttactcgttagggtacggaaacggggtccctaagtttacggacgtcgtattccgtcccgaaaggtacggaccgtaaaccgaccgtaaacggtaacgtttccccgtaggttaacccttaactaaaccgttaaagttaccgaaaccgtaagttccgtaaggaagtacggtaccgtaaggaaccgggtacctaaccggggtccttttagaaacccggtttttanacgggtagttaaaaccggtaagttttagttttaacggtaaggttttaggaaacgggtttacgaaagggttttactaaccgttacggttacggtaggttacgggtaaccgtttcggtaaccggggg

SEQ ID NO: 241583 - DNA, 589 bp, Homo sapiens
  misc_feature: GYAE6OF02F7G2B.38.5.A05.1.454.CMB.1.raw
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgtataattgtctctgtacaacagcaccggcaatcgaccccaaatcatgtatttatgaggtcactcagtccggccctacgtaggggtttctaagtcgtctttctctcgcactacaagtctaggacaacgaccgtcctccctcgacctatcctcgtcgggcctccgaggtccgtaggacgggaccggacgtacttaatttacgttttcgtcgtcgtacgtttctactaactaaccaaccagaccaaccgtacttctagtccgttagtccgggacggacggaaccgaacggtcctacggtacccttacgtaacgtaccgaccggtacccacgggccttccccggcccgttacccgg

SEQ ID NO: 241584 - DNA, 684 bp, Homo sapiens
  misc_feature: GYAE6OF02IS7YK.38.5.A05.1.454.CMB.1.raw
  modified_base (220)..(220): a, c, t, g, unknown or other
  misc_feature (220)..(220): n is a, c, g, or t
  modified_base (298)..(298): a, c, t, g, unknown or other
  misc_feature (298)..(298): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacgagggtcctgggcccagtctgccctggctcagcctgcctcgtgtctggtctcgtgcagtcgatcaccatctcctgcacgtggaaccngcagtgacggttgtgttataattgtactcgtgtacactagcgacccggactatcgaccccaaaatcactagtatttangtaggtacctactcagtccgtcctcgtaggggttttacaacgtcgtacttccgtctcggtactacgttaccaacgttcgtagtaaccaaccgaccggtacccctacccgtacgacccctaacgttccgttccgtacggggtcctcccgtacgggccgttaggacgggaccgggtaaggtacccgtttaaagttttacgtttcgacgttaccgttaggtttacctaacgttacttaaacccgaaccgtaacggaacctaacctaaccgttcgtaacgtacgttaccggttacgggaccggggttaacggaccgtaactacggaccgtaacccggttactaccggtacaccggttaccccgaggtccgtaccccgacccgttacccgg

SEQ ID NO: 241585 - DNA, 748 bp, Homo sapiens
  misc_feature: GYAE6OF02JOD16.38.5.A05.1.454.CMB.1.raw
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
tcagtcgatcacgtcacgaccggtgctcgatttagatagatagacagggggggggtcgtcgaggaggcgagcgctctcaggacatctccacatggctgggctctgctgctcctcaccctctcactcagggcacagggtcctgggcccagtctgccctggctacagcctgcctcgtgtctgggtctcctggacagtcgatcacntctcctgcactggaaccngctagtggacgtttggtaggttaactaaagttgtactccgttacggtacctaaactcgccgacccgggtacaacgttccgaaccccctaaaacttaccgaacgtttagtaacttttaagtacggtacgggtacctacttaacctaacggttccggccccgttacgttacgggggttttaacctaacgttaccggtcctttccggtactttcggactaactttacgtaaaacggtttcgtacgggtaacctaaacccgccgggtacccttacccgtacgaacccgtacttccgtacgttcgggtcccgttcccgagggtccgtaggtacgggtaaccgtaggtacgtttaactttacgtttcgttaacgtcttaaacggttcttaacgtaacgttaaccaacgtaacggacctaacgtaccgttacgtctacgttaacggtcgggtacgtaacggggactaaacggtcgtaccggtccgttaacgtaccgtacacggtacccgaacgtccgtacccgcccgttaccgg

SEQ ID NO: 241586 - DNA, 869 bp, Homo sapiens
  misc_feature: GYAE6OF02H2F5D.38.5.A05.1.454.CMB.1.raw
  modified_base (319)..(319): a, c, t, g, unknown or other
  misc_feature (319)..(319): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctccgtggacagtcgatccaccatcctcctgaccacgtaggaaccagcgagtggacgttggtaggttaattaatttgtctcctaggtaccaacagccaccggacaatcgaacccccaaaatccaatacgtatttanggtacggtactactactacgtccggtccctacggtacggggttttactaacgttcctccgtttccgtacttcgtacctaacgtttcccgaaaacggtttcgtcgggaacctaaacccggtacccgggttcccctaccccgtacggtaacccctagttaccccgttccggtaccgggtacccgtacccgtaacgggtccgttaacgggaaacgggtaaccgggtacggtaaccgtttaagtttttaacgtttcgttaccgtaaccgttaggtttaaccctaattaaacccgttaaccgtaaaaccccgtacgtaaaccccgtaaaacccttacgtttaacccgttacggtttaaccgttaacccgggttaccccgggggtaccggggaaaccgggtttaaaccccggtaaaccgggttaccccggtttaaaccggggttaaaccccccgtttaaccgggtttaaacccggttacccggaaacccgggttaacccccggaaccggggttttacccctacccccggggtttcccccccccgtttaaccccggg

SEQ ID NO: 241587 - DNA, 708 bp, Homo sapiens
  misc_feature: GYAE6OF02J3AUM.38.5.A05.1.454.CMB.1.raw
  modified_base (233)..(233): a, c, t, g, unknown or other
  misc_feature (233)..(233): n is a, c, g, or t
tcagtcgatcacgtcacgaccggtgctcgatttagatagatagacgagggggggggtctcaggaggcagcgctctcaggacatctccaccatggcctgggctctgctgctcctcaccctcctcactcagggcacgagggtcctgggcccagtctcgccctggctcagcctgcctccgtgtctgggtctccgtggacagtcgatcacctatcctcctgaccacgtacggaaccngcgtaggtggtacggttgtagttaattaatttcgtctcgtacgtaccacgcgaccgaccggacaactccgaccctaaatctatagtattagagacgtcacgtcacgtccgtccttaggttacgggttactagtccgtcgttctaccgtcgactactacccgtacgtccgtacggaccctaacccggtacccggtcccttaccgtaccgtaaccgttacgttccggttcgggtccgggtacccgtaccgggtaacggtacggtaacgggtaacgggtaacggttaaccgtttaactttaatttccgtttacgtacgaacttacgttacaaacttacaaccaacgttacaccgtaaccgttcgtacgtaccgtacggttaacggcggacggaccgtaccgaacggtcgtaacccgtaaccggttacgaccgtacggacccgtacccgtacggtaccccgtccggtacccgttacccg

SEQ ID NO: 241588 - DNA, 665 bp, Homo sapiens
  misc_feature: GYAE6OF02FTZQT.38.5.A05.1.454.CMB.1.raw
  modified_base (276)..(276): a, c, t, g, unknown or other
  misc_feature (276)..(276): n is a, c, g, or t
  modified_base (404)..(404): a, c, t, g, unknown or other
  misc_feature (404)..(404): n is a, c, g, or t
tcagtcgatcacgtcacgaccggtgctcgatttagatagatagacagggggagattcccaggtgttccgattcagtgatcgagcacgtggaaccacagaggacttccaccgatcggagttgggactgagcgtggtactttccgtttggcctaattttaaagggtgtccagttcgtagaagtgaccaggtcctcggtcggacgttcgtggggggagcttggttactaggcctaggcaggtcccctagagtacctcctccgtggtacgcacgaccttntaggacttcgagtctttgatgattagaggcagtcgactacgtcggggtaccggctaacgctaccgaggggtaggcctggacgtcggtactcgaggtagttaggtcggaactaggtggtagagtacggntaaggtggaccgtactcggaggttaggaacgggtcctattccgagccctagttcaccgagacggtaaccaaacggtcccaaaggtacctttcccgtaaggtactaccgtaacgtaaagtcgtaaactggtacctagaagtagtccgaggtaacggtacgtacggtccctttaggaacttacggagtacgaacgtaagtagtttagtaacgtaatacggtagttacggtataactcggtaagtgtacggtacgttgtaccgg

SEQ ID NO: 241589 - DNA, 662 bp, Homo sapiens
  misc_feature: GYAE6OF02HNR0H.38.5.A05.1.454.CMB.1.raw
  modified_base (222)..(222): a, c, t, g, unknown or other
  misc_feature (222)..(222): n is a, c, g, or t
  modified_base (302)..(302): a, c, t, g, unknown or other
  misc_feature (302)..(302): n is a, c, g, or t
  modified_base (451)..(451): a, c, t, g, unknown or other
  misc_feature (451)..(451): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttaataatttgtctcctggtaccaacagcaccggcaactgacccccaaaatcaatcgtatttacngaggtcacgtcatcggccctcgtaggggtttctaatcgtcttctctgtcatccaattctggtccaacgaccggccctcctcgacctactcgtacgtcgggtcctccgacgggtctcggaacggtaccggtaggtaccttaaacgttttntttacgtacgtcgtacggtttactaacttaaccgttaacaaacccgtaggaccctaaaccgtaccttaccgtagtacccttaaggtttaccgggaccgggtaacgggaacccctaaacgggtcccgttaaccggacccgtttacccgtaaacgttaccgaaccggtaccccgtaaacgggtcccgtaccggtccccccccggttaacccgg

SEQ ID NO: 241590 - DNA, 682 bp, Homo sapiens
  misc_feature: GYAE6OF02IRE41.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttccttttggctattttaaaggtgtccagtgtgaagtgcagctggtggagtcgtgggggagcttggtacagcctggcaggtccctgagactctcctgtgcagcctctggattcagtctttgatgattagtggcagtgctacgtcggggtccgacaagcctaccggaaggggacgggccgtggggaggtcgggtctcgaggttattaggttaggaacgtaggtgggtaaggtagtaggtactagtcggacggtacttgtggtaggaaacggggtccgtaatttaccgagtcctaagtccctaccgtaaggaaacgtaaccgaaaccggacctaaaagttaacctttacccgtaggttaaactaccgtaaaacctaaagtacgaaaccgtagttacgtaggaacgagcgtaaggacggaccgtaccggttcgtttaagttacttacgtagtacgtaagtaaacgtttagttttaggtaaggttttaagagggtttaagtaacgggttaccttaacgttacggttaacgtaggtacggtaccggtcggttaacgggg

SEQ ID NO: 241591 - DNA, 661 bp, Homo sapiens
  misc_feature: GYAE6OF02JZ8CC.38.5.A05.1.454.CMB.1.raw
  modified_base (273)..(273): a, c, t, g, unknown or other
  misc_feature (273)..(273): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttcctttggctatttaaaggtgtccagtgtgaagtgcagctggtggagtctgggggagcttggtacagcctggcaggtccctgagactctcctgtgcagcctctggattcagtctttgatgattagtgcatgcacgtgggtccgnaagcctaccgaggggacggccgtggacggtggtctacgaggttattaggtaggaactaggttaggtaggagtacgggtacttagtcggaccggtacttgtacggtaggaacggggtcccgtattacgaggactagtcccgtaccgaagacgaaccgaaccgaccgaaagtaactttcccgtagtaactactaacgtaaatacgaactagtcgtaggacgagcgtaggacggaaccgtacggtacctttagtaactttacgtagttacgaacgttaaagttagtttttaacgggaaggttttaaggtaaggttaacggtttaaagggttacccttaacgtttaacggttaaccgggttaagtcgggttaacgggttcggtaaccggggg

SEQ ID NO: 241592 - DNA, 688 bp, Homo sapiens
  misc_feature: GYAE6OF02GB51O.38.5.A05.1.454.CMB.1.raw
  modified_base (322)..(322): a, c, t, g, unknown or other
  misc_feature (322)..(322): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcaggcacgagggtcctgggcccagtctgccctggctcagcctgcctccgtgtcgtgggtctccgtggacagtcgatccaccatcctcctgacactggaaccagctagtcgacggtttggtagttaattaaatttgtctccgtaggtaaccaacacgccgacccgggacaatccgaaccccaaaatcatgtatttagngaggtcactcactccgccctgtacggggtttactaactcgtacttctctcgctaactaccgtaaacgttctagtaccaaacgtaccggtccctacccgtacgaaccctacgttccgtcggtacgggtccctacccggacggtacgtacgggaacgggaacggtacggtaacgtttaaatttaccgtttcgtacgtacgtaagtttacctaaattaactaaaccaacccgaaagtaacctaaacctacgttcctacgtacgttacgttaccgggacggtaacgggaaccggtaaggtaccgtacccgttaaccgtaacgtcgaaccgtacccgaaacggtcctacccggtacccccgttaggtaccc

SEQ ID NO: 241593 - DNA, 689 bp, Homo sapiens
  misc_feature: GYAE6OF02GHW14.38.5.A05.1.454.CMB.1.raw
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
tcagtcgatcacgtcacgaccggtgctcgatttagatagatagacagggggggggtctcaggaggcagcgctctcaggacatctccaccatggcctgggctctgctgctcctcaccctctcactcagggcacagggtcctgggcccagtctgccctggctcagcctgcctcgtgtcgtgggtctccgtggacagtcgatcaccatctcctgcactcgaaccagcagtgacgttggtagttaataatttgtctctggtaaccaacngaccaccggnaatccgaccccaaatcatgtaatttagngacgtcactcactcggtcctacggtacggggtttactaacgtccgttccttctacgtcgacgtactaccgaagtcgtcgaaccgaaaccgtcccggtaccctacccgtacgtaacctacttccgttcgtcgggtaccctcggtacgtcgagggaacgggaccggtaacgttacgtttaacgtttacgtttccagttaccgtagtttaccaattaacctaaacctaacgaccgtaacctaacgacctttccgtagtaccgtttaaggtcccggggaaccgggtaacgggaaccgtaacggttacccggtaaccggttaaacccgtacccgtaacgttacgacccggtaaccgtaaccgggtcccgtaccggtccccccgttaaccgg

SEQ ID NO: 241594 - DNA, 711 bp, Homo sapiens
  misc_feature: GYAE6OF02HEOVQ.38.5.A05.1.454.CMB.1.raw
  modified_base (224)..(224): a, c, t, g, unknown or other
  misc_feature (224)..(224): n is a, c, g, or t
tcagtcgatcacgtcacgaccggtgctcgatttagatagatagacaggggggggggtctcaggaggcagcgctctcaggacatctccaccatggcctgggctctgctgctcctcaccctcctcactcagggcacagggtcctgggcccagtctgccctggctcagcctgcctccgtgtctgggtctccgtggacagtcgatcaccatctcctgcactggaaccngcagtgtacgttggtaggttaattaaatttgtctccgtaggtaccaactagccgacccgggcaactcgaaccccaaaatcactacgtatttatgagtacacgtctacgtcggcctacgtacggggtttctaacgtcgtacttctctagctactaccgaacgtcgtacggaccaaccgaccggcccttacccgtacgacctactccgtcggtcgggtccctaccgagggtctacgggacggaacggtacggtacttaaactttacgtttacgtgtaccgttaggttacctaaagttaactaaacccgtaaccgtaacgtaacctaaaccgttaaccgttcttacggtacctttacggttaccgggtaccggggtaagggtaacccgaacggtacccgtaaccggttaacccgttaacccgttaacggtacccgtaccggtaaccccggtaaaccgggcccgttacccggtccccccgtttaacccggg

SEQ ID NO: 241595 - DNA, 603 bp, Homo sapiens
  misc_feature: GYAE6OF02HEXDP.38.5.A05.1.454.CMB.1.raw
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtagttataattgtctctgtacacagcaccggnaatcgaccccaaatcatgtatttagngaggtcactcagtccggcctcgtagggtttactaactcgtcttctctgctactcaagtctcgacaacgccggccctcctacgacctatccgtcgtcgggcctccgaggtcgtaggacgggacgaggtacttaaagtttactttcgtcgtacgttagtttccaatttaactaaccgaacctagaaccctaaacctaccttactacgtacttacggttacggacgggtaacggaacccgaaggtacctacggtaacccgttacgtaacgtccgaacggtaccccgaggtacccgtcccgcccccgttaccgg

SEQ ID NO: 241596 - DNA, 720 bp, Homo sapiens
  misc_feature: GYAE6OF02GL3GP.38.5.A05.1.454.CMB.1.raw
  modified_base (221)..(221): a, c, t, g, unknown or other
  misc_feature (221)..(221): n is a, c, g, or t
  modified_base (271)..(271): a, c, t, g, unknown or other
  misc_feature (271)..(271): n is a, c, g, or t
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataatttgtctctggtaccaacagcacccgggnaatcgacccccaaaatcatgactttagtgaggtcactcacgtccggcccttcgtaggggtttactaagtcggtctttcgtactcgactactaccgaagttcgtaggacctaacgtaccgggtcccttacccgtacgaccctaacttccgttcggtacgggtcctaccgaacgggtccgttacgggaacggtaaccggacgggttaacctttaaacgtttaacgttttccgtcgtaccgttaggttacctaaacttaacgttaaacccaaaccgtacgacctaaaccgttacgttaccgtacggttaccgttacggtttaccggggacgggaaccgggtaaccgtaacggaccgtttaccggtaaccccggtttaacgtaaaccggttcccgtaaccggtaaccccgtaacgggtccccggttaccccggtaccccccggttaacccggg

SEQ ID NO: 241597 - DNA, 773 bp, Homo sapiens
  misc_feature: GYAE6OF02HXQFP.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttggactgagctggattttcctttggcttaattttaaaaggtgtccagtgtgaagtgcagctggtggagtcgtgggggagtcttggtacagcctggcaggtccctgacgactctcctgtgcagccctgtggacttcagtctttagatgtattatggctatgctacgtcggggtccgacacgcctacggaaggggacggtccgtgggaggtcggtctcggtaaggttagttaggtagacgtaggtagggtagacgtaggctagtggcggtacttggtcgtaggaacgggtctaagtcagctatccgtacaagaacgaaccgaacgacctaaagtaccttaccgtagtactaacctaacaaagtttaccgaaacgttacgtacgtacggtaagggtacgacggtaacgggtacgggtaaacccgtcccgggttaaccggttttagtttaaaccggtttaaccggttaaggttaaccgtaaaaccggttttaaaaggtttacggtttttaaacggggttaaaggtttttaaaacggggtaaaggggtttaaaaccgggttaaaccggggttttaacccgttaaaaccggttttaacccggggtttaaacgggttaaaccggggttttacggggttaaaccggggttccgggttaaacccggggggg

SEQ ID NO: 241598 - DNA, 803 bp, Homo sapiens
  misc_feature: GYAE6OF02HEG0X.38.5.A05.1.454.CMB.1.raw
  modified_base (284)..(284): a, c, t, g, unknown or other
  misc_feature (284)..(284): n is a, c, g, or t
tcagtcgatcacgtcacgaccggtgctcgatttagatagatagacagggggagattcccaggtgtttccattcagtgatcagcactgaacacagaggactcaccatggagttgggactgagctggtattttcctttggcttaattttaaaggtgtccagtgtgaagtgcagcgtggtggagtcgtgggggagtcttggtacacgccgtggcacggtccctagacgtactctccgtgtcgcgacgtccctgtggtacttcgacgttcgtttgattgtaatttagnggactagtcgacctacggtcgggtaccaagacgaacgtccgtaccggaaggggtacggtccgtaggtagtcgggtctacggtaggttattaggtacggaacgtaggtaggtaaggagttacgggacttaggtcggacggtacttaggtacgggtaacggtaaccgggtccttagtaccgacgtacctacgttacccgtacggaaagtaaccggaacgtaaacccgtaaccgtaaacgttaacccgtttacccgttaaggtaacctttaaccgtaaaacgttaaacgtacgtaaaccgtcgttaaccgtaggaacggtaaccgtacggtaacgggtaaccgtaaccgtaccggttaacgtttacgtaaacgtttaacgtacggttaacgttaaacgttaaacggtttttcggtttaaacggttaagtttaaggtaaacggttttaacggttaaacggtttaccgtttaaccgttaaacggttaccgggttaacgttaccgggtaccggtttaaccggggg

SEQ ID NO: 241599 - DNA, 557 bp, Homo sapiens
  misc_feature: GYAE6OF02HQLUM.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttccttttggctattttaaaaggtgtccagtgtgaagtgcagctggtggagtctggggggagcttggtacagcctgggcaggtccctgagactctcctgtgcagcctctggattcagctttgatgattatggcatgcactgggtccggcaagctccgaggggaagggcctgggagtgggtctcgaggtattagttggaacagtgggtaggataggctagtgcggactctggtgaagggccaattcgagcatctccagacacaacgcaaagaattcccgtagtactctaacaaagtgaaacagtctagagagctaggagacacggtccttagttaattacgtgtagactaaagtattttaggaagtttagaaggttaaggtaagggtcttaacgtacgtaacggttagtacgggtacgtcggtaacgggg

SEQ ID NO: 241600 - DNA, 714 bp, Homo sapiens
  misc_feature: GYAE6OF02IJ4VV.38.5.A05.1.454.CMB.1.raw
  modified_base (213)..(213): a, c, t, g, unknown or other
  misc_feature (213)..(213): n is a, c, g, or t
tcagtcgatcacgtcacgaccggtgctcgatttagatagatagacaggggggggggtctcaggaggcagcgctctcaggacatctccaccatggcctgggctctgctgctcctcaccctcctcactcagggcacgagggtcctgggcccagtctgccctggctcagcctgcctcgtgtcgtgggtctccgtggacagtcgatccacatctccngcacgtcggaaccagcaggtcgtacgtttgggtaggtttaattaaagtttgtccttccgtacggtaaccctaaacgacgccgacccgggctaacgtccgaacccccctaaaatccaatagttaatttagtaggacggtcacgtcacgttcccggcccttacggtacggggtttactaacgtccgtctttccgtcttacgcctactaccgtaagtcgtcggaacctaacgccggtcccttccccgtacgtaccctacttcccgttcgtcgggaccctccggacgcgtacggaggacggtacgtactttaagttactttcgacgtactacgttacaacttactaaccaaccgtaacgaacctaacctaccgttactacggttaccgttacgggttaccgggggacgggtacgggtaacccgaaagtcccgtaacggtaccccgttaccgtaacgtccgacccggtaacccggtacggcccgttccccggtaccccgtaccggg

SEQ ID NO: 241601 - DNA, 828 bp, Homo sapiens
  misc_feature: GYAE6OF02HFM2F.38.5.A05.1.454.CMB.1.raw
  modified_base (227)..(227): a, c, t, g, unknown or other
  misc_feature (227)..(227): n is a, c, g, or t
tcagtcgatcacgtcacgaccggtgctcgatttagatagatagacaggggggggggtctcaggaggcagcgctctcaggacatctccaccatggcctgggctctgctgctcctcaccctcctcactcagggcacagggtcctgggcccagtctcgcccgtggctcagcctgcctcgtgtctgggtctccgtgacagtcgatccactatctcctgccacgtcgaaccngctagtgtacgttggtagttaattaagtttcgtcctcgtacggtaaccaacgacgaccggaccggtactaacgtacccgaaccccctaaaaagtcctaatacgttaaattttacgacgggtacggtacctaccttaccgtaccggtccccggtaccgttacgggtttaacggggtttaccttaacgtcccgttccttttacccgtacgttcgaccttaacgttacccgtaacggttccggtaacggaacctaacccggtacccggtccccttccgtaaccggtacctacgtttacccgttcgggtcggtaccctaccgggtacggtacggtaacgggtaaccgggtacggtacggttaaccttttaagttttcgttacgtcgtacgttaaccgttacttaaacgtaaaccctaaccgaaacccgacgtaaaccgtaaccgtaccttcggttaaccgtacgttaccggggtaaccgggtaccgggaaaccgggtaccctaacgggttaccgttaaacccggtacccgtttaacggaccggtacccgtaacccgggtacccgttaacccgggtccgttccccccggttacccggttaccccgg

SEQ ID NO: 241602 - DNA, 863 bp, Homo sapiens
  misc_feature: GYAE6OF02GM2TT.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttcctttggctattttaaaaggtgtccagtgtgaagtgcagctggtggagtcgtgggggaggtcttggtacagtcctggcaggtccctgagactctcctgtgcagcctctggacttcagtcttgatgtattagtggcagttgccgtacggtcggggtaccgacgtaaggtccctaccggaagggggtacggcccgtagggtaggtcgggtctaccggtaagggtttagtttagggttacgggaactaggggttagggtaacgggtaatacgggtaccgttaaggtcgggaccgggttacctttacggttcgggtaacggggtaaacggggtcccgttaagttcccggaagtacccgtacgttcccgtaacccggaaaggtaacccgaacgtaaaccccggtaacgtaaaccggtaaaccctttcccggtaagttaacgttaaccctaaacgttaaaagtacccgtaaacgttacgttaccgtaggaagggtaccgttagaacgggtaaccggtaaacgttccccggggttaacctttagttaaccgtttacggttaacgggtaaccgttaaaacgggttaaagttttacggtttttaacggggttaaaggttttaaaccgggttaaagggtttaaccgggggttaacggttttaaccccgttaaaccgggttaaccggtttacgggtttaaaccgggttaccgggttaaccggttaccgggtaaacccggggggg

SEQ ID NO: 241603 - DNA, 670 bp, Homo sapiens
  misc_feature: GYAE6OF02JAYLS.38.5.A05.1.454.CMB.1.raw
tcagtcgatcacgtcacgaccggtgctcgatttagatagatagacagggagagattcccaggtgtttccattcagtgatcagcactgaacacagaggactcaccatggagttgggactgagctggattttcctttggctattttaaaaggtgtccagtgtgaagtgcagctggtggagtctgggggaggcttggtacagcctggcaggtccctgagactctcctgtgcagcctctggattcagctttgatgtattagtggcatgcacgttggggtccggcaagccgtaccgaggggaacgggtcctgggacggttgggtctacgtaagggttatttacggtggaaacgtaggtggtaggagtagggctagtcggacggactcgtaggtaggaacgggtccgaattcggacgacgtactccgtacgaggtaacgaaccgaacgacgaaagtaccttaccgtagttactaactaaacgtaataacgtaacgtacgtacgtagaacgtagtcgtaagggaacgtaaccggaccgtttaccgtttaaggttacgttacgtaggttaacaacgttaaaggtttagttttagggtaagtttacggtaaaggttaagggttaaacgttaccgttaacggttaaccgtaacgggtttagtaccgggtagttaccgggg

SEQ ID NO: 241604 - DNA, 697 bp, Homo sapiens
  misc_feature: GYAE6OF02G1MPF.38.5.A05.1.454.CMB.1.raw
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
tcagtcgatcacgtcacgaccggtgctcgatttagatagatagacaggggggggggtctcaggaggcagcgctctcaggacatctccaccatggcctgggctctgctgctcctcaccctcctcactcagggcacagggtcctgggcccagtctgccctggctcagcctgcctccgtgtctgggtctccgtggacagtcgatccaccatctctgcactggaaccngcagtgacgttggtagttataatttgtctctggtaccaacagcacccggcaanccgaccccaaatcatgtattangacggtcactcactccggccctcgtagggtttactatccgtcttctctgactactaccgtaagtcgtacggaaccaaccgaccggtccccttacccgtacgtaccctacgttccgtccggttccgggtccctacccggtacgggtccgtacgggtacgggaaccggtacggtaactttaaacgttttacgttttacgtcggtaccgttagttaccaacgttaaactaacccgaaccgaacgtaacctaaccgtaccttcgtacgtaacgttacgttacccggggcggaaacgggtacccaacggttcccttaaccgggtaaccccgttaccgttaaaggtcccgaaccggtacccccggtaacggtccccgttaccccggtacccccggttacccggg

SEQ ID NO: 241605 - DNA, 703 bp, Homo sapiens
  misc_feature: GYAE6OF02JFJFY.38.5.A05.1.454.CMB.1.raw
  modified_base (238)..(238): a, c, t, g, unknown or other
  misc_feature (238)..(238): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttccttttggctattttaaaaggtgtccagtgtgaagtgcagctggtggagtcgtggggggaggcttggtacagcctggcaggtccctgagactctcctgtgcacgcctntggtattcagtctttgatgattatggctagtcgctacgtgggtcccggacaaggtcctccggaaggggacgggcctggggagtgggtcctcgtaggttagtttggttaggaactgggtaggtaaggtagtaagggtcttaagtggcccgggtaacttcggtacggtagggtaaacggggtccgtaaacgtttccgaaggtcctacgttccgtacccgaaggtaaccgaaccgtaaacgaccccgtaaaaggttaaccttaccccgttagttaaccgttaccctaaacgtaaagtaccgtaaacgtaccgttatacggtaagagaccggttaggaacgggaccgtacggtccctttagttaacttacgttagtacgtaacgtaaagtttgtttaggtaaggtttaaggtaggttaaaggtaggttactacgttacgtacggttaggtcggtacgtcggtaacgggg

SEQ ID NO: 241606 - DNA, 620 bp, Homo sapiens
  misc_feature: GYAE6OF02GHI54.38.5.A05.1.454.CMB.1.raw
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctccgtggacagtcgatccaccatcctcctgcactggaaccagcagtgacgttggtgttaattaattgtctctggtaccaacagcacccggnaatcgaccccaaaatcatgtatttangagtcactcatcgccctcgtaggggtttctaagtcgcttctctgctactcctaagtctggacaacgccgtcctccctcactatcctcgtcggcctccgacgtcgtaggacggtacgacggtacttaaagtttcgtttactgtactaagtttacatacgtaacaaccgtagtacctaactaccttacgtacgtaccgttacgttccggggacgggtaacgggaaccgtaacggtaccttaccgggtaacccgttaaccgttaaggttacccgaaccggtaccccggtaacggtcccgtaccccggtcccccgttaccggg

SEQ ID NO: 241607 - DNA, 670 bp, Homo sapiens
  misc_feature: GYAE6OF02JB3VR.38.5.A05.1.454.CMB.1.raw
  modified_base (235)..(235): a, c, t, g, unknown or other
  misc_feature (235)..(235): n is a, c, g, or t
  modified_base (267)..(267): a, c, t, g, unknown or other
  misc_feature (267)..(267): n is a, c, g, or t
  modified_base (587)..(587): a, c, t, g, unknown or other
  misc_feature (587)..(587): n is a, c, g, or t
  modified_base (600)..(600): a, c, t, g, unknown or other
  misc_feature (600)..(600): n is a, c, g, or t
tcagtcgatcacgtcacgaccggtgctcgatttagatagatagacagggggagattcccaggtgtttccattcagtgatcagcactgaacacagaggactcaccatggagttgggactgagctggtattttcctttggctattttaaaggtgtccagtgtgaagtgcagctggtggagtcgtgggggaggcttggtacagccgtggcaggtccctggacgactctcctggtgccngcctcgtggacttcagtctttgatgtattagnggactagtcgactacggtggggtccgacaaggtcctaccggaagggggacggccgtagggtaggtgggtactaggtagggttatttaggttacgggaactagggtagggtaaggtaacgtaggtacttaggtggaccggtacgtcgtaggtacggaacggggtaccgtataccgagacgtacttccgaacgtaaggaaaccgtaccgaaaccgtacgtaaagttacctttacccgagtttaacctacgtaaactaaagtacgaaacgttctacgtacgagtacgcgtaaggacgtacgtacggtcgtttagtaattacgntacgaataggttnttacggtaagttagaggttaaggttacgtacttaacttacggtacggtagtacggtcgtacggtacgggg

SEQ ID NO: 241608 - DNA, 687 bp, Homo sapiens
  misc_feature: GYAE6OF02ISR3T.38.5.A05.1.454.CMB.1.raw
  modified_base (255)..(255): a, c, t, g, unknown or other
  misc_feature (255)..(255): n is a, c, g, or t
  modified_base (304)..(304): a, c, t, g, unknown or other
  misc_feature (304)..(304): n is a, c, g, or t
  modified_base (571)..(571): a, c, t, g, unknown or other
  misc_feature (571)..(571): n is a, c, g, or t
  modified_base (615)..(615): a, c, t, g, unknown or other
  misc_feature (615)..(615): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttcctttggcttattttaaaggtgtccagtgtgaagtgcagctgggtggagtcgtggggggagtcgttggtacgagccgtggctacggttccctgagtactctcctgtggcagcctcgtggacttcngtcttttagatgtaattagtggctagtgccgtacggtcggggtcccganaacgtccgtacggaaggggtacggccgttggggaggttacgggtctaccggtaaggtttaaggtttacgggttagggaaaccttgggggtttagggaacggttagtagggttactagggttaccgacgggttcctgggtttggagggggtaaacgggcccttagttaccgacgtactttagtacccgtacgaggtaacacgtaaaccgacgtaacgtaacttacccgttagtacgtacctaaagtaacgtacggtaaatccgtacgntaaggactcgtaaggacgtcgacttcgttattaacgtcgtaagntaacgtaagtgtttagtaaggttacgtattaaggtagtactaagttaccgtagtagtcggacttaggccggg

SEQ ID NO: 241609 - DNA, 847 bp, Homo sapiens
  misc_feature: GYAE6OF02HSE5S.38.5.A05.1.454.CMB.1.raw
  modified_base (176)..(176): a, c, t, g, unknown or other
  misc_feature (176)..(176): n is a, c, g, or t
tcagtcgatcacgtcacgaccggtgctcgatttagatagatagacgaggggggggggtctcaggaggcagcgctctcaggacatctccaccatgggcctgggctctgctgctcctcaccctcctcactcgagggcacgacgggtcctgggcccagtctccgcgcgctcgctcgtcnccgtcgtgtcggtcggtcctcggacggacgtcggtcactaccactcttcctcgacgaccgtacgaaacggaccgacgacgtagggtacggttaggttagggttaaagtttaaatttacgttccgtccgtacgtaacggaaccacgaccggaccggaaccgtagacctaaccccaaaacccgtaataatgttaattaattaggcggttactacactaccgtacgcccgtcggtaacgggtttagttacacgttcgttcctcgtcgtactactaccgttacgtcggttaccgaacgtaacccgaaacggtcccccgttaccccgtcgtaaacccgttccgtaccgttccggtccgggtaccggttcccgaaccgggttcggttacgggtaacgggaacgggtacggtaaactttacgtttaaacttttcgttacgtacgtaacggttctaacgtaaacgttaaaccgaaaccaacggtaacctaaccttaacccgtacgtttaccggttaccggtaaccggttccggggtaacggggacccgggtaaacgggtaaccggtacccgtttaaccgggttaacccgtacccggttttaaaacccgtaccgaaccgggtaccccgtaaacccgggttaacccgaccccgggtttcccccgtccccgggttaacccgg

SEQ ID NO: 241610 - DNA, 767 bp, Homo sapiens
  misc_feature: GYAE6OF02IFPTO.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggtatttttcctttggcttaattttaaaaggtgtccagtgtgaagtgcagctggtggagtcgtgggggagtcttggtacagcctggcacggtccctgagactctcctgtgcagcctcgtggtacttcagtctttgattgtatttagtggctagtcggaccgtacggttcggggtacccggactaacggtacccgtacccgggaagggggaaccgggtcccgttaggggacggttcgggttacttcggtaagggtttagtttaagggttacggaaacggtagggttacgggtaaggtagttacgggtcttaaggtcggacggttactttacggtaggtacgggaacgggtaccgttagttcgaacgtctaacgttccgtacgagtaaaccgaccgtaaacgaaccgtaagtaaaccttccgtagtacctacgtaaacaaagtacgaactacggttacaggaacgtcgtacggtaggaaccggaccgtaccggttacctttagtaacttagtcggttaacgaaacgttaaagtttcgtttttaaggtaaggttttaaacggaggttaaacgggtttaaacggtcttaaaccggttaacggtaacgggtttaacgtaccggggtacccggttacgggtaaccggggg

SEQ ID NO: 241611 - DNA, 696 bp, Homo sapiens
  misc_feature: GYAE6OF02I8N1Z.38.5.A05.1.454.CMB.1.raw
  modified_base (200)..(200): a, c, t, g, unknown or other
  misc_feature (200)..(200): n is a, c, g, or t
  modified_base (560)..(560): a, c, t, g, unknown or other
  misc_feature (560)..(560): n is a, c, g, or t
  modified_base (682)..(682): a, c, t, g, unknown or other
  misc_feature (682)..(682): n is a, c, g, or t
tcagtcgatcacgtcacgaccggtgctcgatttagatagatagacagggggagattcccaggtgtttccattcagtgatcagcactgaacacagaggactcaccatggagttgggactgagctggtattttcctttggcttaatttaaaggtgtccagtgtgaagtgcagctgggtggagtcgtgggggagcttggtacngccgtggcaggtcctgacgacttctcctggtagcacgtcctcgtgtattccagtctttgattgtaacttagtggactatcggctacggttcggggccgacgtaacgtccggtaaccgggaagggggtaaccgggtccgtaggggtacgggttcggggttaccttaacgggtaggggtttttaaacgttaagggttacgggtaaaaccgtagggggtttaagggtagggtaaacggtacggtcgttaaaggtcggacggtattcgtgggtaacggaacgggctattcgaagtcctacgtcgtacgagacgacgaaccgctaaatcttcgaatactacaagtatagaactcgtcagacgtanaacgtgaaccgtcgtaccggtactttagttactacggttcgtaacgaagttaagttcgtttaagtaggttaacggtagttaacgggttacgtacttacggttactaagggttagttaccggngttccggaacgggg

SEQ ID NO: 241612 - DNA, 719 bp, Homo sapiens
  misc_feature: GYAE6OF02GKB5S.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcagtctttgatgattagtggcagtgcacgtggggtaccgcaacgctccgaaggggaacgggcctgggaggtggggtctcgaaggttagtttacggttaggaacgtaggtaggtaaggattagggcttaagtcggaccgggtacttcgttaggtagggtaaacggggcccgtaatttccgaacggtactaattcccgtaccgaagaacgaaccgaaaccgtacccaaacggtaactttccccgtaagttaaccttaccgtaaactaaagtacgtaaactacgttacgtaggtaacgacgtacgtacggaacggaaccgtaccggttccgtttaagttaacgtttacgtagttacgtaactaaaaggtttagtttttagggaaaggttttaacggtaaggtttaacgggttaaacgggttacgttaaccgtttacggtaaccgggtttaacgtacgggtaccggttacggtaccggggg

SEQ ID NO: 241613 - DNA, 683 bp, Homo sapiens
  misc_feature: GYAE6OF02F0AGS.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttcctttggctattttaaaaggtgtccagtgtgaagtgcagctggtggagtcgtggggggagctcggtacagcctggcaggtccctgagactctcctgtgcacgcctcgtggacttcagtctttgatgattagtggcatgccacgtcgggtccagcaacgtcctaccggaggggaacggccgtagggacggttggggtcctcgaaggttatttaggttaggaaactagggtgggtaggagtagggctaagtcggacggtacttcgtaggtacgggaaggggtccctaagttcgaacgtctacgtccgtaccgaagtaacgaaccgtaaccggaccctaaagtaacccttcccgtagttaccttaccgtaaacaaacgttacggaaacttacggtacctaggaacggtacgtccgtagggaacggtaccgaccggttaccgttagttactttaacgtacgtagtaactaaaaggttcttttaaggaaggttttaaggaaggtttaacgttaaggtacttaacgttaacgttacgggtaagtacggtacgttacggg

SEQ ID NO: 241614 - DNA, 665 bp, Homo sapiens
  misc_feature: GYAE6OF02JG63P.38.5.A05.1.454.CMB.1.raw
  modified_base (224)..(224): a, c, t, g, unknown or other
  misc_feature (224)..(224): n is a, c, g, or t
tcagtcgatcacgtcacgaccggtgctcgatttagatagatagacaggggggggggtctcaggaggcagcgctctcaggacatctccaccatggcctgggctctgctgctcctcaccctcctcactcagggcacagggtcctgggcccagtctgccctggctcagcctgcctccgtgtcgtgggtctcctggacagtcgatcaccatctcctgcactggaaccngcagtgacgttggtgttaataatttgtctctgtaccaacgagccaccgggcaagtccgaccccaaatcatcgtattataggaggtcactacacgtccgtccgtcgtacggggtttactaacgtcgtctttctccgttgctacctcgtaacgtcgtgaccgtaaccgtaccggtacccctcccgtacgtaccctacgtctaccggtcggtcctacccggacggtcgagggacggacggtacggtacctttaagtttacttcgcgtacgtacgttctaactacgttaacccacgacgaacaacccgtacttaccgtacgtccttaacggtccgggtacgggaaacgggtacccgaaggttaccctaacggtaccccgttaacggttaactacccggaaccggtacccgaacgggtcccgttacccggtaccccgttacccggg

SEQ ID NO: 241615 - DNA, 742 bp, Homo sapiens
  misc_feature: GYAE6OF02GHORA.38.5.A05.1.454.CMB.1.raw
  modified_base (150)..(150): a, c, t, g, unknown or other
  misc_feature (150)..(150): n is a, c, g, or t
tcagtcgatcacgtcacgaccggtgctcgatttagatagatagacagggggagattcccaggtgttccattcagtgatcagcactgaacacagaggactcaccatggagttgggactgagctggattttcctttggctagttttaaaggngtccagtgtgaagtgcagctggtggagtcgtgggggagcttggtacagcctggcaggtccctgagactctcctgtgcagcctcgtggacttcgagtctttgatgtattatcggactagtgctacgtcgggtccgacaagccgtaccggaggggaacggtccgtagggacggttcgggtacttacggtaagggttaagtttaggttacggaaacgtaggggttacgggtaacgggtagttacgggtacttaggtacgggaccggtactttcggtagggtacgggaaacggggtcccgtaattacccgaggtacctacgttaccctaccgaaggtaacgaacccgaaaccgtaccgaaacgttaaccgtttccccgtaaggttacctaacccgttaaacgaaaacgttacgaaaccgttaggtaccgttaggaacgacgtacgtagggaaccggtaaccgtaccggtttaccgtttagttaacgttacgtaggtaacgtaacgtaaaggtttgttttaaggaacgtttaaggaggttaaggttacggtacttaacgttacggttacggtagtacgggtacgtcggtaaccgggg

SEQ ID NO: 241616 - DNA, 647 bp, Homo sapiens
  misc_feature: GYAE6OF02I6TKZ.38.5.A05.1.454.CMB.1.raw
  modified_base (226)..(226): a, c, t, g, unknown or other
  misc_feature (226)..(226): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatccacctatcctcctgacactggaaccngcagtgacgttggtagttaataatttgtctcgtggtaccaactagccaccggntaancgaccccaaatcatgtattangagtcactcatccggtcctagttacggggttactaagtcgtacttctgtcgctactctaagtcgtacggacctaaactccgggtcctccgtacgaccctatccgtcgtcgggcctacgtaggtcgtacggacggaacggtcgtaacgttaactttacgttcgtacgtctagtactaacttacgtaaccaacgacgtacctaacctacttccgtacgttaccgttagttaccgggcgggtaaaccggaaccgttaaccggtcgttaccggtaacccggtaaccgttaggtaacccgtaaccggacccgtaaacggttcccctacccgggtcccccgttaaccgg

SEQ ID NO: 241617 - DNA, 715 bp, Homo sapiens
  misc_feature: GYAE6OF02JKEVL.38.5.A05.1.454.CMB.1.raw
  modified_base (155)..(155): a, c, t, g, unknown or other
  misc_feature (155)..(155): n is a, c, g, or t
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (552)..(552): a, c, t, g, unknown or other
  misc_feature (552)..(552): n is a, c, g, or t
  modified_base (567)..(567): a, c, t, g, unknown or other
  misc_feature (567)..(567): n is a, c, g, or t
tcagtcgatcacgtcacgaccggtgctcgatttagatagatagacagggggagagttcccaggtgtttccattcagtgatcagcactgaacacagaggactcaccatggagttgggactgagctggtattttcctttggctaagttttaaaaggngtccagtgtgaacgtgcagctggtggagtcgtgggggagtcgtggtacngccctggcaaggtccctagacgactctccgtgtagccnggccctgttcggattccgagttcgtttagnttagtagtttagnggtaccagttcgaccgtacgtcggggtccggaccgaagtcccgtaacggaggggaacgtccgtacgggtaggtccggggttactcggtaagggttaatttgggtaggtaaacgtaggttaggggacgttaaagtgggtaacttaggtcgggtaccggtaacttacggttcggaggggtaaccgggaacgttcttaaccggcgtacagtttccgacgaggactaacgacgtacccgaagtaccttcctagtatcaacgtagaccgagngtactagacgtacgngtacggagtacccggagttccgtttaagtacttacgtcgtacgtaaaggtaaccgtttgtttacggtaaagtttcgggaaattaacgggttacggttaaccttacgttaacggacccggtttaagccgggttactacgggtacccggg

SEQ ID NO: 241618 - DNA, 678 bp, Homo sapiens
  misc_feature: GYAE6OF02GIXH4.38.5.A05.1.454.CMB.1.raw
tcagtcgatcacgtcacgaccggtgctcgatttagatagatagacaggggggggggtctcaggaggcagcgctctcaggacatctccaccatggcctgggctctgctgctcctcaccctcctcactcagggcacagggtcctgggcccagtctgccctggctcagcctgcctccgtgtctgggtcctccgtggacagtcgatccaccatctcctgcacgtggaaccagcagtgacgttggtagttaattaattgtccttaccgtggtaaccaacacgaccgacccggacaacgtccgaaccccctaaaatcatagtattagtgacgtacactcacgtccgtcccgtacgtacgggtttactaacgtcgtacttctcgtcacctactaccgtagtcgtacgaccaacgccgtccctacccgtacgacctactccgtacggttcggaccctacggagtcgtaggacggtacgtagtactttaagtttcttcgtacgtcgtacttactaacttacgtaacccaacgtacgtaacctaacttaccgttcgtacgtaccgtttaaccggtacgggtaccgggaaccggtaccgaacggttccgttaccggtaacccgttaccgttaacgtcccgaaccggtaacccggtaaccggtccccgtaccccggtcccccgtaaccgg

SEQ ID NO: 241619 - DNA, 740 bp, Homo sapiens
  misc_feature: GYAE6OF02IEIFU.38.5.A05.1.454.CMB.1.raw
  modified_base (434)..(434): a, c, t, g, unknown or other
  misc_feature (434)..(434): n is a, c, g, or t
  modified_base (571)..(571): a, c, t, g, unknown or other
  misc_feature (571)..(571): n is a, c, g, or t
tcagtcgatcacgtcacgaccggtgctcgatttagatagatagacgaggggggggggtctcaggaggcagcgctctcaggacatctccaccatggcctgggctctgctgcctcctcaccctcctcactcgagggcacgagggtcctgggcccagtctgccctggctcagcctgcctcgtgtcgtgggtcctcgtggacaggtcgactccacctattcctccctggcctacgtcgggaaacccaggccgtaggttcgtacgggtttggtaggttaatttaagtttcgtcttccgtacggtaaccaacgtacgcccgacccgggactaacgtccgaaccccctaaaatcctaagtagttaacgttttagcggtacggtctacgtccgtacgtcccggcccgttaggtacggggtttactaacgtccgtctttcctntacgacctacgtaccgtaacgtcgtacgtaaccaaaccgtcccggtcccctcccgtaccgtacctacgtccgttccggtacgggtcctcccggagtccgtagggaacggtacggtagttacctttaatttcgttacncggttactagttacaacttaacgtaaccaaccgtacgtaacccgaccttaccgtctacggtacgttacggtaccgggaccggaccggtaacgacggtccgtaccggtaacccgtcgttaaccgtccgaaccgccccggtaacggtccctcccccggtaccccgttacgg

SEQ ID NO: 241620 - DNA, 607 bp, Homo sapiens
  misc_feature: GYAE6OF02JD0YT.38.5.A05.1.454.CMB.1.raw
  modified_base (155)..(155): a, c, t, g, unknown or other
  misc_feature (155)..(155): n is a, c, g, or t
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (363)..(363): a, c, t, g, unknown or other
  misc_feature (363)..(363): n is a, c, g, or t
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
  modified_base (457)..(457): a, c, t, g, unknown or other
  misc_feature (457)..(457): n is a, c, g, or t
  modified_base (492)..(492): a, c, t, g, unknown or other
  misc_feature (492)..(492): n is a, c, g, or t
tcagtcgatcacgtcacgaccggtgctcgatttagatagatagacagggggggggtctcagggaggcagcgctctcaggacagtctccaccatggcctgggctctgctgcctccctcaccctcctcactcgagggcacgacgggtcctggacccngtctggccctggctcagcctgccncgtgctgggtctccgngacngtcgatccacntctcctgcctncggaaccgtnacggtgacgttcggtagttataagttgtctcgtcgtacaancgcgaccggnatccgaccctaaactcagtctattcgaggacgtacactacagtcccggacctcggtggttactaacgtcgtcttcgtcgtnctacgtctagtcgagtccaactccggtactcccaagtccctattccgngttccggtcncgtacgcgtaggaccggtggacgttacttaagtttntactcgtactaacggttctactaacgactaaccgngtacaaccttcgtacccgttagtacttacggttacggccggtacggtaccgaacggtctacgggtaccgtactacggtaccgaacgtcccggtagtcccgacccgtcccgtaccg

SEQ ID NO: 241621 - DNA, 656 bp, Homo sapiens
  misc_feature: GYAE6OF02F4LKB.38.5.A05.1.454.CMB.1.raw
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
tcagtcgatcacgtcacgaccggtgctcgatttagatagatagacagggggggggtctcaggaggcagcgctctcaggacatctccaccatggcctgggctctgctgctcctcaccctctcactcagggcacagggtcctgggcccagtctgccctggctcagcctgcctcgtgtctgggtctcctggacagtcgatcaccatcctcctgcactacggaaccagcagtcacggttggtgttattaagttgtctccgtggtaccaacagcgacccggcaactccgaccccaaaatcactgattangtagctatcagtccgccctacgtacgggtttntaacttcgtcgttctcgtcgctactacgacgtgtcgacaacgaccgtccctccgtacacctacgtcgtaccgtcggtaccgtccgtacggtctacgggaacggacggtacgggtaacctttaaacgtttcgttttacgtccgtacgttacgttacgtaacgttaactaacccgtaacacgtaaccaaccgttaccgtcttacggacttaccgggtacgggtacgggaaccggaaccgtaacggtcgtaacccggtacccgttaccgttaaccgcgtaacccgggacccgtaacggtcccgtacccgtccccgttacccgg

SEQ ID NO: 241622 - DNA, 921 bp, Homo sapiens
  misc_feature: GYAE6OF02HU1B7.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggtattttcctttggcttaattttaaaaggtgtccagtgtgaagtgcagctgggtggagtcgtgggggagtcgttgggtacaggccgtgggctacggtccctgacgtacctctcctggtcgcacgtccctcgtaggtattcacgtcttttagacttaggtattagtggactagtcgcctacggtcggggtaccaggtaccaacggtcccgtaccgggaagggggtaccggggtcgtaggggtacggttcggggttacctacggttaagggtttagtttaagggtaacgggtaaacgtggggttacgggtaaacgggtagttacggggtacttaacggtcgggtaccgggttaacttcgggttagggtaacggggtaaaccggggtaccgttacgttaacggaaccgggttccttaacttccccggtaaccggtaaacgggtaaaaccgtaaaccccggaaacccgggtaaaccgttaaaaccggtttaaacccgtttacccggttaacggtaaaaccttaacccggttaaaaattaaacgggtaaccggtaaaacccgttagtaccggtaaacgggtacggtaacggttacggtaacgggtaaccgggttaacccggtaccggtttacgtttaacggttaacgttaacggttaggtaaccgttaagttaaaaggtttttcggtttaacgggttaaggtttaaacggtaagggttttaaaccgggtttacggttaacccgttaacgggtttaacggttaaccgggtttaaggttacgggggtacccgtttaaccggggg

SEQ ID NO: 241623 - DNA, 751 bp, Homo sapiens
  misc_feature: GYAE6OF02FNT8J.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggtattttccttttggcttaattttaaaaggtgtccagtgtgaagtgcagctggtggagtcgtgggggagcttggtacagcctggcaggtccccgagacctctcctgtgcagcctcgtggattcagtctttgattgtattagtggctatgccacgtcgggtccggctaagcctaccgaggggacgggtcctagggtggtgggtcctacgaggttagttaggttggaactagggtggtaaggataggtctagtcggcgactcgtggtaggagggtcctaagttcgaacgtctaacgttcctaccgaagtaccgacaaacccggaccaaaggttaaccttcccgtagttaacctaccgtaaactaaacgttacgaaacgtagtactaaggaagtacggtcgtagggaaacggtaccgtacccggttacgtttagttaacgtttacgttaggtacgtaaacgttaaaagggtttactttttacggggtaaagtttttaaagggaaacgggtttaagggggttttaaaaccggtttacctttaaacccggtttaaccggtttaaacgggtttaaccgggttaacggggttaaccccgggttttaccggggacccggggggttaaaccccggg

SEQ ID NO: 241624 - DNA, 725 bp, Homo sapiens
  misc_feature: GYAE6OF02GHRC8.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagacctctcctgtgcagcctgtggattcgagtctttgatgattagtggactatgcctacggttcggggtcccggacaacgccgtacccggaagggggaacggggtcccgtaggggacggttcggggtcctacggtagggttaagttttagggttcggtaaacgaggggttagggtaagggtaagttacggtctaggttcgggaccggtaacttcggttagggtacgggaaacggggtccgtagttccgagtacctacgttccctaccgaaggaaccgtaaccgaaacccgtaccaaacgtaacctttccccgtagttaactacctaaacaaagtacgaactagtctaggagtacgtcgtaggaacggaccgacggttcctttagttaacttacgtagtagtaacttaagttagttttacggtaaggtttaaggtaaggttaacggttaacggttaccttaacgttaacggttaacggtaggttacgggttaccggtacgggtaaccgggg

SEQ ID NO: 241625 - DNA, 653 bp, Homo sapiens
  misc_feature: GYAE6OF02JP2E2.38.5.A05.1.454.CMB.1.raw
  modified_base (193)..(193): a, c, t, g, unknown or other
  misc_feature (193)..(193): n is a, c, g, or t
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (396)..(396): a, c, t, g, unknown or other
  misc_feature (396)..(396): n is a, c, g, or t
tcagtcgatcacgtcacgaccggtgctcgatttagatagatagacgaggggggggggtctcaggaggcagcgctctcaggacatctccaccatggcctgggctctgctgctcctcaccctcctcactcagggcacgagggtcctgggcctagtctcgccctggctcagcctcgtcctcgtgtctcggtctccnggacagtcgatccacntctaccgtnctacaggaaccgacagttcgtacgttggtagttaataacgtttcgtctccgtcgtacaacgtccgccgaaccgggctaacgtccgaaccccaaagttcatacgtacttagcgtacgtctacctcgacgtccgtacctacggttacgggttacttactaccggttccttacgtaccgtntactactaccgtaacgtacggtcaaccgtaacgtccgtccctccgtaagtccctaatcctacgtcgtcctaaccggtgtcgtaggacggacgacgttcttaaatttcttcgtatcgttacgtacttaacgaactaaccgtactcgaactacgtacgttcgtactacgtcgtaaccgggacggtaaccggctaaggtcgtaccgtaaccttacgtacgtaccgtacgacccggtatcccggtaccctccggttacccg

SEQ ID NO: 241626 - DNA, 605 bp, Homo sapiens
  misc_feature: GYAE6OF02GJGUL.38.5.A05.1.454.CMB.1.raw
  modified_base (242)..(242): a, c, t, g, unknown or other
  misc_feature (242)..(242): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (378)..(378): a, c, t, g, unknown or other
  misc_feature (378)..(378): n is a, c, g, or t
tcagtcgatcacgtcacgaccggtgctcgatttagatagatagacagggggagattcccaggtgtttccattcagtgatcagcactgaacacagaggactcaccatggagttgggactgagctggattttccttttggctatttttaaaaggtgtccagtgtgaagtgcagctggtggagtcgtgggggagcttggtacagccgtggcagggtccctgagacctctcctgtgcagccttacnggatttccagtcttttgatgattatggcatgctacgtgggtccggctaagcctaccgaggggaacggccgngggnggtcgggtctacgagggtattaggttggaactaggtggtagggataggctatggcgacgtntaggagacggggcgtattcaggccagtctccgagacgacaacaccgaagaactcacgtgtgcgtcgcatacgagaaccgcgtagacgagggaccgaccggacgaccggtcgtacggttactaccgtttgtgttacggacggacggtaacccggacccccgacgttacgggagggtaccgtacggtaacgggttcggggaacgttccggtacggttacgttttaacgg

SEQ ID NO: 241627 - DNA, 702 bp, Homo sapiens
  misc_feature: GYAE6OF02IDGV8.38.5.A05.1.454.CMB.1.raw
  modified_base (211)..(211): a, c, t, g, unknown or other
  misc_feature (211)..(211): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (420)..(420): a, c, t, g, unknown or other
  misc_feature (420)..(420): n is a, c, g, or t
  modified_base (459)..(459): a, c, t, g, unknown or other
  misc_feature (459)..(459): n is a, c, g, or t
  modified_base (530)..(530): a, c, t, g, unknown or other
  misc_feature (530)..(530): n is a, c, g, or t
  modified_base (538)..(538): a, c, t, g, unknown or other
  misc_feature (538)..(538): n is a, c, g, or t
tcagtcgatcacgtcacgaccggtgctcgatttagatagatagacagggggagacttcccaggtgtttccattcagtgatcagcactgaacacagaggactcaccagtggagttgggactgagctggattttccgtttggcttaattttaaaggtcgtccagtgtgagtgcagtcgtggtggacgttcggtgggggacgtcgttaggtacncgccgttgggacctacggttacccgtggacctactccgttccgtagtcgccagtccctgtggtacttcgngttcctttagnttagtactttaaggcgtacagtcgacctacggtcgggtacgacaacgtcgtaccggaggggacggtccgtaggacggtcggtctaggtgttagtttaggtcggaagtaggtaggtagtacgttacggntaaggtcgccggtaatcgttaggacgacgggtctagcgngtacgactacgtcaggacaacgaaccgtacgtaactacctccgttggtactaacgtactaaagtctaacgngttaacgnggaacgtgaacggtacggacgacccgtggtacctttagttaagttcgtacggaacgtaaccgttaagtttacgtttaggtaagtttaacggtaaggtttaaccggttaagtaaccggttagtaccggttaaggtccggttaagggtaccgttggtaacccgggg

SEQ ID NO: 241628 - DNA, 674 bp, Homo sapiens
  misc_feature: GYAE6OF02I3W15.38.5.A05.1.454.CMB.1.raw
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
tcagtcgatcacgtcacgaccggtgctcgatttagatagatagacaggggggggggtctcagggaggcagcgctctcaggacatctccacatggcctgggctctgctgctcctcaccctcctcactcagggcacgagggtcctgggcccagtctcgcctcggctcacgcctgcctccgtgtcgtcgggtctccgtggacacgtcgatcaccntctctcncacgtacgaaccnggcaggtcggtaggtggttaggttaattaacgttcgtacctccgtacggtaaccacgtacgaccgtaccggactaacgaccgaacccctaaaatccgaaagttatagtttaactagggtacgtacctacctacgtaccgtccggaccttacgggttacgggttacttaacgtccgtcctttcgtactcgtaactcgttaccaagtcgtacggtaccgaacccgtacccgggtccttacccgtacgtaaccgtactaccgtcccgggtcggtacccgtaccggtacggttcgacgggaacggaacgtacgttaacttaagtttctactacggtctaagtactacgtaactacaactagaccaacgtctactacgtacgtacgtacggagacgagccgtagcgttacctacgtaacgacgacgacgcgtcctccgtacccgtcg

SEQ ID NO: 241629 - DNA, 761 bp, Homo sapiens
  misc_feature: GYAE6OF02IG5SW.38.5.A05.1.454.CMB.1.raw
  modified_base (247)..(247): a, c, t, g, unknown or other
  misc_feature (247)..(247): n is a, c, g, or t
tcagtcgatcacgtcacgaccggtgctcgatttagatagatagacaggggggggggtctcaggaggcagcgctctcaggacatctccaccatggcctgggctctgctgcctcctccacccctcctcactcgagggcacgaggggtcctcgggccctaggtctcgcccctggcctcagcctcgcctcgtgtcgtggtctccgtggacagtcgactaccacctatcgtcctgacctacgtacggaaccngtacgtaggtggtacgggtttgggttaggttaatttaaacgtttcgtacccttccgttacggtaaacccaacgaccggacccggacccgggtaactaaacgtccccggaaaccccctaaaattccgtaagttagtaacttttagacggtacggtaccactacgacgttacccgggtccttacgggttacggtttactactccgttcttctacgtacgtactaacttacgtacgtccggtacgaacccaaccggtccgtccccttacccgtaccgacctacgtacccgttcggtaccgggcctaccggacggtcgtacgggaacggacggttaacgttactttaacgtttcttcggattaccgtacttactaataaccgaaccaacgtacacctaaactccgttctacgtacgttaccgggtacgggaccggaacggacgtaccgtaccgtaccggtaccgtaaccgaaccggtacgaccgtaacccggtacggtccctaccccgggtctacccg

SEQ ID NO: 241630 - DNA, 666 bp, Homo sapiens
  misc_feature: GYAE6OF02GNT1A.38.5.A05.1.454.CMB.1.raw
  modified_base (420)..(420): a, c, t, g, unknown or other
  misc_feature (420)..(420): n is a, c, g, or t
  modified_base (564)..(564): a, c, t, g, unknown or other
  misc_feature (564)..(564): n is a, c, g, or t
  modified_base (578)..(578): a, c, t, g, unknown or other
  misc_feature (578)..(578): n is a, c, g, or t
tcagtcgatcacgtcacgaccggtgctcgatttagatagatagacaggggggggggtctcaggaggcagcgctctcaggacatctccaccatggcctgggctctgctgctcctcaccctcctcactcagggcacgagggtcctgggcccagtctgcctggctcagcctcgcctcgtgtcgtgggtctccgtaggactgtcgactcaacctattcgtcctgaccacgtacggaaccagtcaaggtcggtacggttggttacgttaatttaaacgtttcgtacctccgttacggtaccaaacgacgccgacccgggacaactcccgaacccctaaaatcctattacgttattagtacggtacgtcctaacctctacggtcccgtccgttcgggttacgggtttacctagtcgttcttactcncgtactactacggtatcgacgaaccgaacggccgtcccgtaccagtacctacgttacgtcggtacggtcctacggagcgtacggacggtacggtagtactttaagtttactcgtcgtacgttatacgtacttaacactaccganactaacgtctcgtnaacgttcggtcgggaacgtacgtccgaacggcttaccgtaaccgtagtaccacgaccggtaccacggtccgtacccgtccgtacccgg

SEQ ID NO: 241631 - DNA, 766 bp, Homo sapiens
  misc_feature: GYAE6OF02F75IY.38.5.A05.1.454.CMB.1.raw
  modified_base (204)..(204): a, c, t, g, unknown or other
  misc_feature (204)..(204): n is a, c, g, or t
  modified_base (432)..(432): a, c, t, g, unknown or other
  misc_feature (432)..(432): n is a, c, g, or t
tcagtcgatcacgtcacgaccggtgctcgatttagatagatagacagggggagattcccaggtgtttccattcagtgatcagcactgaacacagaggactcaccatggagttgggactgagctggtattttccttttggcttaattttaaaaggtgtccagtgtgaagtgcagctggtggagtcgtgggggaggtcttggtacngccgtggcacggtcctgagaccttctcctgtcgcacgtcctcgtaggtattccgagtcctttggacttaggtatttagtcggactagttcgccgtacgggttcggggtacccgacgtaacggtcccgtacccggggaagggggaccgggtcgtaggggtacggttgggtactacggtaggtttaaggttagtaacgggacttagggtggtacgagtcggatagtcggngtacctgtgtacggaacggctacttcgacggtactcgttccgactaagacgtaaccgaaccgacctaagtaccttccgtatacctaactaactaaacgtacgtaacgtacgttaccgagtaaccggtaacgtccggtaaggaacccggtaaccgggttaccctttcgggttaaacgttttaccgtaacgttcggttaaacggtaaccgtttaagttttaccgttttaggttaacgttaagggtttaacggttaaacgggttaacgttacctttaccggttaaccgggtttacggtaacggttccgggtttaacccggaggggttaaacccgggg

SEQ ID NO: 241632 - DNA, 632 bp, Homo sapiens
  misc_feature: GYAE6OF02JC226.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcagtctttgatgattagtggcatgctacgtggggtccgacaaggcctaccggaaggggaacgggtcctagggaggttgggtctacgtagggttattaggtggaactaggtgggtaggagtaggcttagtggacggtactgtaggtaggaacggggcctagttcgagtctatccacgagacgaacaaccgacctaaagtacttccgtagtaactactaaacaaatacgaactacgtctagaagacgtcgtaggaacggacgtaccggtccttagttaacgttacgtagtacgtaacgtaaagtttagtttaggtaaggtttaaggaaggtttaaggtaacgggttacttaacgttaacggttacggtagtacggtacgttacggtacgggg

SEQ ID NO: 241633 - DNA, 709 bp, Homo sapiens
  misc_feature: GYAE6OF02I8XB2.38.5.A05.1.454.CMB.1.raw
  modified_base (201)..(201): a, c, t, g, unknown or other
  misc_feature (201)..(201): n is a, c, g, or t
  modified_base (520)..(520): a, c, t, g, unknown or other
  misc_feature (520)..(520): n is a, c, g, or t
tcagtcgatcacgtcacgaccggtgctcgatttagatagatagacgagggggagattcccaggtgtttccattcagtgatcagcactgaacacagaggactcaccatggagttgggactgagctgggtatttttccgtttggacttaagttttaaaggtgtccagttgtgaagtgacagtctgggtggagtcgtagggggngtctacggtacagccgtggactaggtccctgacgacttctccgtggtgaccacgtcctgtaggtactcaggttcttttggaacttggtaattgtcggaactgttcgctacggtcggtaaccacggtacgaagtcccgtaaaccgaggggtaacggtcctagggtaacgttcgggtcctaggtaagggtttactttaaggttaggaaaccgttgggtacggtaggtaacgtgggtactacggtggtacggtcctggtagtacggagggtcctaagttcgagtcgtactacgtccgaagactaacggaccgacgttaaacnccgtttacctcgtaaactcgtaaacgtaagtacgtaacgagttccgaagtcgaggttccgtagaacgtccgaccgttagtttctaacgttaacgtgtaagtaactaaggtttgttaacggttaaggttctaaaaggtcggttaaggtaccttaacggttaccgagggtttagttaccggtgttaacggg

SEQ ID NO: 241634 - DNA, 782 bp, Homo sapiens
  misc_feature: GYAE6OF02FJSGG.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggattttcctttggctattttaaaaggtgtccagtgtgaagtgcagctggtggagtcgtgggggaggcttggtacagcctggcaggtccctgagactctcctgtgcagcctcgtggattcagtctttgattgattagtggcagtcgctaccggtcggggtaccgcaacggtccgtacccggaagggggtaaccgggccgttggggaacggttcgggtcctaggtaagggttaagtttacggttacgggaaacgtagggtttggggtaacgggtacgttaaggggacttagtgggaccgggttaacctcggttagggtacggggaaaccggggtcccgttaaagtttccggacgtacccgtaagttacccgtaccgaaggaacgtaacccgaaacccggtaacccgtaaaacggttaacctttaccccgttaaggtaacttacccgtaaaactaaacgtaacggaaactacggttacgtacgggaacggtacggtaccgtacgggaaccggaccgtaccgggttaccgtttagttaacgtttacgtggtacgtaaacgttaacgttagtttaggtaacggttttaagggaacggtttaacggttaacggttacgtacgttacggttaaccggttaggtacgggtacgtacggttacgggg

SEQ ID NO: 241635 - DNA, 584 bp, Homo sapiens
  misc_feature: GYAE6OF02GDR2A.38.5.A05.1.454.CMB.1.raw
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (479)..(479): a, c, t, g, unknown or other
  misc_feature (479)..(479): n is a, c, g, or t
  modified_base (503)..(503): a, c, t, g, unknown or other
  misc_feature (503)..(503): n is a, c, g, or t
tcagtcgatcacgtcacgaccggtgctcgatttagatagatagacaggggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtagttataaatttgtctcgtggtaccaanacgcacccgggnaatcgaccccaaaatcatagtatttagtgaggtcactcactccggccttgtacggggtttctaactcgtcttctctcgactactactaagtcgtgacctaacgaccggtccctaccctagacctacttacctcggtcggtcctaccgaggtcgtaggacgggtacgacggttacttaaatttactttcgtagtctacgttanacttaactaaccaccagtacaacncttctgtactagtcggacgacggaccaagtcacggtaccctacgtaacgccacggaccaacggtcctacccgcccgttacg

SEQ ID NO: 241636 - DNA, 945 bp, Homo sapiens
  misc_feature: GYAE6OF02FQ4VI.38.5.A05.1.454.CMB.1.raw
  modified_base (142)..(142): a, c, t, g, unknown or other
  misc_feature (142)..(142): n is a, c, g, or t
  modified_base (194)..(194): a, c, t, g, unknown or other
  misc_feature (194)..(194): n is a, c, g, or t
tcagtcgatcacgtcacgaccggtgctcgatttagatagatagacaggggggggggtctcaggaggcagcgctctcaggacatctccaccatggcctgggctctgctgctcctcaccctcctcactcagggcacagggtccngggaccagtctgccctggctcagcctgcctcgtgtctgggtctccgtggacngtcgaatccactatcctcctagtccacgttcggaaccagtcacgttgaccgggtttgggttacgttaattaaatttgtaccttccgtacggttaaccctaaacgacgacccgtaacccggggaccaaaacggttccgtaacccccgaaaacttaccgtagttaacggttaacttttacgtacggggtaaccggttaacctaaccgttaccgtaacggttcccgggttccccctaagggttacgggggttttaccttaaacgttccggtacctttacggttccgttaccggtacgtaacgtttaaccgtaaacggtttcctaacggggtaaccctaaacccgttaaccgggtaacccccgttttacccgttaaccggaacccttaactttaccccggtttaccggttaaccggggaccccgttttacccgggaaacccgggtaccgtttacggggaaaccggtaaacggggttacccgggtaacgtttaaaacggttttatttaccggtttaccgggtacctttaaccgggtttaacaaacgttaacccgttaaaacccgtaaccccggtaaacgaaaccgttaaccgttaaccctaacggttggttaaaccgttaccggttaccgggggacccggttaacggaacccggtacggttaacccgttacccggtaacccgtttaaccgtaaacggttccggaaaccggttaccccggaagggttaccccttcccgggttaccccgggttaccgg

SEQ ID NO: 241637 - DNA, 611 bp, Homo sapiens
  misc_feature: GYAE6OF02FPLXN.38.5.A05.1.454.CMB.1.raw
  modified_base (186)..(186): a, c, t, g, unknown or other
  misc_feature (186)..(186): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (266)..(266): a, c, t, g, unknown or other
  misc_feature (266)..(266): n is a, c, g, or t
  modified_base (312)..(312): a, c, t, g, unknown or other
  misc_feature (312)..(312): n is a, c, g, or t
  modified_base (501)..(501): a, c, t, g, unknown or other
  misc_feature (501)..(501): n is a, c, g, or t
  modified_base (518)..(518): a, c, t, g, unknown or other
  misc_feature (518)..(518): n is a, c, g, or t
tcagtcgatcacgtcacgaccggtgctcgatttagatagatagacgagggggggggttctcaggaggcagcgctctcaggacatctccacatggcctgggctctgctgctcctcaccctctcactcagggcacagggtcctggccagtctgcctggctcagctgcctcgtgtctggtctactgacngtcgatcaccatctccngccacgtcggaaccngccgtagtcggacggttggtcgttattaattgtacctcgtcgtaccanacgcgaccggacaacgtaccgaccccaaatcgtatacgtacttagngtacgtcacttcgacgtccggtacctaggtacgggttactaagtccggtactttccgtctacgtctactcgtaacgtctacggaccaaccgtccggtccctacctcgtacccttacgtcgtccggtacgtcgaccggtagcgtagaacggtacgaggttactttaattcggtgtatactagtacattanacacaacgtcaacttcngtctacgttgttaccgggacgtacggaacgtaggtacctacgacgttaacgacgttacggaccgtaacggtaccgctaccccggtctacccgg

SEQ ID NO: 241638 - DNA, 763 bp, Homo sapiens
  misc_feature: GYAE6OF02I1NAF.38.5.A05.1.454.CMB.1.raw
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
tcagtcgatcacgtcacgaccggtgctcgatttagatagatagacagggggggggtctcgaggaggcgagcgctctcaggacatctccaccatcggcctgggctctgctgctcctccaccctcctcactcgagggccacgacgggttcctcgggccctaggtcctcgcccgtggactcacgcctgcctccgtgtcgtggtctccgngacngtcatccacatctctgcacnggaaccngtcgagtgacggttggtacgtttaattaagttacgtcgtaccgtacggtaaccaactacgacccgaccgggtactaaacgtaccgaacccctaaaacctccgtaagtacgtaacgtttaacgtagtacggtacctaacgtactacgtacccggtacccgttacgttacgggtttaacctaacgttccgttcgtttaccctacgttgaaccctaacgtacccaacgttaacggcgtaaactaacccgtacccgggtacccttacccgtacgtaaccctacgttacccgtcggttaccgggtccctacgtacggtacgttacgggaccggtacggtaacgtaacgttaaacttttcgttcgtacgttacgtacgtacctaaacgtaactaccgtaaccacgtaaccgtaactaccgttactacgttaccgttaacgttccgggacggtaacggaacgtacgaccgttacggaacccgttaacgtacgtaccgaccgtaccgtaacccggccgtacccgtccccgtacg

SEQ ID NO: 241639 - DNA, 830 bp, Homo sapiens
  misc_feature: GYAE6OF02GLW3R.38.5.A05.1.454.CMB.1.raw
  modified_base (252)..(252): a, c, t, g, unknown or other
  misc_feature (252)..(252): n is a, c, g, or t
tcagtcgatcacgtcacgaccggtgctcgatttagatagatagacgaggggggggggtctcaggaggcagcgctctcaggacatctccaccatggcctgggctctgctgctcctcaccctcctcactcagggcacgagggtcctgggcccagtcctcgccctggcctcagtcccgtcgcccttccgtgttcgtgggtccttccgtggacagtcgactccacctactcctccgtgactaccgtacggaacccngctaaggttcggtacggtttgggttaggttttaaattaaaacgttttgttcccttccggttacggttaaaccccaaacgaccggtaccccggaacccccggggtacaaacgttcccgaaacccccctaaaaactccgaagttagttaacttttagtcggtaacggtcctacctcgtaccgtcccggacccttacgggttacggggtttacctaacgttccgttaccgtttctcgtacgtacctacgtacccgtaagttccgtacgggtaccaacccggtacccggtccccttacccgtacccgaccgttactttacccgttccgggtccgggccgttacccgggaaggttccggtaacgggaaccgggtaccgggttaacgggttacttttaaacgtttcgtttaccgtcgttacgtaggtttaacctactaacgtaaaccgtaccaacgtaaccgtaaccttacgtaccgtctacggttaacggtccgggacgggtacggtaccgaacggtccgtaacgtacccttaacgaccgtaccgccgtaacccgacggtcccgtacccgtccccggttaccg

SEQ ID NO: 241640 - DNA, 831 bp, Homo sapiens
  misc_feature: GYAE6OF02JG6RJ.38.5.A05.1.454.CMB.1.raw
tcagtcgatcacgtcacgaccggtgctcgatttagatagatagacagggggagattcccaggtgtttccattcagtgatcagcactgaacacagaggactccaccatggagttaggactgagctggtatttttccgtttggcttaattttaaaggtgtaccagttgtgaagtgcagcgtggtgagtcgtggggagtcttggtacacgcctggcacggtccctgacgaccttctccgtgtcgccgacgtcctgtggtacttccgagtcgtttagacttaggtaatttacgtcggtactacgtggtaccgtacggttacgggggtcccgaactaaacggttcccgtacccggggaaagggggtaaccgggtcccggtagggtaccggttcgggtttaccgtaggttaacggtttaaggtttacggttaaggaacgtagggttacgggtaaggtacgttacggtacgttaggtaccgggacggttaaccgtttcggtaagggtacggtaacgggtaccttagttaccggacgtaccgtagttcccgacgtaaggtaaccgaaaccgtaaaccgtcctaaaacgttaccgtttcccgtaagtaacttaccgaaacttaacgaacggtaacctagttcgtaaacggagtaacgtcgtaacggacgtaaaccgtccggtttacgtttaagttaaccgttagttaacggtaaccgtaacgtttaaaccgttttagttttacggtaaacgggttttaaggaaccggtttaaacggtacggtttaaccgtaacctttaaggggtaccttagggtaaccggttacggtcgggtaaccgggg

SEQ ID NO: 241641 - DNA, 815 bp, Homo sapiens
  misc_feature: GYAE6OF02IQOUS.38.5.A05.1.454.CMB.1.raw
tcagtcgatcacgtcacgaccggtgctcgatttagatagatagacagggggagattcccaggtgtttccattcagtgatcagcactgaacacagaggactcaccatggagttgggactgagctggatttttccttttggcttattttaaaggtgtccagtgtgaagtgcagctggtggagtcgtgggggagtcgttggtacagcctggcaggtccctgacgtactctcctgtcgacagcctcgtaggtacttcagttctttgattgtaatttacgtggactagttcgacgtacggttcggggtaccgacaacgtccgtaccgggaaggggaacgggtccgtagggtacggtcgggtacttacggtagggtttaattaggttacggaaacggtggttaggggtaggtatagggtactacggtacggacggtacttgtacggtaggaacggggtcctagttacgacgtctacgtccgtaccgtaggaaccgaaccgaccgaaccgtaaacgttaacctttccccgttaagttaaccttaaccgtaaacgtaaaacgtttaccgtaaaccgttacggttacgtaacggtaacggtaaccgttaccggtaacgggaacgggtaacccgttacccgggttacgttttagtttaaccgttaaccggttaggtaaccgttaaacgttaaacgtttttaggttttaacgggttaaggttttaacgggtaaagggtttaacgggttaaccggttttaacgtaaccgtttaacccgggttaaggtttaccggttacgggttacccggtttcggggtaacccgggg

SEQ ID NO: 241642 - DNA, 948 bp, Homo sapiens
  misc_feature: GYAE6OF02JEWZT.38.5.A05.1.454.CMB.1.raw
tcagtcgatcacgtcacgaccggtgctcgatttagatagatagacaggggggggggtctcaggaggcagcgctctcaggacatctccaccaatggcctgggctctgctgctcctcaccctcctcactcgacggcacgtaggtcctgggcccagtctcgccctggctcacgcctcgcctcgtgtcgttcgggtcctccgtcggactagtcgtactaccacctaagttcctaccctcggacctaccgttacggaaccctagtccgaaggttcggtaccgggtttagggtttaaggtttaaacttttaaagtttttcggttcccttacccggtttaacggttaaacccgtaaaccggaccggtaccccgggtaacccccggggtaccgttaaaaccggtaccccgaaaccccccgtaaaaacgttcccgtaaaagttacggtttaacgtttttaggtaaccggggttaacggttacctaaacccgtttccgtaaaccggtttccccggtaaccccgttttaacggggttttaacccgggggttttacctttaaaacccggttttcccggttccctttaccgttccggtttaccgtaccgttaaaccgttaacccgttaaacggttccggtacgggtaaacccaaacccggggtaccccggttaccccgtttcccgtaacgtaccccgtagttaccccgttccggttaccgggtcccgttacccgggtacggtacggtacgggaaccgggtaacggtacgttacgtttaaacgtttacgttccgttacgtccgttacgtactactaacgtaacctaacgaactacgtacctcttaccgtcttaacgtacgtaccgggtacggtacggaaccggtaacggtccgtaaccggtaccgttaaccgtaacgtaaccgtaccggaccggtacggtcccgtacccgtcccgttacccg

SEQ ID NO: 241643 - DNA, 850 bp, Homo sapiens
  misc_feature: GYAE6OF02IRHUU.38.5.A05.1.454.CMB.1.raw
tcagtcgatcacgtcacgaccggtgctcgatttagatagatagacaggggggggggtctcaggaggcagcgctctcaggacatctccaccatggcctggctctgctgcctcctcaccctcctcactcagggcacgagggtcctgggcccagtcctgccctggcctcgagcctgcctccgtgtctgggtctccgtggacagtcgatccaccatcctcctgccacgtacggaaccagctaggtcgtacggtttgggttaggtttaagttaaacgttttgtccttaccgttacggtaaccctaacgtacgaccgtaccccggggactaaacgtacccgaacccccgtaaaactcccgtaagttacgttaattttaggtacggtaccggttaccgtacctaccgtacgtacccgggtccccgttacggttaaccggggggttttaccttaaccggttaccggttccttttccggtacgttacggcccttaacgttacccgtaacgttccgtacgtaaccgaccgaacccgggtccccttacccgtacgaccctacgtaccgtacccggtcgggtaccctaccggacggtccgtacgggtaacggacccgggtaacggtactttaaacgttttacgtttaccgtcgttaacgttacggttaacctacgttaacctaaccgtaaccaacgaactaaccgtaaccgttcgttacgtaaccgttacgttaccggggaccgggtaaccgggtaaccggtaacgggtaccgttacccggttaaaccccggtttaccggtaaggtttacccgaccggtacccggaaccggttcccgttaccccggttcccccgttacccgg

SEQ ID NO: 241644 - DNA, 729 bp, Homo sapiens
  misc_feature: GYAE6OF02H49O7.38.5.A05.1.454.CMB.1.raw
tcagtcgatcacgtcacgaccggtgctcgatttagatagatagacaggggggggggtctcaggaggcagcgctctcaggacatctccacatggcctgggctctgctgctcctcaccctctcatcgaggcacgagggtcctgggcccagtctcgcccgtggctcgagccctgcctccgtgtcgtcgggtctccgtggactaggtcatccaaccacttcgtcctggacctactacggaaaccagtaccaggtacggtacggtttggtaggtttaattaagtttcgtcttaccgtacggtaccaaaacgcgaccgtaaccggactaacgtaccaaacccctaaaatctaagtacgttaattagtaggtcgtacacgtctacgtcccgccgtacgttacgggtttactacgtcgttccttcgttctcggtactactacgtaacgtcgtacggtaagtaaccacccggttccctaccgtaccgaactcgtacccgttcgtaccgggacgtaccgtaggtacgtacgggaacggacggtacgttaacctttaatttacgttacgtcgtaacgttacgtaataacttaaacaaccgaaacgactaacgaacctcttaaccgcgttaacttacgggacgggaccggttaccggacgttaacgacccgtagtaaccgttaaccggaccttacgaacccggttaccggaacggttcccgttccccggtacccgttccgg

SEQ ID NO: 241645 - DNA, 815 bp, Homo sapiens
  misc_feature: GYAE6OF02GHW31.38.5.A05.1.454.CMB.1.raw
  modified_base (344)..(344): a, c, t, g, unknown or other
  misc_feature (344)..(344): n is a, c, g, or t
tcagtcgatcacgtcacgaccggtgctcgatttagatagatagacaggggggggggtctcaggaggcagcgctctcaggacatctccaccatggcctgggctctgctgctcctcaccctcctcactcagggcacgagggtcctcgggcccagtctcgcccgtggcctcacgcctcgccctccgtgtcgtgggtcccccccctgtggacagtcgatccacctatctcctgcacgtacggaaccagctaggtgtacggttggtaggttaattaaatttgtcctcctggtaaccaacgagccacccgggacaactccgaaccccctaaaatccaagttgtatttagnggtacgtcctactcacgtccggcccttacggttacggggtttactaacgttccgtactttccgtcgtcgacctaacgtaccgtaagttcgtacggaaccgaacccgacccggttccctacccgtacggtaaccctacttcccgttaccgggtaccgggtcccttacccgggtacgggttaccggtaacggggaaccggggtaaccggtacgggttaaccttttaaacgttttaccgtttttccggtacgttacccgttacgttttaaccgtaaacgtttaaacctaaacccgtaaaccgtaccgtaacctaacccttacccgtttcgtaaccgttaccggttaacgggttcccggggaccggggtaaccggtaaccggtaaccgtccggtaacccggtaacccgttaccgttaacggtaccacccgggtaaccgtaccggtacccgtaccccggtcccccggttaacccgg

SEQ ID NO: 241646 - DNA, 154 bp, Homo sapiens
  misc_feature: GYAE6OF01AJNF1.19.68.G02.1.454.CMB.1.raw
  modified_base (153)..(154): a, c, t, g, unknown or other
  misc_feature (153)..(154): n is a, c, g, or t
tcagtactctcgtgcacgaccggtgctcgatttagtcgatagtgaagggaaagggaccagggtggaaatcaagcgaactgtggctgcaccatctgtcttcatcttcccgccatctgacacgagagtactgagcgggctggcaaggcgcatagnn

SEQ ID NO: 241647 - DNA, 153 bp, Homo sapiens
  misc_feature: GYAE6OF01BGWYR.19.68.G02.1.454.CMB.1.raw
  modified_base (153)..(153): a, c, t, g, unknown or other
  misc_feature (153)..(153): n is a, c, g, or t
tcagtactctcgtgcacgaccggtgctcgatttagtcgatagtgaagggaaagggaccagggtggaaatcaagcgaactgtggctgcaccatctgtcttcatcttcccgccatctgacacgagagtactgagcgggctggcaaggcgcatagn

SEQ ID NO: 241648 - DNA, 547 bp, Homo sapiens
  misc_feature: GYAE6OF01BSB16.19.68.G02.1.454.CMB.1.raw
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtgtcctgtcacaggtgcagctgcaacagtcaggtccaggactggtgaagccctcgcagagcctctcactcacctgtaccatctccgggacagtgtctctagtgacagcgcaacttgggactggctcaggcacgtcccatcgagacggccttgagtggcgtgggaaggacatactacaggtccacgtggtatgatgtattatgcagttatcgtagtagaaagttcgtaatttaccattaacgccaagacacataccaacgaacctacgttctaccctgacctacgttacgtaaccttcttcgtacgacctccccgaacgtaccgaccggtcttacgtccttaattacgtcgtagacgaagtcgactacggacgtaaggggtaaacgtacg

SEQ ID NO: 241649 - DNA, 516 bp, Homo sapiens
  misc_feature: GYAE6OF01CVR39.19.68.G02.1.454.CMB.1.raw
tcagtactctcgtgcacgaccggtgctcgatttagtcgatagtgaagggaaaggggcagagcctgctgaattctggctgaccaggacagtcaccagagctccagacaatgtctgtcgccttcctcatcttcctgcccgtgttgggcctcccatggggtgtcctgtcacaggtgcagctgcaacagtcaggtccaggactggtgaagccctcgcagagcctctcactcacctgtaccatctccggggacagtgtctctagtgacagcgcaacttgggactggctcaggcagtccccatcgagagccttgagtggctgggaaggacatactacaggtccacgtggtatgatgattatgctagtatctgtagtaaagtcgatttaccattaacgccagacacactaccaagaacctagttcctaccctgacctaccgttacgtaacttcgtgtacgacctcccgacgacaccggtctgtctatttactgtacgcaagtacgctagacgaagggaatacg

SEQ ID NO: 241650 - DNA, 594 bp, Homo sapiens
  misc_feature: GYAE6OF01EGE77.19.68.G02.1.454.CMB.1.raw
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctccatggggtgtcctgtcacaggtgcagctgcaacagtcaggtccaggactggtgaagccctgcagagcctctcactcacctgtaccatcgtccggggacagtgtctctagtgacagcgctaacgttgggactggctcgaggcacgtcccagtcgagacgtccttaggaggtggcgtaggggaacgactaatacgtaacgtacggtaccgtaacggttggtaactgaagttagtaattagtgacgtagttactacgttaggtaagtaaaacgtcgttaactttaaccaagttaacgaccaagtaccaactactaccgaaacgtacctacttcctactcgactactacgtaacttcgtagtaccgtaccaccgaacgaccgtacgtcttacgtacttattacgtggtacgacgaaacggtcgacgtacgacgtaaagggtactaacg

SEQ ID NO: 241651 - DNA, 648 bp, Homo sapiens
  misc_feature: GYAE6OF01C7YO6.19.68.G02.1.454.CMB.1.raw
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtgtcctgtcacaggtgcagctgcaacagtcaggtccaggactggtgaagccctcgcagagcctctcactcacctgtaccatcgtccgggacagtgtctctagtcgacagcgacaacgttgggactggctcgaggcacgtccccagtcgagacggtccgttggaggtggcgtaggggaacgactaacgtacgtaacgtacggtaccgtacggttaggtagtacgagttagtaactttagtcgacttagttacttcgtaggttaaacggtaaaacgttcggttaaacttttaaccgtaagtttaaacgacctaacgtaaactaaccgtaaccgtaccgtaaacgtaacccgttacgtttaccctacccgtcgtaccttacgttaacgtaccttacgttcgtaccgtaccgtcccggaacgtaccgaccggtcttcgttactatttacgtgtacgtacgaacggtcgtacgtacgacgaaagggtaacgtacg

SEQ ID NO: 241652 - DNA, 532 bp, Homo sapiens
  misc_feature: GYAE6OF01C3NMB.19.68.G02.1.454.CMB.1.raw
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtgtcctgtcacaggtgcagctgcaacagtcaggtccaggactggtgaagccctcgcagagcctctcactcacctgtaccatctccggggacagtgtctctagtgacagcgcaacgttgggactggctcaggcacgtccccatcgagagccttgagtggcgtgggaagcatactacgaggtccacgtggtatgatgattatgctagtatcgtagtagaaagtcgtaatttaccaattaacgccagtacacactaccaagaacctagttcctcccgtagcctacgttacgaacttctacgtacgacctcccgacgacaccggtctcgttcctagttacgtgtacgacaggacgacgtacggacaggggaaagtacg

SEQ ID NO: 241653 - DNA, 624 bp, Homo sapiens
  misc_feature: GYAE6OF01A25FE.19.68.G02.1.454.CMB.1.raw
  modified_base (200)..(200): a, c, t, g, unknown or other
  misc_feature (200)..(200): n is a, c, g, or t
tcagtactctcgtgcacgaccggtgctcgatttagtcgatagtgaagggaaagggggcagagcctgctgaattctggctggaccagggcaggtccaccagagctccaggacaatgtctgtcgccttccgtcactcgttcctcgacccgttgttgggcctcccatgggggtgtcctcgtcacacggtcgccagctgcaacngttcaggtccaggactggtacaagccctacgcaggacgcctctacacttcacctggtaccatccgtccgggacagtcgtactctaggtcgacacgccgacgtaacgttcggactggctcgaggcacgtcccatcgagacgcgttggcgtggcgtgggaagcatacgtacgaggtccacggtgtatgtatagtattagcgactagtacgtctaggttagaaacgttcgtaaacgtttaaccgaagtttaaacggccgtaagtaaccgtaacctaacgttacccgaaacggtaaccctaacggtttacctacccgttagacctacgtttacgtaaccttcgttacgtcgaccgttaccgacgacacggtactacgtactaactacgtcgtagacaacgtacgactacggacgtagggtaactaccg

SEQ ID NO: 241654 - DNA, 787 bp, Homo sapiens
  misc_feature: GYAE6OF01EN8HJ.19.68.G02.1.454.CMB.1.raw
  modified_base (159)..(159): a, c, t, g, unknown or other
  misc_feature (159)..(159): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttggcctccagtggggtntcctgtcacgaggtgcagctgacaacagtcgacgtccgaggtactggtacgaacgcccgtacgcagacgtccctctaccacctcgaccgttacggtacccagtcccggtaccggggactacggttcgtctacgtagttcgacgacggcgtacgtaacgtcgggacgtcggctaccgacggccacgtccccagtcgagtacgtctgacgtggacgtagggacgacgtactacgtacgacggtacgacggttggtagtagtagtacgtagttagtacgtacgttaagttacgttacgttaaggtaacggtaaacgttaccgtttaaacgtttaaccgtaacgtttaacgaccgtaacgtaacctaaccgtaaaccgttaaacccgtaaaccgtaacccgtttaaccgtttaccccttacccgttaacgtaacccgttaccgttttaaccgaaccgtttaccgttaggttacccgtaacccggttaccccggtaaccggtacccggttacccgggttaccgttttacggttaccgtttaaaccggttttagtaccgggttaaccgtaccggtaaacggtacggttacccggtaccggtaaacggggtaaaaccggggttacgttaaaccgg

SEQ ID NO: 241655 - DNA, 154 bp, Homo sapiens; identical to SEQ ID NO: 241646
  misc_feature: GYAE6OF01CN219.19.68.G02.1.454.CMB.1.raw
  modified_base (153)..(154): a, c, t, g, unknown or other
  misc_feature (153)..(154): n is a, c, g, or t

SEQ ID NO: 241656 - DNA, 593 bp, Homo sapiens
  misc_feature: GYAE6OF01EWSHZ.19.68.G02.1.454.CMB.1.raw
  modified_base (160)..(160): a, c, t, g, unknown or other
  misc_feature (160)..(160): n is a, c, g, or t
  modified_base (394)..(394): a, c, t, g, unknown or other
  misc_feature (394)..(394): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtntcctgtcacaggtgcagctgcaacagtcaggtccaggactgggtgaacgccctcgcagagccctctcactcacctgtaccatccgtccgggacagtcgtctctagtcgacagcgcaacttggggactggctcgaggccacgtccccagtcggagtacggtccgtttaggaggttgggccgtaggggaaggactacgtaactacgaggtaccgaggtggtatagatgtaatttangactagtactcgtagtagaaagttacgtatttaaccaagttaacgaccagaccaactactaccaacgaacctacgttcctccgtgacctacgttgaactcgtcgtacgtaccgtccgacgaccgtaccggtcttcgttaccttaattacgttggtacgtacgaacgtacgtacgtaccgacgggtaaacggaaagtacg

SEQ ID NO: 241657 - DNA, 607 bp, Homo sapiens
  misc_feature: GYAE6OF01B5DEG.19.68.G02.1.454.CMB.1.raw
  modified_base (126)..(126): a, c, t, g, unknown or other
  misc_feature (126)..(126): n is a, c, g, or t
  modified_base (185)..(185): a, c, t, g, unknown or other
  misc_feature (185)..(185): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctnatcttcctgcccgtgttgggcctcccatggggtgtcctgtcacaggtgcagctgcaacngtcaggtccaggactggtcgaagccctgcagacgcctctcactcacctgtaccagtcgtccgggacagtgtctctagtgacagcgcaacgttgggactggctcgaggcacgtcccatccggagtacggccttggagtggcgtagggaacgacagtactacgacggtacacgtggtatggatgattagtgactagtatcgtagtagtaaagttcgtaatttaaccaattaaacgcctaagaacctaacgtaactaccaaacgtaacctacggttaccctacccgtagacctacgttacgtaccttccgtacgttacgaccctacccggtaacgaaccgtacggtacttacggttaccttaagttacgtgtacgaacgtaacggtacgtaccgttacggaaccggtaaagggtaaacgttaacg

SEQ ID NO: 241658 - DNA, 600 bp, Homo sapiens
  misc_feature: GYAE6OF01CG2VR.19.68.G02.1.454.CMB.1.raw
  modified_base (373)..(373): a, c, t, g, unknown or other
  misc_feature (373)..(373): n is a, c, g, or t
tcagtactctcgtgcacgaccggtgctcgatttagtcgatagtgaagggaaagggggcagagcctgctgaattctggctgaccagggcagtcaccagagctccatacaatgtctgtcgccttcctcatcttcctgcccgtgttgggcctcccatggggtgtcctgtcacaggtgcagctgcaacagtcaggtccaggactggtgaacgccctcgcagacgcctctcactccacctgtaccatcgtccggggacagtgtctctagtgacagcgctaacgttgggactggctcgaggcacgtcccagtcgagcgtccttggagtggcgtagggaacgacagtactacgacggtccgagtggtatgatagtattangctagtatgtagtagtaaagttcgtaatttacaagttaacgacaagacctacacttaccgaacgtaacccgtacgttaccctccgtagtacctaacgtttacgtaaccttcgttacggtacgtacccgtaccccggaacgtaacccgtccggtaccttacgttacttaacgtttacgtggtacgaacgtaaggacgtaccgtacggaacggtaaagggaagtaaccg

SEQ ID NO: 241659 - DNA, 678 bp, Homo sapiens
  misc_feature: GYAE6OF01ALZ5Q.19.68.G02.1.454.CMB.1.raw
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccagtggggtgtcctgtcacaggtgcagctgcaacagtcaggtccaggactggtgaacgccctcgcagacgcctctcactccacctgtacctacgtccgtccggggacacgttgtcctactaggtgacagcgactaacgttgggactggcctacgacggccacgtcccagtcggagcggtccgttggacggtcggacgtagggaacgtactaacgtacgtacgacggtaccaggttacgtagtaggtataggtaattgcgtactagttacgtacgtaggtaacgtaaacgttcgttaactttaacgtaagttaacgacccgtaagtaaccctacgtaccgtaaccgtaaaccgtaacccgttacgttacccttaccgtacgtaaccttacgttacgtaccttacggtacgttaccggaccccgtaccggaaccgtacggtaccggtcttacgttacttacgttacgttcggtaacgacgttaacgggtccgacggttaaccggaacgggttaaacggtaaacgtacgg

SEQ ID NO: 241660 - DNA, 668 bp, Homo sapiens
  misc_feature: GYAE6OF01EXZBQ.19.68.G02.1.454.CMB.1.raw
  modified_base (167)..(167): a, c, t, g, unknown or other
  misc_feature (167)..(167): n is a, c, g, or t
  modified_base (194)..(194): a, c, t, g, unknown or other
  misc_feature (194)..(194): n is a, c, g, or t
  modified_base (213)..(213): a, c, t, g, unknown or other
  misc_feature (213)..(213): n is a, c, g, or t
  modified_base (356)..(356): a, c, t, g, unknown or other
  misc_feature (356)..(356): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcactcttcctgcccggttgttcgggccctcccagtgggggtnttcctgtcacaggtcgcagctgcaacngtcaggtccaggactgganaacgccctcgcagacgtcctctcacctcaccttgtaccagtccgtccggggactaggttcgtcctctagtcgacgacgcgctaacgttgggactggctcgaggcacgtcccatcggagtacgtctggacgtgggcgtaggaanactattaccgacgcggtacccgtagtggtactacgattgtaattatcggactagttatcgtaagtaagtaacgttcgtatttaacagttaccactaacgaactacctaaacgaccctaaacggtacccttacgtttccctaccgtagtaaccttaaccgttaccggtaacttcccgttgacccggttaacccgtccccggaaacgttacccgtacgggtacctttttacgaacccgtttagttaccggtaaggtaccgaacgtaaacgggtcccgtacgtaaccgggtacggtaaaacggtaacgttaacgg

SEQ ID NO: 241661 - DNA, 600 bp, Homo sapiens
  misc_feature: GYAE6OF01BXUHK.19.68.G02.1.454.CMB.1.raw
  modified_base (161)..(161): a, c, t, g, unknown or other
  misc_feature (161)..(161): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccagtggggtntcctgtcacaggtgcagctgcaacagtcaggtccaggactggtgaacgccctgcagacgcctctcactcacctgtaccagtccgtccggggacagtgtctctagtgacagcgacaacgttgggactggcctcgacggccacgtccccagtcgagacggtccttggaggtggcgtagggaacgacagtaacgtacgacggtccacggtggtatgatgtattagtgtagttatctagtaagtaaagtcgtaactttaaccaagttaacgactaacgacacaactacccgaaagtaaccctagttacctacctacgactaacttacgaacttctacgtacgtaccctacccgaaccgaccgtaccggtcttacgttacttacgttacgtcggtcgaccgtaagtcgtaccgtacggaacggaacgggtaaacgtgttaacgg

SEQ ID NO: 241662 - DNA, 593 bp, Homo sapiens
  misc_feature: GYAE6OF01CIYKO.19.68.G02.1.454.CMB.1.raw
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtgtcctgtcacaggtgcagctgcaacagtcaggtccaggactggtgaacgccctcgcagacgcctctcactcacctgtaccagtccgtccgggacagtcgtctctagtcgacagcgactacgttgggactggctcgacgccacgtcccagtcgagcgtcctgagtggcgtagggaacgacagtactacgacggtccagtggtatgatgtattagtcgactagtatcgtagtaagtaaacgttcgtaactttaacgattaacgaccaagactaacactaaccgaacgtaacctacgtttcctacccgtgtacctacgttacgtaaccttcgttacgtaccgtacccgtacccggacgtaccgccgtacgttcgttaccttattacgtgtacgaacgtaacggtacgtaccgtaccggacggaagggtaaacgtacg

SEQ ID NO: 241663 - DNA, 677 bp, Homo sapiens
  misc_feature: GYAE6OF01B1ARB.19.68.G02.1.454.CMB.1.raw
  modified_base (126)..(126): a, c, t, g, unknown or other
  misc_feature (126)..(126): n is a, c, g, or t
  modified_base (160)..(160): a, c, t, g, unknown or other
  misc_feature (160)..(160): n is a, c, g, or t
  modified_base (185)..(185): a, c, t, g, unknown or other
  misc_feature (185)..(185): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctnatcttcctgcccgtgttgggcctcccatggggtntcctgtcacaggtgcagctgcaacngtcaggtccaggactggtgaacgcccctcgacaggacgtccctctccactccacctggtaccagtccgtccggggaactaggtcgtcctactaggtcgacagccgactaacgttgggactcggctcgacggcctacgtcccctagtcggagacggtccgttggacggtggtacgtagggaaaggactagtacgtacgacggtcctacggtggtatgagtagtattagtagtacctagttatcgtaggtaaggtaaacgttacgtaactttaaccgtaagttaaacgacctaacgaacctaaccgtaactaaccgtaaacgtaacccttacgtttacccctacccgtacgtaccttaccgttactaacccttcgttaccggtacctacccgtaacccggtaaccgtaaccgtacccggtaccgttacgtacctttacgttacggtcgtacgactaacggtcgtacgtacggacgtaaaggggtacctaaacgg

SEQ ID NO: 241664 - DNA, 689 bp, Homo sapiens
  misc_feature: GYAE6OF01ER12I.19.68.G02.1.454.CMB.1.raw
  modified_base (186)..(186): a, c, t, g, unknown or other
  misc_feature (186)..(186): n is a, c, g, or t
  modified_base (252)..(252): a, c, t, g, unknown or other
  misc_feature (252)..(252): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccagtggggtgtcctgtcacaggtgcagctgcaacngtcaggtccaggactggtgaacgccctgcagacgcctctcactcacctgaccatccgtccgggacngtcgtctcgtagtgacagcgactaacgttcggggactggcctcgacggccacgtccccagtcggaggtcggtccgttggacggtcgggcgtaggggaacgactacgtaaccgtacgacggtccacggtggtataggtagtagtaatttagtcgtactaggttactacgttagtaaggtaaacgttccgttaaactttaaaccgtaacgtttaaacggacctaacgtaacctaaccgtaacttaacccgaaacgtaaacccttacggtttacccctacccgttacgaaccttaccgttacgtaaccttccgttacgtaccgtacccgtacccggaacggtacccgtaccggtaccgtttccggtaactttacgttacgttcggtacgtaaccggaacgtacggtcccgtaacgggaccggtaaagggtaaacgtacgg

SEQ ID NO: 241665 - DNA, 692 bp, Homo sapiens
  misc_feature: GYAE6OF01EPJKG.19.68.G02.1.454.CMB.1.raw
  modified_base (125)..(125): a, c, t, g, unknown or other
  misc_feature (125)..(125): n is a, c, g, or t
  modified_base (159)..(159): a, c, t, g, unknown or other
  misc_feature (159)..(159): n is a, c, g, or t
  modified_base (185)..(185): a, c, t, g, unknown or other
  misc_feature (185)..(185): n is a, c, g, or t
  modified_base (648)..(648): a, c, t, g, unknown or other
  misc_feature (648)..(648): n is a, c, g, or t
tcagtactctcgtgcacgaccggtgctcgatttagtcgatagtgaagggaaaggggcagagcctgctgaattctggctgaccagggcagtcaccagagctccagacaatgtctgtcgccttcctnatcttcctgcccgtgttgggcctccagtggggtntcctgtcacaggtgcagctgacaacngtcaggtccaggactggtgaacgccctcgcagacgcctctcactccacctcgtaccagtccgtccgggactagtcgtctcgtagtcgacgagcgacgtaacgttgggacttggctacgacggcctaccgttaccccagtcggaagtacggtccgttaggacggtcggacggtaagggaacgactaacgttaaccgtacggacggtacccgtaggtacggttagtagtagtagtaattagtcgtacgtaacgttagttacgttaaggtaaggttaaaacgtttcgttaaacctttaaccgtaagttaaccggacctaagtaacctactaaacgtaacccgtaaacgaaccgtttaccgttaccttacccgtagtaaccttaccgtttaacgtacccgtttacgtagtaccctaccgtacccggacggtaccgtaccgtaccgttacgttacttaagtttaccgngttagaaccgtaggtacctcgtaacgaggtaaacggacgttacg

SEQ ID NO: 241666 - DNA, 700 bp, Homo sapiens
  misc_feature: GYAE6OF01DD2MQ.19.68.G02.1.454.CMB.1.raw
  modified_base (164)..(164): a, c, t, g, unknown or other
  misc_feature (164)..(164): n is a, c, g, or t
  modified_base (212)..(212): a, c, t, g, unknown or other
  misc_feature (212)..(212): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttcgggcctcccagtcgggggtntcctgtacacgaggtgcagctgacaacagtcaggtccaggactggtanaacgtccctcggcggactcctctcactcacctgtaaccagtccgtaccgggacacgtgtctatagtcgacagcgactaacgttgggacttcggctcgacggactcgtaccccatcgaggacgtccgttaggaggttgacggtagggaacgcgtaacgtacgtacgacgggtaccctaggttggtaactggtatacggtattagtcgtacgtagttaacttcgtacgtaaggtaaacgttcgtaactttaaacgacgtttaaacggcctaaagaaccgtaaccaacgtacccaaacgtaaccctaagttccctaccctggaccttaagtacgtaactcgttacggtacctaccgtacccggacgtacccgtacggtcgttaccgttacgtttaacgtttaccgttacggttacggtaaccccgtaaacgggtaccgtaaccgtaccggggtaaaccggtaaacggggtaaaacgttccggttaaaccgg

SEQ ID NO: 241667 - DNA, 716 bp, Homo sapiens
  misc_feature: GYAE6OF01BIGP7.19.68.G02.1.454.CMB.1.raw
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttcggcctccagtggggtgtcctgtcacaggtgcagctgcaacagtcaggtccaggactggtgaacgccctcgcagacgcctctcactcacctgtaccatcgtccgggacagtctctcgtagtcgacacgcgacgtaacgttgggactggctcgacggccacgtccccagtcggagacggtccgttggacggtcgggtacgtacgggaacgtacgtaacgttacgtaacgtacggtacctaacggttaggtacgtagtagttagtaactttacgtgtacgtagttaacgttcgttaggtaacggtaaaacgttcgttaaacgtttaaaccgtaagtttaaacgaccgaacgtaacctaactaacgtaacccgaaacgtaacccttacggttacccttacccgtaacgtaccgtaaccgtttacgtaaccgttacgttacggttaaccgtacccgttacccggaaaccggtaaccgtaccgggttaccttacggttacttaaggtttacggttacggttacggaaccgaacggtacgttaccgtacgggaaacggtaaacgggaaacgttaaccgg

SEQ ID NO: 241668 - DNA, 598 bp, Homo sapiens
  misc_feature: GYAE6OF01AHJPB.19.68.G02.1.454.CMB.1.raw
  modified_base (185)..(185): a, c, t, g, unknown or other
  misc_feature (185)..(185): n is a, c, g, or t
  modified_base (398)..(398): a, c, t, g, unknown or other
  misc_feature (398)..(398): n is a, c, g, or t
  modified_base (571)..(571): a, c, t, g, unknown or other
  misc_feature (571)..(571): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtgtcctgtcacaggtgcagctgcaacngtcaggtccaggactggtgaagccctcgcagacgcctctcacctcaccgtgtaccagtccgtccggggacaggtcgtctctagtcgacagcgacaacgttgggactggcctcgacggcctacggtccccagtcggagtacggtccttaggagtgggcgtaggggaacgacacgtacgacgacggtccaacggtggtactaggatgtaattagngctagtacttcgtaggtaagtaaagtcgtaactttacaattaacgacagacacactaccaacgtacctagttacctccgtcgacttacgtacgtaactcgttacgtaccgacctcccggaacgaccgtacggtcttacgttacttacgtttacgtgtacgacgaacgggtacnccgtacggacggtaaagggtactaacg

SEQ ID NO: 241669 - DNA, 695 bp, Homo sapiens
  misc_feature: GYAE6OF01AF72G.19.68.G02.1.454.CMB.1.raw
  modified_base (189)..(189): a, c, t, g, unknown or other
  misc_feature (189)..(189): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgttgttcgggcctcccagtggggtgtcctgtcacgaggtgcagctgcaacngtcaggtccaggactggtacgacgccctcgcagacgcctctcactccacctgtaccagtccgtccggggacagttcgtctcgtagtcgacacgcgactaacggttggactggcctcgagccacgtcccagtcggaggacgtccgttggacggtcgggacggtaggggaaacgtacgtaacgtaaccgtaaccgacgggttacccgtacgggttacgggttaattagggtaacgttacggttaaagtttacgtacggtaaccgttaagtttacgttaccgttaaggttaacggtaaaacgttcgttaaactttaaccgaacgtttaaacgacctaacgtaaccactaaccgtaacctaaacgtaacccttacgttaccctaccgtcgtaaccttaacgttacgtaacttccgtaggtacccgtaccgtacccggaacgtccgtacgtcgttacgttacgtacgttacgtcgacgtacaacggtctacgtagacggtaaggactacgg

SEQ ID NO: 241670 - DNA, 657 bp, Homo sapiens
  misc_feature: GYAE6OF01D66IF.19.68.G02.1.454.CMB.1.raw
  modified_base (185)..(185): a, c, t, g, unknown or other
  misc_feature (185)..(185): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtgtcctgtcacaggtgcagctgcaacngtcaggtccaggactggtgaacgccctcgcagacgcctctcactcacctgtaccatccgtaccgggacagtcgtctctagtgacagcgcaacgttcgggactggctcgacggcacgtccccatcggagacggtcctgagtggcgtagggaagacatactacgacggtccacggtaggtactgagtgtattatgactagttactacgttagtaaggtaaagttcgtaacttttaaccaagtttaacgaccgaagtaacctaaccactaacccgaaacgtaacccgttacgtttaccctacccgttacggtaccttaacgtttaacgtaaccttccggttacgtaccgtacccgttacccggaaccggtaccgtaccggtaccgtttacggttaccttaacgtttacgtacggttagtaaccgaaacgggtccgtaacggacccggtaaacgggaaggggtaaacgtaaccggg

SEQ ID NO: 241671 - DNA, 698 bp, Homo sapiens
  misc_feature: GYAE6OF01CUON2.19.68.G02.1.454.CMB.1.raw
  modified_base (163)..(163): a, c, t, g, unknown or other
  misc_feature (163)..(163): n is a, c, g, or t
  modified_base (178)..(178): a, c, t, g, unknown or other
  misc_feature (178)..(178): n is a, c, g, or t
  modified_base (252)..(252): a, c, t, g, unknown or other
  misc_feature (252)..(252): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcactcttcctgcccgtgttcgggcctcccagtggggtntcctgtcacgaggtncagctgacaacagtcaggtccaggactggtagaacgtccctcgcaggacgtcctctccactccacctcgtaccncgtcggtacccggggactaggttcgtctcgtacggtgaactacggaccgtacgtaacggttggggactcgggactccgaaggtcctaccgtaccccagtacggaggacggtccgttagaggtcggcggtagggaaggtactacgtacgtaacggacggtcctaaggttaggtactaggtacttagtaatttacgtagacgttagttaacgttagtacggtaaagtaaacgttcgttaaacgttaaccgtaagttaaccgaccaacgtaaacctacctaaaccgtaaccggtaaacgaacccgtttaccgttacctacccgtagtaccgttaccttagtacccttgttaccggactcccgtacgacccgtagaccgttcgtacgtacgtttagttaaccggtgtaccgtaacgaacgtccgaacgtacgaacggaaaggtactaacg

SEQ ID NO: 241672 - DNA, 686 bp, Homo sapiens
  misc_feature: GYAE6OF01CT4PL.19.68.G02.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
tcagtactctcgtgcacgaccggtgctcgatttagtcgatagtgaagggaaagggggcagagcctgctgaattctggctgaccagggcagtcaccagagcctaccagacaatgtctgtccgccttcctcattcttcccgtcgcccggttggttcgggccctccgtaggtcgggggttctcctgtccagaggtcgcagcctgaccaaacngtcgacggtaccaggtcgtggtacgaccgtcccgngacgaggactcctacctccaccttccaaccgttacgacctacggtccggtaccgggactagttcgtctacgtagcgacgtacgccgacgttaacgtcggacgtcggcctacgacggcctaccgcccgagtcggagtacgtcgtgacggtggacggaagggaacacttacgaacggtacgcggtacgtaggttacgatacggtagtacgtaacgtttagcgtacgtagtacgtcggttaaagtaagtaaccgttaacgttaacctttaaacgaacgttaaccgaccgtaacgtaacctaccgtaaacgtacccaaacggttacctaccggttacctcgttacgacctagtactacgtctacggtacctcccggaacggtactcgtaaccggtctacggttaaccttgtcgacgtacagtacgcgtagtacgagaagtagtacg

SEQ ID NO: 241673 - DNA, 911 bp, Homo sapiens
  misc_feature: GYAE6OF01A8QFL.19.68.G02.1.454.CMB.1.raw
  modified_base (159)..(159): a, c, t, g, unknown or other
  misc_feature (159)..(159): n is a, c, g, or t
  modified_base (173)..(173): a, c, t, g, unknown or other
  misc_feature (173)..(173): n is a, c, g, or t
  modified_base (886)..(886): a, c, t, g, unknown or other
  misc_feature (886)..(886): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttggcctccagtggggtntcctgtcacaggtncagctgacaacagtcaggtccaggtcgtgggtgaacgcccctacggcaaggacgtcccctctacctaaccgtccaccttccggtaaccacgttccggtaccggggaactcggttcgttccgttacgtaaggttcgaaccgtacggaccgtaaccgttaaacggtttcgggggaccttcgggaccgttaccggaaccggggtaccctaaccccggtttaccccccgaaggtttaccggggaacggtaaccccggggttcccgttttaacgggaacgggggttcggggtaaaccggttaaggggggaaaaccgtaacctaaacgggtttaaacccgttaacccgggtacggttacccggtttaaacgggttagggtttaaagtacggttagttaacggttaaagttttaccggtaggtaaccgttaagggttttaacgtaccggttttaagggtaaacgttaaaaccggtttccgtttaaaactttaaaccggttaaagttaaacccgaccggaaacgtaaccctaacgttaaacccgtaaacccgtaaaccgtaaccgtttcccggttaaccgtttaccccgtaacgtaccgttaacccgtttaggtaacccgttcgttaacgtaaccccggtacccgtaacccggaacgaccgttacgtaccttcggttaccgtttacttggacgttacgaacgtacggtaacttccgggaanaaccggggaaagttaaccgttacgg

SEQ ID NO: 241674 - DNA, 780 bp, Homo sapiens
  misc_feature: GYAE6OF01B61E1.19.68.G02.1.454.CMB.1.raw
  modified_base (126)..(126): a, c, t, g, unknown or other
  misc_feature (126)..(126): n is a, c, g, or t
  modified_base (199)..(199): a, c, t, g, unknown or other
  misc_feature (199)..(199): n is a, c, g, or t
tcagtactctcgtgcacgaccggtgctcgatttagtcgatagtgaagggaaaggggcagagcctgctgaattctggctgaccagggcagtcaccagagctccagacaatgtcctgtcgccttcctntacttcttcctgcccgttgttcggccctccgagttcgggtctcctgtacagaggtcgctagcgtgaccaacgngtccgaggtccgaggtacgtggtacgaaccgcccgtagcgaacggctccctcaccgaccttacctacgtacgtaccgtaccggtccgggtacccggggtaacttcggttacggttacctaacggtttaacggaccgaacggaccggtaccggtaccgttaaacgggttcggtaacggttcggaccgttacggaccggtacccgacccgtacccgtaaggttacggacgggtaccgtcgttagggacgtgggtacggtaagggaacgactagtaacgtacggtacggtaaccgtcggtaagtcgtaagtattacgttagtacgtacgacggttaagtcgttaagtaacggtaagtaaactttcgtaaactttaacgaagtaaccggataactaccgaatactaaccgtaacgtaaccttcgtaaccctcggcttaaaccgtcgtttaacccgacgttaccgttagccccggttaacgtacccggtaaacgtcgtacgtacctttacgttaaaccttcggttaacgccgtacggaacgttaaccgcggttaacgacgggaacgggttaaaacgtgttacccgg

SEQ ID NO: 241675 - DNA, 810 bp, Homo sapiens
  misc_feature: GYAE6OF01B305R.19.68.G02.1.454.CMB.1.raw
  modified_base (127)..(127): a, c, t, g, unknown or other
  misc_feature (127)..(127): n is a, c, g, or t
tcagtactctcgtgcacgaccggtgctcgatttagtcgatagtgaagggaaagggggcagagcctgctgaattctggctgaccagggcagtcaccagagcctccagacaatgtctgtcgccttcctnatccttcctgcccgtgttcggccctccgagtcggggtgtcctgtcacgaggtcgcagctgacaacacggtcacgggtaccaggtacgttcgggtacgaaccgtcccctcgacgagaccgtcccttaccgtaccaaccttccaacccgttacgttaaccccgacgttacccggttacccggggaactaggttcgtaccttcgtaagtcgaaccgtacgaccggtaccgtaaacggtttcggggaacgttggtacccgtacggacggtaccccgtaccgttaccccggaagttacccgggaaggtacccggttccgtttagggacggttcgggtaccggtaaggggaaacgtacctaaagttacccgaacggttccggtaaccgtagggtttagtaacgtggaacgtagttaacgttagcgtacgtaagttcgtacgttagtaacggttaaacgttacgttaaaccctttaaacgtaagttaaacccgaccgtaactaaaccgtacctaaaccgttaacccaaaaccggttaacccttccggtttaaccctccccttaagtacccgttaacggttaacctacgttaccgttacgtaccgacccgtacccgagtaccgaccgtcttcgtaagttctaccgtagacgcgtaagtacgacccggtaagaccgggtaaagaagttaccg

SEQ ID NO: 241676 - DNA, 616 bp, Homo sapiens
  misc_feature: GYAE6OF01CCM55.19.68.G02.1.454.CMB.1.raw
  modified_base (126)..(126): a, c, t, g, unknown or other
  misc_feature (126)..(126): n is a, c, g, or t
  modified_base (161)..(161): a, c, t, g, unknown or other
  misc_feature (161)..(161): n is a, c, g, or t
  modified_base (175)..(175): a, c, t, g, unknown or other
  misc_feature (175)..(175): n is a, c, g, or t
  modified_base (206)..(206): a, c, t, g, unknown or other
  misc_feature (206)..(206): n is a, c, g, or t
  modified_base (241)..(241): a, c, t, g, unknown or other
  misc_feature (241)..(241): n is a, c, g, or t
  modified_base (264)..(264): a, c, t, g, unknown or other
  misc_feature (264)..(264): n is a, c, g, or t
  modified_base (459)..(459): a, c, t, g, unknown or other
  misc_feature (459)..(459): n is a, c, g, or t
  modified_base (501)..(501): a, c, t, g, unknown or other
  misc_feature (501)..(501): n is a, c, g, or t
  modified_base (603)..(603): a, c, t, g, unknown or other
  misc_feature (603)..(603): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctnatcttcctgcccgtgttcggcctcccagtggggtntcctgtcacaggtncagctgcaacagtccaggtccaggacgtggngaacgcctacgcaggactcctcctacactcacctnaccagtcgccgggcagtgtcctntagtcgacacgtcgacgtacgtggacctggctcgaggccacggtcccaagccggagcgtccgtgacggtggacgtagggaacgtacagtaccgtacgtacggtcctaaggttcgtagtagtacgtaggtttattagtcgacgttaagtcttagttaagtaagtaaacgtcttaaagttaacacgtaagccctaanaacctaccacgtaaccgaaccttacccgctttacctcgtacncttaccttaacgtaccttcggtacgacctacccgaaccgtacggtaactacggtccttaacgtactttatcggtctaccgagaacgttcgactacgggtaanaacgggtataacg

SEQ ID NO: 241677 - DNA, 722 bp, Homo sapiens
  misc_feature: GYAE6OF01BSBMO.19.68.G02.1.454.CMB.1.raw
  modified_base (162)..(162): a, c, t, g, unknown or other
  misc_feature (162)..(162): n is a, c, g, or t
  modified_base (176)..(176): a, c, t, g, unknown or other
  misc_feature (176)..(176): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctggcccgttgttgggcctcccatggggtntcctgtcacaggtncagctgacaacagtcaggtccaggctggtcaacgccctgacagacgccttctcactcgacctgaccagtccgtaccgggacagttcgtactctaggtcgacacgcgactaacgttggacctggcctacgacgggccacggtcccaagtcggagcgtctagacgtggcgaggaacgctactacgtacgcggtacctagtcggtatcgaacttggtaaacttagcgtacgtaagttcgttacgtaaggttaacgtaaaaggtttacgttaaacttttaaccgtaacgtttaaacggtaccctaaacgtacgtaaacccgtaacgtaaccccgtaaaccggttaaccgttaccggtttaccctacccgtttacggtaccctttaacccggtttacgttaaaccctttcgggttaaccgtaccgttaaccccttaccgggaaaccgtacccgtacgttccgttaaaccgttactttaacgggttactcgggtacgaaccctaaaggtacgttacccggtacggaaacggttaaagggtaaaccttaccgg

SEQ ID NO: 241678 - DNA, 520 bp, Homo sapiens
  misc_feature: GYAE6OF02INSFI.19.68.G02.1.454.CMB.1.raw
  modified_base (205)..(205): a, c, t, g, unknown or other
  misc_feature (205)..(205): n is a, c, g, or t
  modified_base (267)..(267): a, c, t, g, unknown or other
  misc_feature (267)..(267): n is a, c, g, or t
  modified_base (493)..(493): a, c, t, g, unknown or other
  misc_feature (493)..(493): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatgggggtgtcctgtcacaggtgcagctgcaacagtcaggtccaggactggtnaagccctcgcagagcctctcactcacctgtaccatcgtccggggacagtgtctctagtgacngcgcaacttgggactggctcaggcacgtccccatcgagacggccttgagtggcgtgggaaggacatactacacggtccagtggtatgatgattatgctagtatcgtagtagaaagtcgaatttaccaattaacgccagacacataccaaagaacctagtctccctgactacttacgaacttctcgtcgacctccgacgaccacggctgtctacttacgtgtacganaacgcgtcgtccgacgacgggaatacg

SEQ ID NO: 241679 - DNA, 503 bp, Homo sapiens
  misc_feature: GYAE6OF02IHFN0.19.68.G02.1.454.CMB.1.raw
  modified_base (461)..(461): a, c, t, g, unknown or other
  misc_feature (461)..(461): n is a, c, g, or t
  modified_base (486)..(486): a, c, t, g, unknown or other
  misc_feature (486)..(486): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtgtcctgtcacaggtgcagctgcaacagtcaggtccaggactggtgaagccctcgcagagcctctcactcacctgtaccatctccgggacagtgtctctagtgacagcgcaacttgggactggctcgaggcacgtccccatcgagaggccttgagtggctgggaagacatactacaggtccagtggtatgatgattatgctagtatctagtagaaagtctatttaccattaacgccagacacataccaagacctagttcctaccctgactacgttacgaacttctgtcacctaccgacgaccncgctgtctattacgtgtgacgagcncctagcgagggaactcg

SEQ ID NO: 241680 - DNA, 589 bp, Homo sapiens
  misc_feature: GYAE6OF02HJ4K5.19.68.G02.1.454.CMB.1.raw
  modified_base (160)..(160): a, c, t, g, unknown or other
  misc_feature (160)..(160): n is a, c, g, or t
  modified_base (265)..(265): a, c, t, g, unknown or other
  misc_feature (265)..(265): n is a, c, g, or t
  modified_base (372)..(372): a, c, t, g, unknown or other
  misc_feature (372)..(372): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtntcctgtcacaggtgcagctgcaacagtcaggtccaggactggtgaacgccctgcagacgcctctcactcacctgtaccatccgtccggggacagtcgtctctagngacagcgacaacgttgggactggctcgaggcacgtcccagtcgagacggtccttggagtggcgtagggaacgacatactagacggtccacggttgtatgatgattangactagtatcgtgtagtaaagtcgtaattacctaagttaacgaccaagacaactactaaccaacgaacctacgtccttacccgtagtacctacttacgtaacttacgtcgtacgtaaccgtaccccgtaacgaccgtacggtcttacggttacttacgtttacgtacgtacgtacgtaacgtcggtaccgttacgggaccgtaaggggaacttacgg

SEQ ID NO: 241681 - DNA, 745 bp, Homo sapiens
  misc_feature: GYAE6OF02ICFV3.19.68.G02.1.454.CMB.1.raw
  modified_base (285)..(285): a, c, t, g, unknown or other
  misc_feature (285)..(285): n is a, c, g, or t
  modified_base (690)..(690): a, c, t, g, unknown or other
  misc_feature (690)..(690): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggccctcccgagtggggtcgtcctgtcacgaggtgcagctgcaacagtcacggtccaaggctgggtagaacgccctcggacaggactcctctacactcaaccgtgtaccagtccggtaccgggacacgtgtctcgttaagngacaggcgtacgtacgttacggactcgctacgacggtcgtaccgtcccagtacggacggtacgtcgttggacggtgggtacgtacggggtaacggaactacgttaaccgtacggacggttaccgtaacggttaaggtagtacggtaagttacggttaagttacgtagacgttagtaacgttcggtaagggttaaacgtaaaacggttcgttaaacgtttaacctaaagtttaaccgaccgaaacgtaactaacgtaacttaaaccggaaaaccgtaaaccggtttaccttacccgttacccgttacgtaaccgttaaaccgttcgtaaacccgttcgttacgtaccgtaaacccgtaccggttaacgaacgtccgggttattaccgttaacgttacgttaaccgnggttaccgtaacgtaacggttccgacggttacccggaacgtaagggtaaactcgg

SEQ ID NO: 241682 - DNA, 655 bp, Homo sapiens
  misc_feature: GYAE6OF02GHBFR.19.68.G02.1.454.CMB.1.raw
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtgtcctgtcacaggtgcagctgcaacagtcaggtccaggactggtgaacgccctcgcaganccctctcactcacctgtaccatccgtaccggggacagtcgtctctagtgacngcgcaacgttggactggctcgaggcacgtcccatcggagaggccttgagtggcgtgggaacggactagtactacacggtaccacggttggtatgattagtattagtgacgtagttactacgtaggtaagaaaacggtttcgtaacttttaaccgtaatttaaccgaccgtaaacggaacctacgtaaccgtaaccctaaaacggtaaccctacggttttaccctaccccgttacgacccgttaacttacgtaccctttacgttaccgtaacgtacccgtacccggtaccggaccgtaccgggtccttacgttacccttaagtttaccgtcggttacggtacgaacgtcgtaccgtaccggaacggtaacgggaacgttaaccgg

SEQ ID NO: 241683 - DNA, 660 bp, Homo sapiens
  misc_feature: GYAE6OF02GBVA6.19.68.G02.1.454.CMB.1.raw
  modified_base (135)..(135): a, c, t, g, unknown or other
  misc_feature (135)..(135): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcccngcccgtgttggcctcccatggggtgtcctgtcacaggtgcagctgcaacaggtcaggtccaggactggtagaacgccctcgcagacgtcctctcactccacctgtaaccagtccgtccggggacagtgtctctagtgacagccgacaacttgggactgggctcgagctacgtccccatccgagacgtcctgaggtcgctagggacgacaatacgtacgacggtccacggttggtatgatggactttagcgctagtactcgtaggtaagtaaacggtcgttaacttaaccgtaaagttacgacccgtaagacctaacgtaacgttaacccgaaataacccgttacgttaccctcccgttaagacccgttaacgtttaaccgacctttacgtttccgaaccgttacccgtaaccgggaaccgtacccggttaccggtacgtttaccgtactttaaccgtttaccggtacgtacggaaccgtaacgccggttaacctaccgggaacccggttagggaaacccgttagg

SEQ ID NO: 241684 - DNA, 608 bp, Homo sapiens
  misc_feature: GYAE6OF02GFZ4X.19.68.G02.1.454.CMB.1.raw
  modified_base (265)..(265): a, c, t, g, unknown or other
  misc_feature (265)..(265): n is a, c, g, or t
  modified_base (367)..(367): a, c, t, g, unknown or other
  misc_feature (367)..(367): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtgtcctgtcacaggtgcagctgcaacagtcaggtccaggactggtgaagccctgcagacgcctctcactcacctgtaccatcgtccgggacagtgtctctagtgacngcgcaacgttggactggctcgagcacgtcccagtcgagacggtcttggaggtggcgtagggaacgacagtactacgaggtccaggtggtatgatgtagttangacagtatcgtgtaaggaaacgttcgtaatttaacagttaacncgtaanactanacttacaaacgtacctacgttcctacccgtagtaccctaagttacgtaaccgttcgtaccgttacgacccgtaccccggaacgaccgttacggtactttacggtaccttaacgtttaaccggttggtaccgtaaccgtaacggtccggtaccggtaaccggtacgggtaaacgggtaacttaaccgg

SEQ ID NO: 241685 - DNA, 698 bp, Homo sapiens
  misc_feature: GYAE6OF02HVYSV.19.68.G02.1.454.CMB.1.raw
  modified_base (266)..(266): a, c, t, g, unknown or other
  misc_feature (266)..(266): n is a, c, g, or t
  modified_base (397)..(397): a, c, t, g, unknown or other
  misc_feature (397)..(397): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccatggggtgtcctgtcacaggtgcagctgcaacagtcaggtccaggactggtagaacgccctgcagcgcctctcactcacctgaccatccgtccggggatagttcgtctcgtagngacaggcactaacgttgggacgtcgctgacggcacgtcccatcgagcggtcttgagtggacgtagggaacgactacttaaccggacgtacggtaccgtacggtaggttaatcggaagtcgtaagtttacgnggtcctaagtttacgtacgttaggtaaaggtaaaacgtttgttaaactttaacgtaacgttaacgaccgtaacgaacgtaaacctacgtaaacccgaaacggttaaacccgtcttttacccgtacccgtacgttacccgtaaacgtttccgtaaaccgttccgttacggtaccggttaacccgtaccccgaaccggtaccggttacccggtcgttaacggttacctttaacggttaccggtagttaccggaacgttaacggaccggttacccgagggtaaccggaacggggtaaattccgg

SEQ ID NO: 241686 - DNA, 702 bp, Homo sapiens
  misc_feature: GYAE6OF02JURGK.19.68.G02.1.454.CMB.1.raw
  modified_base (177)..(177): a, c, t, g, unknown or other
  misc_feature (177)..(177): n is a, c, g, or t
  modified_base (667)..(667): a, c, t, g, unknown or other
  misc_feature (667)..(667): n is a, c, g, or t
tcagtactctcgtgcacgaccggtgctcgatttagtcgatagtgaagggaaagggggcgagagcctgctgaattctggctgaccagggcagtcaccagagctccagacaatgtctgtcgccttcctcatcttccgtgcccgtgttcggcctcccagtgggtgtcctgtcacgaggtnccagtcctgcaactcgttgacggtccgaggacgttggacgaaccgtcccctgcctaaggactccctctacgaccttccacccttaggaccctcgtccgtccgggactaggtcgtcgtactgtcgacacgtcgaccgtacgttaggtaccgtggtccgtcgacggtccaccggtacccctagtaccgaaggtcggtaccgtacggtacgtgggacgttaggggaaccggtacgtaagtaccgtaccgtacggttacccgtaggttgtagttacgatttagtagttacgttagcgtaacgtactagttacggtaacgttaaacggtacgttacctttaacgttaacgttaacgttacgaacgaacttacctaacgtaccgtaaacgtacgttaaccgtaccgttaccgttcgacgttactcgtaaactcgtacgtccgtaccgtaccgaccgtaccgtcgtaccgtgttcttacgttagtacgttccggaanacgacgaccgttcgaacggttacggaacgtttacg

SEQ ID NO: 241687 - DNA, 735 bp, Homo sapiens
  misc_feature: GYAE6OF02IYNO2.19.68.G02.1.454.CMB.1.raw
  modified_base (164)..(164): a, c, t, g, unknown or other
  misc_feature (164)..(164): n is a, c, g, or t
  modified_base (193)..(193): a, c, t, g, unknown or other
  misc_feature (193)..(193): n is a, c, g, or t
  modified_base (599)..(599): a, c, t, g, unknown or other
  misc_feature (599)..(599): n is a, c, g, or t
  modified_base (640)..(640): a, c, t, g, unknown or other
  misc_feature (640)..(640): n is a, c, g, or t
tcagtactctcgtgcacgaccggtgctcgatttagtcgatagtgaagggaaagggggcagagcctgctgaattctggctcgaccagggcagtcaccgagagctccagtacaatgtctgtccgccttacctcactcttcctgcccgtgtcggcctccagtgggtntcctagtcacgagtgcacgtctgacaacncgtcacggtccaggaccgtgggtacgacggccccgtgcgacggacctcctactctacctcctaaccttcgtacctacgttccggtacccgggggtaactacggttcggttccgttaccgttaacggtcgtaaccgacgcggtaccgtaacggttcgggaacgtcggtactacggacggtccgtaccgtaccaaggttccgaaggtaccgtccgttggacggtcggacgtaggagtaactacgtacgtacgacggttcctaaggtgttagacgttagacgttaagttcgaggtacgtagttactaccggtaggttaaacgtaacgttacgttaaagttaaccgagttaaaccgcaacggtaactaaaccgttaacgaacgtaaccgtaaccgttacgtttaaccccngtacctaccgttaaacgttccgaacgtttcgacggttaacncccggtaccgaccgttacgcgtaccgttacgtaactcggttacgacgtcgttaacgcggttacggtacgtcggaacggtaacggtaccttaacgg

SEQ ID NO: 241688 - DNA, 859 bp, Homo sapiens
  misc_feature: GYAE6OF02F27VN.19.68.G02.1.454.CMB.1.raw
  modified_base (159)..(159): a, c, t, g, unknown or other
  misc_feature (159)..(159): n is a, c, g, or t
  modified_base (173)..(173): a, c, t, g, unknown or other
  misc_feature (173)..(173): n is a, c, g, or t
  modified_base (185)..(185): a, c, t, g, unknown or other
  misc_feature (185)..(185): n is a, c, g, or t
  modified_base (225)..(225): a, c, t, g, unknown or other
  misc_feature (225)..(225): n is a, c, g, or t
  modified_base (314)..(314): a, c, t, g, unknown or other
  misc_feature (314)..(314): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctccatggggtntcctgtcacaggtncagctgacaacngtcaggtccaggactggtgaacgccctgcagacgtcctcncactcaccttcgaccagtccgtccggggacaggttcgtcttacgtagtgacctagaccgactaaccgttgggactggcctcgaggtacnccgtacccatcggacggtacggtcttggacggttgggaccgttaagggggaacgactaaacttaccgtaaccgtaacggggttacccgaacgggtttacgggttaaactcgggtaaacttaaggggttaaacgtttttcgtaacggggtaccttaaagggtttttaccgttaaccgggtttaaaggggttaaacggttaaaaaacccggggtttaccggttttaaacctttttaaaaccgtaaacggttttaaacccggggaaccccgtaaacggtaaacccttaaccgtaaaccggttaaccccgtaaaaccgtaaaccccgtttacgggtttttacccccttaccccggttaacgtaaacccgttaaccgttttacggaaacccgttttacccggtttagtaaccccggttaaccccgttaccccgaacgggtaaccccgtacccggggttactttaccgggtttaccttaacggtttacccggtgttaccggaagtaacggacggttacccgttaacgggacggtaaacgggttaataccgg

SEQ ID NO: 241689 - DNA, 759 bp, Homo sapiens
  misc_feature: GYAE6OF02G2KOD.19.68.G02.1.454.CMB.1.raw
  modified_base (168)..(168): a, c, t, g, unknown or other
  misc_feature (168)..(168): n is a, c, g, or t
  modified_base (185)..(185): a, c, t, g, unknown or other
  misc_feature (185)..(185): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctccatggggtgtcctgtcanaggtgcagctgacaacngtcaggtccaggacgtggtagaacgcccgtcgcacgacgtcctctccacctccacctcgtaccacgtccgtccggggacaggtcgtcctacgtagtgaaccgacggccgacgtaacggttcggggacctgggcctaccgacggtcctacccgtccccgagtaccggtacggaccggtccgttggacggtcggggacgtaggggaacgaactaacgtaaccgtaccgacggttaccgtaacggtacggttaagttacggagttaacgtagtttacgacgtaacgtagttaacttcggtttaaagtaaacgggtaaaactttccggttaaactttaaaccgtaacgtttaaaccgacccgtaaacgtaacctaaacctaacgttaaccccgaaaacgtaacccgtttccgtttaccctaccccgttagtaccgttaaccgttacgtaaccccgttgttacgtacccgtaaccccgtaaccggacccgtacgacccgttgtttacctaaagtttcgttaccgaggttaccgaacgtacgaaccgttcggaaccgggaacgtaacggtaaccgtaacg

SEQ ID NO: 241690 - DNA, 818 bp, Homo sapiens
  misc_feature: GYAE6OF02HRO2X.19.68.G02.1.454.CMB.1.raw
  modified_base (177)..(177): a, c, t, g, unknown or other
  misc_feature (177)..(177): n is a, c, g, or t
  modified_base (269)..(269): a, c, t, g, unknown or other
  misc_feature (269)..(269): n is a, c, g, or t
tcagtactctcgtgcacgaccggtgctcgatttagtcgatagtgaagggaaagggggcagagcctgctgaattctggctgaccagggcagtcaccagagctccagacaatgtctgtcgccttcctcatcttcctgcccgtgttgggcctcccagtcggggtgtcctgtcacgaggtnctagctcgacaacacgtcacggtacccaggtacctgggtgaaaccgccctaggaccgagacgccttctaccaacttcctaacctgtaacccngttccgtccgggggaactagtcgttacctacgttagtacgacgacgtcccgacgtaaccgtttcgggacgtcggtacctaccggaacggtccgtaaccggtaccccgacgttaccggacggtacggttcccgtttacgggacggtttacgggccggttaacggggaaacggtaacctaacggttaaccgttaaccgtaacgggtccgttaacgggttacgttaacgtaggtaagttaacggtaactttaggtacggtacgttaacggtacttaacgggttacggttaaaaggtaaaccggttcggttaaacttttaaccaaacggtttaacggaacccgtaaaaggtaaccaaacctaacggtaaacccgtaaacgtaaaccctacggtttacccctaccgtacgttaacctacccgttaaggtaccttacgttaccgtaacgtcccgtaacccgtaacgaccgaccgttcgttaaccgtcgtttaacgccgtttacggaacgtacgaacggtacctccgtaccggtaacggtaacgggtactaaccgg

SEQ ID NO: 241691 - DNA, 464 bp, Homo sapiens
  misc_feature: GYAE6OF01BVBYI.44.28.C06.1.454.CMB.1.raw
  modified_base (438)..(438): a, c, t, g, unknown or other
  misc_feature (438)..(438): n is a, c, g, or t
  modified_base (444)..(445): a, c, t, g, unknown or other
  misc_feature (444)..(445): n is a, c, g, or t
  modified_base (447)..(464): a, c, t, g, unknown or other
  misc_feature (447)..(464): n is a, c, g, or t
tcagacagtatatacacgaccggtgctcgatttagagctcacgtattgggtttgggagtagcacaagctacgcggactccgtgaagggccgattcaccatctccagagacaacgccaagaacacgctgtatctgcaaatgaccagcctgagagtcgaggacacggctgtgtattactgtgcgaccatactcagcgccgtggacgttccgttcgtagaagttacttaccaagtagttcggggaccgagggccacccgtggtccaccgtccgcctcacgcctcccaccgacgggcccagtccggtccttccccctggccgccctgcctccgaggcgccaccctaccgagacgccacaggccggcccgtcgggctcggcctggtacaacgggtacctacttcctaagtatcgtgtcctggaggccgggcgtgacgaggccnagtagnngnnnnnnnnnnnnnnnnnn

SEQ ID NO: 241692 - DNA, 900 bp, Homo sapiens
  misc_feature: GYAE6OF01AMCU5.44.28.C06.1.454.CMB.1.raw
  modified_base (206)..(206): a, c, t, g, unknown or other
  misc_feature (206)..(206): n is a, c, g, or t
tcagacagtatatacacgaccggtgctcgatttagagctcacgtattgggtttgggggagctctgagagacgagcccagcactggaagtcgccggtgtttccattcggtgatcatcactgaacacagaggactcaccatggagttgggctgagcgttgggtttcctcgttgtcttacttttaagaggtcgtaccagttgtcgaggngctacgttgggtggagtcggtggggggacggcggtcggtaccgacgggccccggggtaggtccccgtggacgtaccttccgttccgttggttcgttaccgcccgtttcggttcgggtttacccttcgtaacgtttccggtaagtttacggttagtttttgggtttacgcgtaaccggttcgggggttcccgacccggtacggccctcccgggaacgggtaccgggaacggggggtcccgggtagggttcgggggtaccggtcaggttacccgtacgtcccggtaccggtaacggtaaggttaggggtaaacggtggtaaaacggttaaacggtttactttaacccggacgtaacgggtaacccggtttccgggggtaaagggtaaacccggggttcccgttaacttacccgtaaaccccttacgttaccccttaccgggaaacggtaaccgttaaaccgtaaaccgtttaacccgaaaaggttacctacggttacgtaccgtttaagtttacgttaacggtaaactaaacgttccgaaacgtcggtacgtaaacggtggttaaccggtaaggaccgttaacctcggttctttaacgtttagtaccgtgggtaccgggaacggggtaccggggtaacccgttaaaccgggaaacgggttaacgggtaaggaacctacggtaaaactacgttaacg

SEQ ID NO: 241693 - DNA, 418 bp, Homo sapiens
  misc_feature: GYAE6OF02IGD20.44.28.C06.1.454.CMB.1.raw
  modified_base (411)..(418): a, c, t, g, unknown or other
  misc_feature (411)..(418): n is a, c, g, or t
tcagacagtatatacacgaccggtgctcgatttagagctcacgtattgggtttgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaaggggaccacggtcaccgtctcctcagcttccaccaagggccccatcggtcttcccctggcgcccctgcctccaggagcacctctcgggggcacagcggccctgggcctgccctggtcaaggctacttccacgtctactgctgagcgggctggcaaggcgcagtagnnnnnnnn

SEQ ID NO: 241694 - DNA, 546 bp, Homo sapiens
  misc_feature: GYAE6OF02F47KG.44.28.C06.1.454.CMB.1.raw
tcagacagtatatacacgaccggtgctcgatttagagctcacgtattgggtttggggagctctgagagacgagcccagcactggaagtcgccggtgtttccattcggtgatcatcactgaacacagaggactcaccatggagtttgggctgagctgggttttcctcgttgctcttttaagaggtgtccagtgtcaggagcacttggtggagtctgggggaggcgtggtccagcccgggaggtccctgagactctcctgtgtagcctctgggttctcattcgatagattttggtttgcactggggtcccgccaggctccaggcaaggggccgagtgggtggcagtcatctccgagatggaagtgagaagtattactcagactccgtgaacgggccattcaccatctccagagaacaattccaagaatatgctgtatttgactaaatgaacagcgtagagtagttgacgacacgtcttagtttacttacgtgtgcggacggggtacctacggaagggtaacgggttacgggaatacgataacgtaacg

SEQ ID NO: 241695 - DNA, 583 bp, Homo sapiens
  misc_feature: GYAE6OF02I050H.44.28.C06.1.454.CMB.1.raw
  modified_base (310)..(310): a, c, t, g, unknown or other
  misc_feature (310)..(310): n is a, c, g, or t
  modified_base (447)..(447): a, c, t, g, unknown or other
  misc_feature (447)..(447): n is a, c, g, or t
tcagacagtatatacacgaccggtgctcgatttagagctcacgtattgggtttggggagctctgagagacgagcccagcactggaagtcgccggtgtttccattcggtgatcatcactgaacacagaggactcaccatggagtttgggctgagctgggttttcctcgttgctcttttaagaggtgtccagtgtcaggagcacttggtggagtcgtgggggaggcgtggtccagcccgggaggtccctgagctctcctgtgtagcctctgggttctcattcgatagattttggttgctacgtggggtcccnccgagggcctccgagggcgaagggggccgaggtgggtggcaggtcatctccgagatggaagtgagtaagtattaccagacctccggagaagggcctactcaaccatctaccgagacgactaattaccgaagaattangacttgttatttgactaaagtgaacagcgtagagtagttgacgtacacgttcttagtttaatcgttggacggtcgggaacggggtacctaccggaagggtaaccgggttcggggaatacggtaacttaacgtaacc

SEQ ID NO: 241696 - DNA, 690 bp, Homo sapiens
  misc_feature: GYAE6OF02ILMC6.44.28.C06.1.454.CMB.1.raw
  modified_base (250)..(250): a, c, t, g, unknown or other
  misc_feature (250)..(250): n is a, c, g, or t
tcagacagtatatacacgaccggtgctcgatttagagctcacgtattgggtttggggagctctgagagacgagcccagcactggaagtcgccggtgtttccattcggtgatcatcactgaacacagaggactcaccatggactttgggctgagattgggtttttcctcgttgcttcttttaagaggtggccagtgtcaggtgcagctagtggagtcgtgggggagagcggcccagccgtgggaactcccngagactctcctgtcgcagcctcgtggattcattcttcgacggaccttatcgccagtcgaccacgttcggggtcccgccgaggcctccgagggaccgaaggggctagggaggtgggtacggactaaatttgtactacgaaggaagtagtagggtaattaggaagtaaacctacgtaacggacgtacccgtaaccggaaggaaaccgggcctaacgttccgaacccggttctaccccgaaggaactaaccgtaaacgttcccgaaacggtaaccaccgtacgtcgacctacttcgacgtaactaaacgtccgtaaacctaacccgtaaccaacgtaacggtacggaacggaaccgtaccgggtaccttacggttaacctttaagttttaagttcggttacggaacccgtacggaccccgttcccccggtaggtaaccccggg

SEQ ID NO: 241697 - DNA, 964 bp, Homo sapiens
  misc_feature: GYAE6OF02F1KR0.44.28.C06.1.454.CMB.1.raw
tcagacagtatatacacgaccggtgctcgatttagagctcacgtattgggtttggggagctctgagagacgagcccagcactggaagtcgccggtgtttccattcggtgatcatcactgaacacagaggactcaccatggagttggctgagcttgggttttcctcggttgccttcgttttaagaggttcgtccagtgtcgaggagctacgttggtaggagttcggtgggggagcgtggtccaacggcccggggtagtccctaggacgaccttccgtccgtggtcgtacgtcccgttcgttcgggtttacctcgtacgtttaccggaattaacggtttggttttttcggggtttccgtacccgaccgggttttaccgggggtcccccgtaccggtaccgggtccccgttacccggaagggggtaaccccggtaaacggggggggccccggtaaggggtttcgggggtacgggaccgtaggtacccgtacgttccccggttaaccgggaaccggtagggtacgggtaaacggttagggaaagttaaaaccggtttacttaaacccgcggttaaacgtaaccccgggtttacggtaacggggtaaaccgggtacccgtttaactttaacccggaacccttaaacgtttccccgtaaccgtaaacggggtaacctaaaccgttaacgttaacccggaaaacgttaagttacggttcgttaacggttttacgtttaacgtttaacgtaaacgtaaacggtttaacgaaaccgttcggtaccggttaaggtaacggttaccggttaaccgaacccggttaaaccttacggtttaccgttttacgtttaaccgtagggtttacgggaaccgggtaaccggggtaaccccgggtttaccgtaaacccggggtaaacgggttaacccggggttaagggtaacccttaacggttaaaccgtttaaccttaacgg

SEQ ID NO: 241698 - DNA, 530 bp, Homo sapiens
  misc_feature: GYAE6OF02HK83K.44.28.C06.1.454.CMB.1.raw
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
  modified_base (269)..(269): a, c, t, g, unknown or other
  misc_feature (269)..(269): n is a, c, g, or t
  modified_base (329)..(329): a, c, t, g, unknown or other
  misc_feature (329)..(329): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
  modified_base (488)..(489): a, c, t, g, unknown or other
  misc_feature (488)..(489): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
  modified_base (497)..(498): a, c, t, g, unknown or other
  misc_feature (497)..(498): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
  modified_base (506)..(513): a, c, t, g, unknown or other
  misc_feature (506)..(513): n is a, c, g, or t
  modified_base (515)..(518): a, c, t, g, unknown or other
  misc_feature (515)..(518): n is a, c, g, or t
  modified_base (521)..(521): a, c, t, g, unknown or other
  misc_feature (521)..(521): n is a, c, g, or t
  modified_base (523)..(530): a, c, t, g, unknown or other
  misc_feature (523)..(530): n is a, c, g, or t
tcagacagtatatacacgaccggtgctcgatttagagctcacgtattgggtttgggagtagcacaagctacgcggactccgtgaagggccgattcaccatctccagagacaacgccaagaacacgctgtatctgcaaatgaacagtctgagagccgaggacacggctgtgtattacngtgcaagngcggtgcgggagttcgggagttcgcatacgtactactacggtatggactcgtggggcctaagggaccaggtccaccgtctcctnacgtctaccacgaaggccaatcggtccttcccctggccctacccgtgacctccgaggccncgacccgtgtcggggctaacgcgccgtccgtggccttagcccgtggaacgaacggtaccttaaccgtttcctagtaacttacgtcgtaccgtaggtacggccggtccgtacggtaccgtaagggccctagttaacgaggtcangacgngcgcagcncgnngncngngnngncgngcnnnnnnnngnnnngtngnnnnnnnn

SEQ ID NO: 241699 - DNA, 493 bp, Homo sapiens
  misc_feature: GYAE6OF01A931W.38.11.A11.1.454.CMB.1.raw
  modified_base (405)..(405): a, c, t, g, unknown or other
  misc_feature (405)..(405): n is a, c, g, or t
  modified_base (488)..(488): a, c, t, g, unknown or other
  misc_feature (488)..(488): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggcacggtattaacacctggttggcctggtatcagcagaaaccagggaaagcccctatgtccctaatctttgatgcatccactttgcaaactgggtccatctaggttcagcgcagtggatctggacagatttcactctcaccatcgacaacctgaagcctgaagattctgactaatttattactgaccaanaataataatacttacccgtctaccttcgccaaggacacgactaggagaattaaacgactagtggctagacacatctgtcttcnttccc

SEQ ID NO: 241700 - DNA, 594 bp, Homo sapiens
  misc_feature: GYAE6OF01C017G.38.11.A11.1.454.CMB.1.raw
  modified_base (228)..(228): a, c, t, g, unknown or other
  misc_feature (228)..(228): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgcgggcgggcacggtattaacnctggtgcctggatcagcagaaccaggaagcccctatgtccctaatctttgatgcatccatttgcaaactgggtccatctaggttcagcgccagtggatcgtggacagactttcactctcaccatcgacaacctgaagccctagaagtattctagtactaaattttacttaactagtacccaaataataacttaaactaacccgtttaccccggtactaaccctttaccgggaccctaaacgggtaccaaccgaacgttacgggaacgtaaaacgtttaaaaccggaaacgttaggtacgggtaccttagggaccccaaacccgttacttacccgttaggtttcccttaccgtaacgttttcccccg

SEQ ID NO: 241701 - DNA, 614 bp, Homo sapiens
  misc_feature: GYAE6OF01CZKDY.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgttccaggtgacagatgtgacatccagatcgacccagtctccatcctcactgtctgcatctgtaggagacagactcaccatcacgttggtcgggcgggcacggtattaacgaccgtggtggcctggtatcagacaagaaccaggaacgccctagtcgtaccctaattctttagatcgctactcctactttcgactaacgtcgggtacctatcgtacggttcacgtcgaccgagtcggatcgagggacagtacttcactctacactactcgaactaacctagaacgtcctagaacgtattcagtaactaattttactactacgaacctaaattaataacttaacgtaacccgttacccggtacttacccggttaccggaaccgtaacgggacctaaccggtacggtaacggtaaaccgtaagtaaaaccggtacgtaggtacggcctacggacctaacccgtacttaccgttagttccttcgtaaccttaccccgg

SEQ ID NO: 241702 - DNA, 511 bp, Homo sapiens
  misc_feature: GYAE6OF01A5QQG.38.11.A11.1.454.CMB.1.raw
  modified_base (343)..(343): a, c, t, g, unknown or other
  misc_feature (343)..(343): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
  modified_base (486)..(486): a, c, t, g, unknown or other
  misc_feature (486)..(486): n is a, c, g, or t
  modified_base (505)..(505): a, c, t, g, unknown or other
  misc_feature (505)..(505): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttggtcgggcgggcacggtattaacacctggttggcctggtatcagcagaaaccagggaaacgcccctatcgtccctaatctttgatgcatccactttgacaacgtgggtccatcgtagttcagcgccagtggatcgngggacagtatttcactctacacatcgacaacctgaancctagaacgtnttcagtactaatttattactgaccaactaatataactaaccttacccggtctaccgttcggaccaagggacacgactagaagtataaacgactgngctgacactatctagtctnctcccg

SEQ ID NO: 241703 - DNA, 575 bp, Homo sapiens
  misc_feature: GYAE6OF01CNTCT.38.11.A11.1.454.CMB.1.raw
  modified_base (387)..(387): a, c, t, g, unknown or other
  misc_feature (387)..(387): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacacctggttggcctggtatcagcagaaaccagggaaacgcccctatgtccctaatctttgatgcatccactttgcaaacgtgggtcccatctagttcagcgcagtgatctggacagatttcactctcaccatcgacaacctgaacgcctagaagattcngtactaatttacttactagacctaacaattaattaaacttaacctttacccggtacctacccgtttaccggaccctaaagggaccaacggtactacgggaagtaaacgtttaaaaccgaacgttaggtacggtccttacggaccctaaccgtaacttaccttaggtttccctttcgaacgtttccccg

SEQ ID NO: 241704 - DNA, 582 bp, Homo sapiens
  misc_feature: GYAE6OF01CXWUI.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcggggcacggtattaacacctggttggcctggtatcagcaagaaaccagggaaacgcccctatgtccctaatctttgatgcatccactttgcaaacgtgggtccatctaggttcagccgccagtggatcgtgggacagtatttcgactctcacatcgacaacctgaacgctgaagattctgtactaaatttacttaactacgaccctaaactaaattaactaaactttaaccgttaccccggtactaacccgtttaccggacctaaacgggaccacgtaacgttacggaagtaaattaaaccggaacgttgtacgggtacctacggacccaaccgtacgttacgtagttacccttcgtactttaccccg

SEQ ID NO: 241705 - DNA, 589 bp, Homo sapiens
  misc_feature: GYAE6OF01AIUGP.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggcacggtattaacacctggttggcctggtatcagcagaaccagggaacgcccctatcgtaccctaatctttgatgcatcctactttgacaacgtcgggtccctatcgtaggttcagcgccagtggatcgtggacagtactttcactctcacctatcgacaacctgaacgcctagaatacttctagtactaatttacttactacgacctaataattaacttaacgttaccgttaaccccggtcctaacccgtttaccggaccgtaacgggaccaaccggtacgtcgggtaaacgtaacgttaaaccggacgttggtacggtccttacgacctaaccctacgttaccttaggttcctttaccgtacgtttaccccg

SEQ ID NO: 241706 - DNA, 543 bp, Homo sapiens
  misc_feature: GYAE6OF01EJ3WU.38.11.A11.1.454.CMB.1.raw
  modified_base (537)..(537): a, c, t, g, unknown or other
  misc_feature (537)..(537): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagacgtcaccatcacgttggtcgggcgggcacggtataacaccgtggttggcctggtatcagcaagaaccgaggaacgccctatcgtacctaatctttgatgctactcctactttgacctaaacgtcggggtaccagtcgtaggtcacgcgctaggtgactcgtgggactagtactttcactctacacctataccgacaaccgtagaacgcctaggaagtcttacgtacgtacttaatttactactacaacctaacaattaactaacttaccgttacccgtctaccgtcgacgaacgacacgacgtagacgtaataacgtacgtgcgctcacactctactagtcctntctccg

SEQ ID NO: 241707 - DNA, 635 bp, Homo sapiens
  misc_feature: GYAE6OF01BQL6P.38.11.A11.1.454.CMB.1.raw
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatcgacccagtctccatcctcactgtctgcatctgtaggagacagagtcaccatcacgttggcgggcgggcacggtattaaccgccgttggtacggcctggtactcgagacaaggaaaccgagggaactccctagtcgtacctatcttagatgactatcctagttacgactaacggttcgggtaccctagtcgttaggtcaggtccgcgagtcggactcggtaggactagtactttcacgttcnccaacnctacgaactaccgtagaacgccgtaagtaacgtacttacgtagtaacttaacgttttactaaccgtacgtaaaccctaaagttaacttaaacttaaaccctttaacccgttaccccggtaacccgttaacccgtttacggaacccgttaacgggacctaacggtacgtaaggacgttaaacgtaaacgacgttagtacggctacgaccactacttactagttccttccgtcgtaccc

SEQ ID NO: 241708 - DNA, 647 bp, Homo sapiens
  misc_feature: GYAE6OF01DA8TB.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatcgacccagtctccatcctcactgtctgcatcgtgtaggagacagagtcaccatcacgttggtcgggcgggcacggtacttaacgaccgttggtcggcctggtatcagcaagaaaccgagggaacgccctagtcgtaccctaatcttagatcgactactcctacttacgactaacgtcgggtccagtcgtaggtacaggcctcgaggtcgtatcggaggactagtacttccacgtcctaccacctagtaccgaactaaccgtacgaacgtaccgtagtaagtcttacgactacgttaaactttacgtaactacgtaaccaaataacttaacgtaactttaacccgttacccgtaccttaacccgtaccggtaaccgtaaccgggtaccgaacgtacgtacggtaaacgtaaaccgttaaacgtaaccgttaggtaccggtacctacgtaacccgtaaccttacgttaccttagtttacccttctaccggtttaccccc

SEQ ID NO: 241709 - DNA, 652 bp, Homo sapiens
  misc_feature: GYAE6OF01BPLQ8.38.11.A11.1.454.CMB.1.raw
  modified_base (171)..(171): a, c, t, g, unknown or other
  misc_feature (171)..(171): n is a, c, g, or t
  modified_base (283)..(283): a, c, t, g, unknown or other
  misc_feature (283)..(283): n is a, c, g, or t
tcagtcgatcacgtcacgaccggtgctcgatttagctacgactgcagggggagtcagacccagtcaggacacagcatggacatgagggtcctcgctcagctcctgggctcctgctgctctgtttcccaggtgacagatgtgactatccagatgtacccagtctccatcctnactgtctgcatctgtagggagacagacgtcaccagtccacgttggtcgggcgggcacggtattaacaccgtgggttcggcctggtactcgagacaagaaaccgagggaaacncccctatcgtaccctatcttgatgcactccgacgtttgacgtaaacgtcgggtaccctagtcgtaggttcacggtacgactagtggacgttcgtgggactagtctttaccgacttcctacactactaccgaaccgtaaccgtagtaacgaccctaagtaacgtacttacgtacgtacttaaatttacttactcggtaacctaaacgtaattaactaaaccttaacccgttaacccggtacctaacccggttacggaacccgtaacgggtacctaacggtacgtagggtaaacgtaacgttaaacggtaccgttaggtacggtacttacgacctaaccgtacttacgtacgttccttacgtacgttcccg

SEQ ID NO: 241710 - DNA, 568 bp, Homo sapiens
  misc_feature: GYAE6OF01BN0EB.38.11.A11.1.454.CMB.1.raw
  modified_base (188)..(188): a, c, t, g, unknown or other
  misc_feature (188)..(188): n is a, c, g, or t
  modified_base (269)..(269): a, c, t, g, unknown or other
  misc_feature (269)..(269): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
tcagtcgatcacgtcacgaccggtgctcgatttagctacgactgcaggggatcagacccagtcaggacacagcatggacatgagggtcctcgctcagctcctggggctccttctgctctgtttcccaggtgacagatgtgacatccagatgacccagtctccatcctcactgtctgcatctgtagganacagagtcaccatcacttggtcgggcgggcacggtattaacaccgtggttcggcctggtatcagcaagaaaccagggaacnccctatcgtacctaatcttgatcgctactcctactttcgactaaacgtcgggtcccatcgtagtcagcgcgagtgactcgtggacagtattcactcacactancgacactgaacnctagaactnttctacgtactaatttactactacgaccaaactaactaataacttaccttacccgtactaccgttcggacgtaacggacacgtacgtaggaacgtaaacgttaaaccgtacgtacggtaggacgttacgacctaacctacgttctacgttaccttacctacttcccgttaccccg

SEQ ID NO: 241711 - DNA, 573 bp, Homo sapiens
  misc_feature: GYAE6OF01EPX6W.38.11.A11.1.454.CMB.1.raw
  modified_base (264)..(264): a, c, t, g, unknown or other
  misc_feature (264)..(264): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtataacaccgtggttgcctggtatcagcagaaaccaggaacncccctatcgtcctaatctttgatgcactcctactttgactaaacgtcgggtacccagtcgtaggttcacgcgccaggtggatcgtggactagtactttcactctacactactcgaaccaacctagaacgtcctagaagtacttctacgtacttaattttactactacgaccaaactaataacttaactaaccgttacccgtactaaccgttaccggaccgaacgggaccacgacgtaggtaacgtaaacttaaaccggattggacggtctacgaccaaccgtattccttagttccttctcgttaccccg

SEQ ID NO: 241712 - DNA, 597 bp, Homo sapiens
  misc_feature: GYAE6OF01D5M36.38.11.A11.1.454.CMB.1.raw
  modified_base (188)..(188): a, c, t, g, unknown or other
  misc_feature (188)..(188): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacttggtcgggcgggcacggtattaacacctggttgcctggtatcagcagaaaccagggaaacgcccctatcgtaccctaatctttgatgcatcctactttgacaaactcgggtccatctaggttcagcgcagtggatcgtgggactagtactttcactctacacctataccgactaacctgaacgcctagaacgtattctagtacttaattttacttactacgtacctaaactaataacttaacttaaccttacccggtacctacccgttaccggaacccgtaacgggaccaaccgtaaccgtaggtaaacgtaacgtttaaaaccgaacgttaggtacggtccttacgacctaaccctacttaccgtagttaccctttcgtactttacccccg

SEQ ID NO: 241713 - DNA, 573 bp, Homo sapiens
  misc_feature: GYAE6OF01CJKGJ.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttggtcgggcggggcacggtattaacaccgtggttggcctggtatcagcaagaaaccgaggaacgcccctatcgtacctaatcttgatgcatcctatttcgactaaacgtcggggtacccatcgtaggttcagccgccaggtggatcgtggacagtattcactctacaccatcacacctagacgtctagagtattctagtacttaatttactactcgtaaccaactaataacttaacttaccgttaaccccggtacctacccgttaccggaccgaacgggtaccaacggtacgtaggaacgtaacgtaaaccgtacgtaggtacggtcgtacgaccacctacttcgtatttccttcgtacgttccccg

SEQ ID NO: 241714 - DNA, 578 bp, Homo sapiens
  misc_feature: GYAE6OF01BLHMV.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggcacggtattaacacctggttggcctggtatcagcagaaaccagggaaagcccctatgtccctaatctttgatgcatccactttgcaactggggtcccatctaggttcagcgccagtggatcgtggacagatttcactctcaccatccgacaacctgaacgcctagaacgatttctagctaaatttactttactcgacctaacaaacttaataaacttaacctttaaccccggtacctaacccgtttaccggtacccgaacgggtaccaacgtaccgtagggtacgtaaacgttaaaaccgaacttaggtacggccgttacggacctaaccctacttccttagttccttcgtactttcccccg

SEQ ID NO: 241715 - DNA, 642 bp, Homo sapiens
  misc_feature: GYAE6OF01DQQD2.38.11.A11.1.454.CMB.1.raw
  modified_base (188)..(188): a, c, t, g, unknown or other
  misc_feature (188)..(188): n is a, c, g, or t
  modified_base (274)..(274): a, c, t, g, unknown or other
  misc_feature (274)..(274): n is a, c, g, or t
  modified_base (609)..(609): a, c, t, g, unknown or other
  misc_feature (609)..(609): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtagganacagagtccaccatcacgttggtcggggcgggcacggtattaacgaccgttggttggcctggtatcagcaacgaaaccgaggaacncccctatcgtaccctaattctttgatgactactcctactttgactaacgtcgggtccctatcgtacggttcacggtccgaccgtaggttcggtattccggtaggggaactacggttaacttttccgaaccttcccgtaccaaccctacgttaacccgaacctaaacccttaggaaaccgtcccgttaaggtaaacgtactttccttacgtaactttaaagttttaacttacctacgaacctaaactaattaacttaacttacccgttacccggtactacccgttacgaccgtaaggaccacgtacgtaggaataacgtaaacgtacgtgtcgacncgacctacgtactctagttcctcgtcttacccg

SEQ ID NO: 241716 - DNA, 550 bp, Homo sapiens
  misc_feature: GYAE6OF01CAPI0.38.11.A11.1.454.CMB.1.raw
  modified_base (232)..(232): a, c, t, g, unknown or other
  misc_feature (232)..(232): n is a, c, g, or t
  modified_base (270)..(270): a, c, t, g, unknown or other
  misc_feature (270)..(270): n is a, c, g, or t
  modified_base (534)..(534): a, c, t, g, unknown or other
  misc_feature (534)..(534): n is a, c, g, or t
  modified_base (542)..(542): a, c, t, g, unknown or other
  misc_feature (542)..(542): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatcgacccagtctccatcctcactgtctgcatctgtaggagacagagtcaccatcacgttggtcgggcgggcacggtattaacnccgtggttggcctggtatcagcagaaaccagggaaacncccctatcgtcctaatctttgatgcatccactttgacaacgtcgggtccatctaggttcagcgccagtggatcgtaggacagtatttcgacttctacacctactacgaacctaacctcgaacgcccgtagaatacgttctagacttaactttattactcgacctaataatataactaccgttacccgtctaaccgttcgacctaacgggacacgacgtaggtagaacttaaacgacttagtcggtctacggactaccgtatctntccttacnttaccccg

SEQ ID NO: 241717 - DNA, 562 bp, Homo sapiens
  misc_feature: GYAE6OF01CRI3H.38.11.A11.1.454.CMB.1.raw
  modified_base (229)..(229): a, c, t, g, unknown or other
  misc_feature (229)..(229): n is a, c, g, or t
  modified_base (340)..(340): a, c, t, g, unknown or other
  misc_feature (340)..(340): n is a, c, g, or t
  modified_base (380)..(380): a, c, t, g, unknown or other
  misc_feature (380)..(380): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtagagacagagtcaccatcacgttggtcgggcgggcacggtataacnctggttggcctggtatcagcaagaaaccagggaaagcccctatgtccctaatcttgatgcatcactttgcaaacgtcgggtaccatctagttcagcgcagtgatctggacngtatttcactcacaccatcgacaactgaacgccctagaanacttctagtctaatttatactgaccaactaataattaaacctacgttaacccggtacctaccgtttaccggaccgaacggtaccgaacgtaacgtagggaacgtaagttaaaaccggtaacttaggtacggacgtacgtaccgaacctacttacttcggtacctttccgacgtttacccccg

SEQ ID NO: 241718 - DNA, 715 bp, Homo sapiens
  misc_feature: GYAE6OF01DUHAD.38.11.A11.1.454.CMB.1.raw
  modified_base (195)..(195): a, c, t, g, unknown or other
  misc_feature (195)..(195): n is a, c, g, or t
  modified_base (306)..(306): a, c, t, g, unknown or other
  misc_feature (306)..(306): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatcgaccctagtctccactcctcactgtctgctatcgtaggtagganacagacgtcacctatctacgttcgggccggggcgggtactaacggttattaaccgacgttgggttcggccgttaggtactcgacgacaaacggaaaaccgaagggtaaccnccccttagtaccgtacccttaattcgttttagagttcgacttaccttacccgttaacgtttacgaaccgtaaacggttccgggtaccctagttacgttacggttcacggtcgtaccgtaggtgtacgtcgtaggaactagtacttacactctaccactacgaccaactaacgtcgaacgtcctaagtacgtacttcgtagtaactttaatttactacgtaacgaacctttaaataattaacttaaaccgttacccgttacccggtacccgttaaccgttacccggaaccgtaaacgggtaccaacggtaacggtacggaaaccttaaaagtaaacgttaccggttaggtaccgttccgtacgaaccctaccgtattccgttacctttaccgtacttacccgttcccccg

SEQ ID NO: 241719 - DNA, 650 bp, Homo sapiens
  misc_feature: GYAE6OF01CM221.38.11.A11.1.454.CMB.1.raw
tcagtcgatcacgtcacgaccggtgctcgatttagctacgactgcaggggatcagacccagtcaggacacagcatggacatgagggtcctcgctcagctcctgggctcctgctgctctgtttcccaggtgacagatgtgacatccagatgacccagtctccatcctcactgtctgcatctgtaggagacagacgtcaccatcacgttggtcggggcggggactaccgggttattaaccgaccgttgggttcggccgtggtatcgagacaagaaaccgaggaacgtcccctatcgtaccctaattctttgatgctactcctacttacgacgtaaacgtcgggtacctagtcgtacggttcacgccgactaggtcgacgtcggtgggtaactagttactttaccaccttactacctaccgtacgtaccgaacctaaccgtagtaaccgtacccgttaagtaacgtactttactacgtaacgtttaaatttacgttacgtactaacctaaactaaactaactttaaactacccgtttacccggtaccttaccgttaccggaaccgaaggaccaacggtacgtaggaactaaacgttaaacgaccgttgtacggtctacgacctacgtacttcgttacttctctacgttccccg

SEQ ID NO: 241720 - DNA, 699 bp, Homo sapiens
  misc_feature: GYAE6OF01BVL7X.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatcgacccagtcctccatcctcactgtctgcatcgtggtaggagacagagtcaccatcacgttggcgggcgggcacggtattaaccgcgtggttacggccttggtatcgagacgaacggaaaccgagggaaacctcccctaatccgttacccctaattcgtttagactacgaccaactttcctaacgttttacgaacctaaaccggttcggggttacccctaagtttcggttaaccgggttccacggtcccggtaccgtaaggttcggacgttaccggtaggggtaacttaacgtacttttaccacccgttactacccaacctacgttacccgaaacctaaccgtaggaaccggtaccctaaggtaacgtactttcgtagtaacctttaatttaacgtactacgaaccttaaagaactttaataaccgttaacccgttacccggtaccttaaccggtaccgtaaccgaaggacctaacggtacgtaggtacgtaaacgttaacgacgtggacgtctacgctaccgtacttcgttataccttcgtcctcccg

SEQ ID NO: 241721 - DNA, 788 bp, Homo sapiens
  misc_feature: GYAE6OF01C7NN0.38.11.A11.1.454.CMB.1.raw
tcagtcgatcacgtcacgaccggtgctcgatttagctacgactgcaggggatcagacccagtcaggacacagcatggacatgagggtcctcgctcagctccgtggggctcctgctgctctgtttcccaggtgacagatgtgacatccagatcgacccagtcctccatcctcactgtctgcatctggtaggagacagacgtccaaccatcgtacgttcgggtcggggccggggactacggttaacttaaccgaccgttgggttcggaccgttagggtaactacgaaggaccgaaacggaaaacccggaagggggtaaaccctccccctttaagttacccggttaacccctttaaagtttccgttttaggaacttcgacctaaccgtttaccctaacgttttacggaaccggtaaaaccggttccgggggttacccctagttaccggttacgggttaccaacggccgtaccgtaggtcggtactcgggtaggtactagtactttccactcctacacctagtaccgaactaaccgtgaacgtccttaaggaaacttacgttctacgttaactttaaacttttacgttaaccacgtaaaccctaaactaaacttaaacgttaaacctttaacccggttaaccccggttaaccttacccggttaccggtaacccgaaacgggtaccgaaccggtaagtaacggaaacgttaaacgtaaacggtacgttacggtacgaccgttacgaaccctaaccttacgtactttacgttacccttacgtccgtttaccccg

SEQ ID NO: 241722 - DNA, 658 bp, Homo sapiens
  misc_feature: GYAE6OF01B6Q5B.38.11.A11.1.454.CMB.1.raw
  modified_base (268)..(268): a, c, t, g, unknown or other
  misc_feature (268)..(268): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacaccgtggttgcctggtatcagcaagaaaccgagggaacncccctatcgtcctaatctttgatgcactcctactttgaccaaacgttcgggtacccagttcgtacggttcacgcgccgaggtgacgtcgtaggacagtactttcacctctaccacctataccgaacctaaccgtagaacgtacccgtagaacgtactttacgtagtacttaagttttaacttaccgtacgaaccctaaactaacttaattaaaccgtttaaccccgtttaccccggttaccttaaccccggtttaccggaacccgtaacgggtacctaaccggtacgttagggtaaacgtaaaacgttaaaaccggtacgttacggtacggtcctacggaccctaacccttacttaccgttacgtttccctttactcccgtttacccccg

SEQ ID NO: 241723 - DNA, 686 bp, Homo sapiens
  misc_feature: GYAE6OF01EK9VP.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtccaaccatccacgttggtccggggcggggctacggtaacttaaccgaccgttgggttcggccttggtactcgagaccaaggaaaccgagggaaacctccccttaagttccgtaccctaattcgtttaggactcgacctactccctacgtttgaaccgtaacggttcgggtacccctagttccgtaggttccagtccgcgtaggtcgactcggtaggactacgttactttccgaccttctaccacctactacccgaacctaaccgtaggaaccgtccgtaaggaacgttctttaccgtagtaacctttaagtttacctacgtaccgtaacctaaataattaacttaaccgttaacccgttacccgtactacccggttaccggaaccgtaacgggacctaacgacgtaggaaacttaaacgttaaccgacgttggtcgtaccgtcgaaccctacgttacttaccgttaggttaccctttcgccgtttaccccg

SEQ ID NO: 241724 - DNA, 701 bp, Homo sapiens
  misc_feature: GYAE6OF01C7967.38.11.A11.1.454.CMB.1.raw
  modified_base (188)..(188): a, c, t, g, unknown or other
  misc_feature (188)..(188): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtagganacagagtcaaccatcacttggtcgggcgggtacacggtattaacaccgtggtgccttggatcagacgaagaaaccgaggaacgccctatcgtaccctaattcttagatgctactcctactttagactaaacgtcgggtaccctagttacgttacggttcgacgtaccgtacccgaaggttcgggtaacttacggtacggggtaacctaggtttaacttttacctaaccgttacctaacccgtaaccctaacgtttacccggaaacctaaccccgttaggaaacgtacccgttaagtaacggttactttaccgtagtaacctttaagtttactaacgttacgaacctaaactaagttaacttaacttaccgttacccggttactacccgttaccggaccgtaaacgggacctaaccggtacggttagaaaccgttaacgttaaaaccggaacgttcggtacgtctacggaccctaacgtacttaccgttatttaccttccgtacgtttaccccg

SEQ ID NO: 241725 - DNA, 564 bp, Homo sapiens
  misc_feature: GYAE6OF01BPDVU.38.11.A11.1.454.CMB.1.raw
  modified_base (195)..(195): a, c, t, g, unknown or other
  misc_feature (195)..(195): n is a, c, g, or t
  modified_base (261)..(261): a, c, t, g, unknown or other
  misc_feature (261)..(261): n is a, c, g, or t
  modified_base (307)..(307): a, c, t, g, unknown or other
  misc_feature (307)..(307): n is a, c, g, or t
  modified_base (434)..(434): a, c, t, g, unknown or other
  misc_feature (434)..(434): n is a, c, g, or t
  modified_base (451)..(451): a, c, t, g, unknown or other
  misc_feature (451)..(451): n is a, c, g, or t
tcagtcgatcacgtcacgaccggtgctcgatttagctacgactgcaggggatcagacccagtcaggacacagcatggacatgagggtcctcgctcagctcctggggctcctgctgctcttgtttcccaggtgacagatgtgacatcccagatcgaccctagtcctccatcctcactgtctgctatcgtgtagganacagactacaccatctacgttcgggcgggcgggacacggttataacgccgttggtcgcctggtacncgagaccaagaaccgaggaacctccctatacgtaccttattcgtanatcgtctactaccacttcgacgtaacgtcggtacctagtcggtacgtacacgcgtcgaggtcgtactcggtggaactatacgtttcaacctctacactacacgaactaccgtagactctagatcgtntactacttaattcactnaacaataataactccgtaacctccgctaccgtagaccgtaacggacactgaacgtacgtaaatacggtctagtcggaactccacacgttactcttacgtcctatcccgttacc

SEQ ID NO: 241726 - DNA, 632 bp, Homo sapiens
  misc_feature: GYAE6OF01BU5FY.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttccaaggtgacagatgtgacatccagatgacccagtctccatcctcactgtctgcatctgtagagacagagtcaccatcacttggtcgggcgggcacggtattaacacctggttggcctggtatcagcaagaaaccgagggaacgcccctatcgtacctaatctttgatgctatcctactttgacctaaacgtcggggtacccctagttcgttaggttccacggtccgccgtaggttggacgtcgttaggggactagtactttcacgttcctacacctactaccgaaccaacctgaacgtcctagaacgtattcgtagtacttaatttactactgtaacctaataattacttaaacttaaccgttaccccggtactacccgttacggaccgtaacgggacctaaccggacgttaacgggtaacgtaaacgtttaaaaccggactttacgggtacggtcctacggaccaaccgttactaccttaggtttcctttaccgtcgtttacccccg

SEQ ID NO: 241727 - DNA, 622 bp, Homo sapiens
  misc_feature: GYAE6OF01CFZNU.38.11.A11.1.454.CMB.1.raw
  modified_base (189)..(189): a, c, t, g, unknown or other
  misc_feature (189)..(189): n is a, c, g, or t
  modified_base (272)..(272): a, c, t, g, unknown or other
  misc_feature (272)..(272): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatcgacccagtctccatcctcactgtctgcatctgtagganacagagtcaccatcacttggtcgggcgggcacggtattaaccaccgtggttcggcctggtatcagacaagaaccgagggaacnccctatcgtaccctaatctttgatcgctactccttactttacgacctaaacgttcggggtaccctagttacgtacggttcacgccggacgtaggtaggtactcgtagggactagtacttcactctacacactacgaacaccgtagaacgtcctagtaacgtacttctacgtacttaagtttaccttagtactaaccaaattaaactaacttaacttacccgttaacccggtcctaaccgttacggaaccgaacggtacaaccgtagtacggaacttaaacgtaaacgtacgttggacggtacctacggtacccaaccgtacttccgttacttaccttcttcctttccccg

SEQ ID NO: 241728 - DNA, 584 bp, Homo sapiens
  misc_feature: GYAE6OF01CCSRT.38.11.A11.1.454.CMB.1.raw
  modified_base (270)..(270): a, c, t, g, unknown or other
  misc_feature (270)..(270): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (551)..(551): a, c, t, g, unknown or other
  misc_feature (551)..(551): n is a, c, g, or t
tcagtcgatcacgtcacgaccggtgctcgatttagctacgactgcaggggatcagacccagtcaggacacagcatggacatgagggtcctcgctcagctcctgggctcctgctgctctgtttcccaggtgacagatgtgacatccagatgacccagtctccatcctcactgtctgcatctgtaggagacagacgtcaccatccacgttggtcggggcgggcacggtattaaccgcctggttggcctggtatcagcagaaccgagggaacncccctatcgtacctaatcgttgatgctatacctactttgacaaacgtcggggtcccatcgtaggtcacgcgccagtggatcgnggacngtattcactcncacatcgacactgaacncgtagaagtattctagacttaatttagttacacgtaacctaactaaattactaacttaaccgtttaccccggacttacccgttaccgaccgtaacgggaccaacggtacgtaggaacgtaaagttaaaccgaacgttggttacggtccgtacgtctaaacccgtnttaccttcggttacccttcgtactttcccccgg

SEQ ID NO: 241729 - DNA, 606 bp, Homo sapiens
  misc_feature: GYAE6OF01CS6SO.38.11.A11.1.454.CMB.1.raw
tcagtcgatcacgtcacgaccggtgctcgatttagctacgactgcaggggatcagacccagtcaggacacagcatggacatgagggtcctcgctcagctcctgggctcctgctgctctgtttcccaggtgacagatgtgacatccagatgacccagtctccatcctcactgtctgcatctgtaggagacagagtccacctatcacttggtcggggcggggcacggtattaaccgcgtggttcggcctggtatcagcaagaaaccgaggaaacgcccctatcgtaccctaatcttgatgctatcctactttgacctaaacgtcgggtacctatcgtaggttcagtccgaccgtagtggactcgaggactagtatttccactctaccactacgtaccgactaaccgtagaacgtccgtagaaacgtactttccgtacgtacttaaacttttactacctacgaacctaaactaaattaactaaacttacccgttacccgtactacccgttaccggaccgtaacgggacaaccgtaacgtaggtaagtaacgttaaacggtacgtgtacggtcacgaccactacttactgttaccttcgtacgttccccg

SEQ ID NO: 241730 - DNA, 878 bp, Homo sapiens
  misc_feature: GYAE6OF01B6H8A.38.11.A11.1.454.CMB.1.raw
tcagtcgatcacgtcacgaccggtgctcgatttagctacgactgcaggggatcagacccagtcaggacacagcatggacatgagggtcctcgctcagctccgtggggctcctgctgctctgttccaggtgacagatgtgacatccagatcgacccagtctccactcctcactgtctgcatcgtggtagacgacagagtccaacctatccgtacgttcgggtccgggggcggggacgtaacgggttaacttaaaccgtaccgttgggttcggcccgttagggtaactaccgaaggaccgaaaacggaaaacccgaacggggaaaccgtacccccttaagtaccggttaccccttaaattcgtttaggaactcgtactacgttaccctaacgtttacgaaccgtaaaccggttcgggtacccctaagttacgttaacggtcgaacggtccgaccgtaaggttcggacgttcggtaaggggaactaacggttactttacaaccgttacctaccgtaacctacgtacccgaaactaaccggtaacgaaccgtacgtaagtaaacggtactttacgtaacgtaactttaaacttttaacgtaaccttaccggaaacctaaactaaactttaaacgttaaaccgttaaccccggtttaccccgggttaaccttaaaccccgggtttaacccgggaaaccccgggtaaaacggggtaaccccgtaaaccgggtaaccggttaaacggggtaaaaccggtttaaaaccgttaaaaacccgggtaacctttaccggggtaccgggtaaccttaccggtaaaccctaacccgtttaacttacccgtttaccggttaccctttaacccggtaccccttttaacccccgg

SEQ ID NO: 241731 - DNA, 604 bp, Homo sapiens
  misc_feature: GYAE6OF01AZXTT.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatcgacccagtctccatcctcactgtctgctatctgtaggagacagacgtcaccatctacgttggtccgggcgggctacggtattaaccgaccgttggttcggtccgtaggtactcgagacaacgaaaccgagggaaaccgcccctatccgttaccctaattctttagactgctactcctacttgacgtaacgtcgggtaccagtcgtacgtcagcgtacgaggtgtacgtcgtaggactacgtactttccacttcctactaccgtaactaccgaactaaccgtacgaacgtacctagaagtcttacgtactacgtttaattacttactacgaacctaataattaacttaactaccgttacccgtctaccgttaccgacgtaacgacacgacgtagaacgtaacgtaacgtacgtgtacgtcacgacacgtactcgtacttactcgtaccttcccg

SEQ ID NO: 241732 - DNA, 717 bp, Homo sapiens
  misc_feature: GYAE6OF01C9LD3.38.11.A11.1.454.CMB.1.raw
  modified_base (172)..(172): a, c, t, g, unknown or other
  misc_feature (172)..(172): n is a, c, g, or t
  modified_base (249)..(249): a, c, t, g, unknown or other
  misc_feature (249)..(249): n is a, c, g, or t
  modified_base (673)..(673): a, c, t, g, unknown or other
  misc_feature (673)..(673): n is a, c, g, or t
  modified_base (706)..(706): a, c, t, g, unknown or other
  misc_feature (706)..(706): n is a, c, g, or t
tcagtcgatcacgtcacgaccggtgctcgatttagctacgactgcaggggatcagacccagtcaggacacagcatggacatgagggtcctcgctcagctccgtgggctcctgctgctctgtttcccaggtgacagatgtgacatccagatcgaccctagtcctccatccctnacttgtcctgctatcgtaggtagagacagacgtccacctatctacgttggccggggcgggactaacggtattaaccnccggttgggttacggccgttaggtactccgaagtaccgaaacggaaaaccgtaagggaaaccgtaccccgttaagttccgtaccccttaaatttccgtttacggaactcggtactacgttaccctacgttttacgaccgtaaaccggtccggggtacctaacgttccgtaggttacacggcgtaccacggtagtcgtacggaggtaacctaggttacttacgtacttcctaccgtaacctacgtaccgtaaacctaaccgtacgtaacgtcccgtagtaaacgtcttacgtactacgtttaattaacttacctacgtaacctaaacttaataacgttaaccttaaccgttacccgtacctacccgttacggaaccgtacgactaccggagttaggaaacttaagtaaaccgtaggtgttacggntaccggtactaacgtacgtacttactaccgttntcccgtacccg

SEQ ID NO: 241733 - DNA, 744 bp, Homo sapiens
  misc_feature: GYAE6OF01CS2XR.38.11.A11.1.454.CMB.1.raw
  modified_base (557)..(557): a, c, t, g, unknown or other
  misc_feature (557)..(557): n is a, c, g, or t
  modified_base (668)..(668): a, c, t, g, unknown or other
  misc_feature (668)..(668): n is a, c, g, or t
tcagtcgatcacgtcacgaccggtgctcgatttagctacgactgcaggggatcagacccagtcaggacacagcatggacatgagggtcctcgctcagctcgtgggctcctgctgctctcgttccaggtgacagatgtcgactatccgagactaccgacccgagttcctacccattccctctacttcgtctcgactatcggtaggtaacggagaccgaaggtaccttaccaaccgtacttaccggtacggtttcgggggaccgggaccgggtaccgtaaacggttacttaacccggtacgggttcgggtttaccggaccggttagggtaacttccgaacggttaccgaaaacgggaaaccggtaaccggggtaacccctccggttagtacccgtttaacccgttaatttccgttaggacgtaccgtacttaccgttacctaacggttaccggacgtaaccggttccgggtacctacgttacggtacggttacacggccgtaccgaggttcgaccggtagtacggacttagttcctacggtacctaccgtacaccgtanaccgaacctacgtacgacgtagtacgtacttcgtacgtacgttacctttaaagttcctaacgtactaacctaagtaactacgttaacctcggtttacccgaatcccggtanaccgtagccgaatccgtaagacgttaatacgacgttcgagcgtctacgtacacgttctactacgtctacctacccg

SEQ ID NO: 241734 - DNA, 680 bp, Homo sapiens
  misc_feature: GYAE6OF01AULU6.38.11.A11.1.454.CMB.1.raw
  modified_base (192)..(192): a, c, t, g, unknown or other
  misc_feature (192)..(192): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatcgacccagtcctccatcctcactgtctgctatcgtgtagganacagacgtccaccatctacgttcgggtccggggcgggctaacggttaacttaaccgtaccggttggttcggccgttaggtactacgagacaaacggaaaccgagggaaacctccccgtagttccgtacccttaattcgtttagactgctactcctacttacgactaacgtcggtacctagtcgtacgtcacgtcgcgtaggtcgacgtcggacggtaactagtactttccgactcgtaccaccgtactaccgtaacctaaccgtagaacgtacgtaagtaactacttacgtagtaacttaatttaacgtactacgtaacctaaactaacttaacgttaaccgtttaacccggttaccccgtacttaacccggtaccgaaccgtaacggacgtaaccggtagtaacggtaaacgtaaaccgttaacgtcgttaggtacggtcctacgaccctacgttacttccgttacttacttccgtccgttaccccg

SEQ ID NO: 241735 - DNA, 602 bp, Homo sapiens
  misc_feature: GYAE6OF01DM1Z3.38.11.A11.1.454.CMB.1.raw
  modified_base (288)..(288): a, c, t, g, unknown or other
  misc_feature (288)..(288): n is a, c, g, or t
  modified_base (386)..(386): a, c, t, g, unknown or other
  misc_feature (386)..(386): n is a, c, g, or t
  modified_base (436)..(436): a, c, t, g, unknown or other
  misc_feature (436)..(436): n is a, c, g, or t
tcagtcgatcacgtcacgaccggtgctcgatttagctacgactgcaggggatcagacccagtcaggacacagcatggacatgagggtcctcgctcagctcctgggctcctgctgctctgtttcccaggtgacagatgtgacatccagatgacccagtctccatcctcactgtctgcatctgtaggagacagagtcaaccatcacgttggtccggggcggggacacggttattaaccgaccgttgggttcggccttggtactcgagaccaagaaaccgacggggaaacncccctatcgtacccttaatcgtttgatcgactactcctactttagaccgtaaacggtcgggtacccagttcgtagttcagccgacgaggtcggatcgngggactagtacttcactcacacactacacaacgtgaacgtcgtagaagtnttctagtacttaatttactactacgaacctaactaataacttaaccttaccttacccggtccttaccgtaccggaccgaacgggtacaaccgtagtacggaacgtacgttaaacgacgtcggacggtcctacgcctacgtactacttcgtcttcgtcgttaccccg

SEQ ID NO: 241736 - DNA, 764 bp, Homo sapiens
  misc_feature: GYAE6OF01CANX7.38.11.A11.1.454.CMB.1.raw
  modified_base (199)..(199): a, c, t, g, unknown or other
  misc_feature (199)..(199): n is a, c, g, or t
  modified_base (250)..(250): a, c, t, g, unknown or other
  misc_feature (250)..(250): n is a, c, g, or t
tcagtcgatcacgtcacgaccggtgctcgatttagctacgactgcagggggatcagacccagtcaggacaccagccatggacatgtaggtcttcgctcagctcctgggctcctgctgctctgtttcccaggtgtacagatgtgactatctagattcgaccctagtcctccattcctcactgtctgcagtctggtagganacagacgtcaccagttccacgttcggtcggggacggtcacggttataaccncgtggttcggcctggtactcacgacaacgtaaacgacggaacgacccctagtacgtcctaattcgtttcgaatcgtactaccgtaccgtaacgtttgaccgtaaacggtcgggtaccctagttacgtaacggttacacgtaccgtaccgtagttcggattaccggtagggaaactacggttactttaccgtaccgttacgtaaccgtaaccgtaacggttacccgtaaccgtaaaccgtcggtaaaccgtaccgttaagaaacggttcttaaccgtaagtaaacttttaacgtttaacttaccggttacaaacccttaaactaacgttaaattaaccgttaacccggtttacccggtaaccttaacccgggttaacccggtaacccgtaaacggtacccgtaacggtacgttacgggaaaattaaccggttaaaacggtacggttaccggacggtaaccgtacgtaccctaacgttagtttcccgttaggttctttaccgaccttttaccccgg

SEQ ID NO: 241737 - DNA, 824 bp, Homo sapiens
  misc_feature: GYAE6OF01C8M5N.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgttcccaggtgacagatgtgacatccagatgacccagtctccatcctcacttgtctgcatcgtgaggagacagatcaccatcacgtgtcgggcgggcaggtataacgcgtggtgctggatcgagacaagaaaccgaggaacgccctatcgtacctaattcttagatcgactacgtcttacgtttcgaacgtaacggttcgggtaaccctagttaccgtaacggttcaacggtccgtaccgtaacgggttcggtaacgttcccgggtaagggaaccgttaaggttaaccttttacccgtaaccctttaccgtacccgttaacccgtaccgtttaacccggaaacccttaaacccggtaacggtaaaccggttaccccgttaaacgtaacggttaaccgtttaccttaacgggtttaaaccttttaaacgtttttaaaccgtttaaccttaaccgtaaaacccttaaaaacttaaacttttaaaccgttaaaacccttttaaccccggtttacccccggttaaacccgttaccccgtttaacccgggtaaacccggtaaaccgggtaccggtaaaccggtaacggttaaaccggtaaacggtttaaacgttaaaaaccgtacggttacggacgttaccggtaccgtaaccttaacccgttaacgttacgttaccggttttaaccttccgttaccctttaacccccgg

SEQ ID NO: 241738 - DNA, 696 bp, Homo sapiens
  misc_feature: GYAE6OF01DEGDL.38.11.A11.1.454.CMB.1.raw
  modified_base (675)..(675): a, c, t, g, unknown or other
  misc_feature (675)..(675): n is a, c, g, or t
tcagtcgatcacgtcacgaccggtgctcgatttagctacgactgcaggggatcagacccagtcaggacacagcatggacatgagggtcctcgctcagctccgtgggcctcctgctgctctgtttcccaggtgacagatgtgacatccagatcgacccagtcctccatcctcacttgtctgcatctgtaggagacaggactcaaccatcacgttggtgggcgggacacggtattacgacgttggttcgcctggtatcagcaagaaccgaggaactcccctatcgtaccctaatcgttagactcgactacgttacctactttacgacgtaaaacgttccggggtaacccctagtccgttaaggttccacggtccaccgtaggtcggtaatccgtaggaactaggttactttccacttcctaacacctaacgtccgaaccgtaaccgttaggaaccgtaccctaggtaaacgttactttccgtagtaactttaaacgttttaactaccgttacgtaaacctaaacctaaagtttaacttaaacccgtttaacccgtttaaccccgggtaccttacccgttaccggaaccgtaaacgggtacaaccggtaacttagggaaaccgtaagttaaaacccggtaacgtaggtaccggcttacggacaaccgtattacccgtnttacccgtactccgttacccc

SEQ ID NO: 241739 - DNA, 764 bp, Homo sapiens
  misc_feature: GYAE6OF01B9TTF.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatcgacccagtctccatcctcactgtctgctatcgtaggtaggacgacagacgtccacctatcctacgttcgggtcggggacggggactaacggttacttaaccgaccgttgggttcggccgtggtactcgacgacaacggaaaccgacgggaacctccccttaagtccgttacccttagttcgtttagacgtacgacctacgttacctaaccgttttacggaaccgtaaaccgggttccggggtacccctaacgttccggttaacggttaccgaacggtccgtaccggtagggttaccggtacgttaccggtacgggtaactaacgtttaccgtttacacccgttacctacccgtaaccgtaccgtaacccgtaaacccgtaaccgttacgtaaaccgtaccgtaacggtaacgttccttacgtacgtaacctttaaatttaccgttacgtaaccgtaacctaaagtaactttaacgttaaccgttaacccggttaccccgtacgtaacccggtaccggaacgtaacggacctaacggacgttaaggaacgttaaacgtaacgtacggtgacggtctacgacctacgtactcgttactccgttatccgttacccg

SEQ ID NO: 241740 - DNA, 810 bp, Homo sapiens
  misc_feature: GYAE6OF01AE5SB.38.11.A11.1.454.CMB.1.raw
  modified_base (620)..(620): a, c, t, g, unknown or other
  misc_feature (620)..(620): n is a, c, g, or t
  modified_base (790)..(790): a, c, t, g, unknown or other
  misc_feature (790)..(790): n is a, c, g, or t
tcagtcgatcacgtcacgaccggtgctcgatttagctacgactgcaggggatcagacccagtcaggacacagcatggacatgagggtcctcgctcagctccgtgggcctcctgctgccttcttcgttcccgaggtcgacagatgtacgactactccagactcgaccctagtcctccactccctcacgttgtctgactagtcgtaggtaaggaacgagaaggtactaccaactacttaccgtacggttccggggccgggggtaccgggtaccgtaaacggtttaaccttaaccggtaccgggtttgggttaccggtaccgttaggtaccaccgaacggaacccggaaaaccggaaaacccggaacgggtaaaccccgttcccttacgttaccccgttaacctttaacgtttcgttagacgttacgtacccttaacgttacccgtttaaccgttacggtaaccggtaaccggggttccggtacccttaacgttaccggttaccggtaccgaccggtaccggtaccgtaggttacggttacgtaccgggtaagtacttaacgttaccttacctacccgtccacctaccgtaccgtaccaaccacgtacgactacgagtacttntacgtacttaagttaacttcctaacgtaacaacttaagttaacttaaccgttaaccgttaccccgtacgtaccttaccggaccgtaaacgtacggtaccaggtaacgtagtaacccgtaaacggtacgtcggttacacggtccaaccgtaccgtattccgttcgttaacnccctttcgtacccttacccg

SEQ ID NO: 241741 - DNA, 650 bp, Homo sapiens
  misc_feature: GYAE6OF01A1NF6.38.11.A11.1.454.CMB.1.raw
  modified_base (180)..(180): a, c, t, g, unknown or other
  misc_feature (180)..(180): n is a, c, g, or t
  modified_base (382)..(382): a, c, t, g, unknown or other
  misc_feature (382)..(382): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatcgacccagtcctccatcctcactgtctgcntctgtaggagacgagacgtcacctatctacgttgggtccggggcggggcaacggttacttaacgaccgttgggttcggcctggtactcgagacaacggaaccgaagggaaacctcccctatcgttaaccccgtaattcctttgactcgcctactcctacttagactaacggtcgggtccagttcgtacggttcagccgtacnggtggtactcggtaggaactagttactttacgtacctctaccaacctacgtaccaactaaccacggaacgtacctaagtacgtacttctagtaacttactttaagtactacgtaaccaataacttaattaaccgttaacccttacccggttaacctacccgttaccggaaccggtaacggacctaacggacgtaagaacgtaacgtaaacgtacgtacgtacggacgtacgaccctaacgtcttacttactccttacgtacttccccg

SEQ ID NO: 241742 - DNA, 1053 bp, Homo sapiens
  misc_feature: GYAE6OF01EG3EJ.38.11.A11.1.454.CMB.1.raw
tcagtcgatcacgtcacgaccggtgctcgatttagctacgactgcaggggatcagacccagtcaggacacagcatggacatgagggtcctcgctcagctccgtggggctcctgctgctctcgtttcccaggtgacagatgtgacatccagatcgacccagtcctccatcctcactgtcctgctatcgtaggtaggacgacagacgtaccacctattacctacggtttcgggtccggggggccggggtaccgtaaaccgggtttaacttaaacccggtccgttcggggttcggtcccggttaggttacgtaccgaacggaaccgaaaccgggaaaacccggaaaccggggtaaaacccgtacccccttaacgtttacccggtttaaccccctttaaagtttccgtttaacggtacgttacggacccttaacccgttacccgtttaaccgttttaccgaaacccggttaaacccgggtttacccgggggtaccccttacgttacccggtttaacggttacccgaaccggaccccggtacccggtaggggttacgggttaacccggttacggggttaacggggtaaccgttaaccggtttaaccttttaacccgaaccctttacccgttaccgtaaaccccggttaataaccccggtaaacccgttaaacccggttaacgaaaccgggttaccctaaagggtaacccgtttagtttacccggttaattaaacccggttttaaattttaaccgtttaaccccgttaaccggtaaacccttaaaacgttaaacgtttaaaccctttaaacccggtttaaacccccggttttaacccccgttaacccggttaaccccgggtttaaccccgggaaaccggtaaacccggggtacccctaaaccggggttaacggtaaccgggttaaaacgttaaaaacccggtttaaaccggtaaccgggtttacgggttaaccgtacccggtttaaacgaccccttaaacccgttacgtttaccccggttaccttttaaccctcccccgttaaccgttaaccccccggg

SEQ ID NO: 241743 - DNA, 733 bp, Homo sapiens
  misc_feature: GYAE6OF01AX2F5.38.11.A11.1.454.CMB.1.raw
  modified_base (189)..(189): a, c, t, g, unknown or other
  misc_feature (189)..(189): n is a, c, g, or t
  modified_base (275)..(275): a, c, t, g, unknown or other
  misc_feature (275)..(275): n is a, c, g, or t
  modified_base (410)..(410): a, c, t, g, unknown or other
  misc_feature (410)..(410): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtcctccatcctcactgtctgcatctgtagganacagactcaccatctacgttggtcgggcgggctacggtattaaccgacgtggttcggcctggtatcgagcaacgaaccgaggaacncccctatcgtacctaatcttgatgcactcctactttacgacctaaacgtcgggtacccctagttccgttacggttccaaggcccgtaccgaggtcggacttcggtacggggaactagtactttaccaccttaccnccaacctaccgtaccgaacctaaccgtagaaccgtacccgtaaggtaacgtactttaccgtacgtaacctttaagtttaaccttaccgtaaccgtaaccctaaacgtaaacctttaacttaaacccgtttaacccgtttaacccccggtacccttaaccccggtttaccggaacccggtaaaccgggtaccgtaaccggtaaccggtaaggtaaaccgtaaaaccgtttaaaaccggaaccgttacggtaaccggtccttaccgacccgtaaacccgttacgttacccgttacgtttccttacccgttaccgtttaccccccg

SEQ ID NO: 241744 - DNA, 924 bp, Homo sapiens
  misc_feature: GYAE6OF01A0O0V.38.11.A11.1.454.CMB.1.raw
tcagtcgatcacgtcacgaccggtgctcgatttagctacgactgcaggggatcagacccagtcaggacacagcatggacatgagggtcctcgctcagctcctgggctcctgctgcctctgtttcccaggtgacagatgtgactatccagatgacccagtctccatcctcactgtctgcatcgtggtaggagacaggacgtccaccgtatccgtaacgttcgggtcggggaccggggacctaaccgggttaacttaaaccgtacccgttgggttccggcccgttagggtactccgtaacggtacgtaaacggtaaaacccggtaaggggtaaaccgtccccccgttaagttaccggttacccccgtttaaaagttccgttttaggaacttacgtacccgtaacgtttcccgtaacgttttacggaaccgttaaaccgggttccggggtacccctaagttaccggttacggttaccgacggtaccggtaccgtaaggtacggtaacgttccggtaggggtaacctagttaaccgttttacccgaaccgttacccgtacctaacccgtacgtaacccggaaaccctaaccgttaacggtaaccgtaccccgtaaggtaaacgttaactttaccgtagttaaccgtttaaatttttaaccgtacccgttaaccggtaaaccctaaactaaaactttaaaccgtttaaacccgtttaaccccgtttaaccccgggtaacccgttaaccccggttaacccgggtaaccggtaaaccggggtaaccctaaaccggttaaccggtaacgggtaaaccgttaaaaccgggttaaaccgtaccgggttacggtaccggtaccgtacccgtacccgttaaccgtaaccgtttacccgtttacgtttaccctttacccgttaccgtttacccccgg

SEQ ID NO: 241745 - DNA, 829 bp, Homo sapiens
  misc_feature: GYAE6OF01BJJ2G.38.11.A11.1.454.CMB.1.raw
tcagtcgatcacgtcacgaccggtgctcgatttagctacgactgcagggatcagacccagtcaggacacagcatggacatgagggtcctcgctcagctcctggggctcctgctgctctgtttcccaggtgacagatgtgacatccagatcgacccagtcctccactcctcacgttgtctgcattctaggtaaggagacaggacgttccaacctactaccgtacgttcggggtccggggcggggaccgtaccggtaactttaaccgaccggttgggttccggccgttagggttactcgaacgtaccgaaacggtaaaacccgaaggggaaacccttccccttaagttacccggttaaccccttaagtttccgtttagacttcgacctaccgtcgtttaaccttagaacccgttaaccggtccgggttacccctagttaccgtacggttaccgaccgtaccgtaccgtagggttacgtacggttacggtacgggaaccgttaaggtttacctttaccgtaaccttcccgtacctaaccgtaccgttaacccgtaaccctaaccggtaacggtaaccgtacccgttaacggtaacgtttactttaccgtaacgttaaccttaacgttttaacgtacccgtaacgtaacccctaaattaaactttaaccgttaaccgttaaccccgtttacccggtacccttaacccggttacgggtaacccgtacgggtaacctaacgggtacgttaggtaaacgttaaaccggttaacgtacggttgaccggtacgacgtacccgacgttactacgtacgttcctaccgtcgttacccccg

SEQ ID NO: 241746 - DNA, 927 bp, Homo sapiens
  misc_feature: GYAE6OF01EPFRG.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatcgacccagtcctccactccctcacgttcgtctgacctatcgtaggtaaggaacgacgaggacgtaccaacctactcctacggtttcggggtccgggggccgggggtaccgttaacgggttaactttaaacccgtacccggtttcggggtttacgggtcccgtttagggttaacgtaccgaacggaaccgaaaaccggaaaaacccgggaaacgggggtaaaacccgtccccccgtttaaagtttacccggtttaacccctttaaagtttccgttttaggacgttcgtacctaacttacccttaacgtttacgaaccgttaaaccgggtccgggttaccctagttacgttacggttaccgacggccgtaccgtaggttcggtacgttcggtaggggtaacctaacgttactttaccaaccgtttcctaaccctaaccgtaacgtaacccgtaaccgtaaaccgtacggaaaccgtaccgtaaaggtaaacttacgttaccgttaaggttaaccttttaaagtttaacctttaaccgtaaccgtaaacccttaaaaccgttaaatttaaactttaaaccccgtttaaccccgtttaacccccgggttaacccgtaaccccgggtttaaccggaacccggtaaaccgggtaaccctaaccgggtaacggttaaccgggaaacgttaaaaccgttaaaccggtaacggttacggtacggtcctaacgtacccttaaacgtcctttacgttccttaaccgtttccgtaccctttacccccgg

SEQ ID NO: 241747 - DNA, 873 bp, Homo sapiens
  misc_feature: GYAE6OF01DFIHJ.38.11.A11.1.454.CMB.1.raw
tcagtcgatcacgtcacgaccggtgctcgatttagctacgactgcaggggatcagacccagtcaggacacagcatggacatgagggtcctcgctcagctcctgggctcctgctgctctgtttcccagggtgacagatgtgacatccagatgacccagtctccatcctcactgtctgcatctgtaggagacagacgtcacctatccacgttggtccgggcggggctaaacgggttattaaccgaccgttgggttcggtacccgtttgggaaactttccgaacgggtccaaaacgggaaaaaacccgaagggggggtaaaaacccgtcccccccttaagttccggtttaaccccccttttaaaagttccgtttttacgggtaacttcggaccttaacccggtttacccttaaccgttttttcgggaaaccccgtaaaaaccgggtttcccggggggtaccccccttaaggtttacccggtttaacggggtttaccgaaaccgggcccggtaaccccggtaagggtttacgggtaacgtttcccgggttaagggggtaaccctagggtttaaacttttaccctaaccgtttccgtaccccgtaacccaacgtttacccggaaacccttaaaccccgttaggaaaccggttccctaaggtaaacgttacgtttacctacgggtactttaaacgtttttacctaacgttaccgtaacccaaagtaaacttaacgttaaacttacccgtttaccccgtaccttaccggttaccggacgtaacgggactaacggtaccgtaggtaacgtaaacgttaaccggtagttcggtacggtctacgtccacttcgtactcgtttacttcccgtaactttccccgg

SEQ ID NO: 241748 - DNA, 886 bp, Homo sapiens
  misc_feature: GYAE6OF01DQGKZ.38.11.A11.1.454.CMB.1.raw
tcagtcgatcacgtcacgaccggtgctcgatttagctacgactgcaggggatcagacccagtcaggacacagcatggacatgagggtcctcgctcagctccgtggggctcctgctgctctcgtttcccaggtgacagatgtgacatccgagatcgaccctagtcctccatccctcactgtctgctactcgtgtaggacgacgagtacgtaccacctatcctacgttgggtaccggggcgggacgtacggtacttaaccgaccgttggtacggccgtaggtactacgacgaccgaacgtaaaccggaagggaaccctccccttaagttacccgttaccttaacgttcgtttacgactcgtacctaccgttacccgttaacgtttacgaacccgttaaccgggttccgggttaaccctacgttacgtttaccgggtaccgtacggtacccggtaccggttaacggtacggtaccgttaccgggtacggggtaacgttaacgtttaccttttaccgaacccctttaccgtaccccaaacccggttaacgtaaccccggtaaaccctaaacccgttaacgggtaaaccctaccccggtttaaagggtaaccttaacgtttaccgttaaccgtaacgtttttaaactttaccgttaaccgtaccgtaaaaccctaaacgttaaactttaacgttaacccgtttaaccccggtttaccccgttacccgttaacccgggttaacggtaacccggtaaaccggtaaccggaaccgttaacgggtaacgggtaaaccttaaaaccggtaaacggtccggtaggttacccggtacaccggttaacccaaccgtttcttacccggtttacgttaccccttgtaccccctttccccgg

SEQ ID NO: 241749 - DNA, 676 bp, Homo sapiens
  misc_feature: GYAE6OF01DKKZK.38.11.A11.1.454.CMB.1.raw
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (666)..(666): a, c, t, g, unknown or other
  misc_feature (666)..(666): n is a, c, g, or t
tcagtcgatcacgtcacgaccggtgctcgatttagctacgactgcagggatcagacccagtcaggacacagcatggacatgagggtcctcgctcagcctccgtgggcctcctgctgcttctcgtttccccgaggtcgactagtatcgtacgactactccaggactccgaaccccagtcctccatcctactctgtctagcatcgtaggagggacaacgacgtacgtaccacctagtcctagttcggggtccggggcgggactaacggttataacccggtcgttggtcgtccgttggactacgaggaccgaaacggaaccgaacgggtaacctccccttaatccgtacctattcgtgatcgctactacctattcgaacgacggttccgacctgttacnggttaccnggccgacgaggttgactcgggacggtacactttcctaacgtcgtacctaacgacacctaccggaaccaacgtacgagtaacccttaggaacgttacgtcctataacgtttaaacttacttaccaaccgtaactaaactagttaactaccgtacccgttaccgtccgtaaacccgttgggaaccctaacggaccaacgtacggtaagaacttaacggtaaactcggtagtagcctaagtccacgttcgttacgtcttccggtntccttccccg

SEQ ID NO: 241750 - DNA, 607 bp, Homo sapiens
  misc_feature: GYAE6OF01EIQDO.38.11.A11.1.454.CMB.1.raw
  modified_base (601)..(601): a, c, t, g, unknown or other
  misc_feature (601)..(601): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtcctccatcctcactgtctgcatctgtaggagacagactcaaccatcacgttcggcgggcgggcaacggtacttaccgaccgtggttcggccgttggtactcgagacaacgaaaccgacgggaaactcccgtatcgtaccctaagttctttagacgtgctatcctacgtttcgactaaacgtcgggtacctacgttctaggttcgacgtcgacaggtggatcgtaggacagtctttcgacttcctacacctagtaccgtaacctaaccgtgaacgtcccgtaaggacttaacttccgtagtacgttaaattttacgtacgtcgtaacctaactaattaacgtaacttaacccgttaccggtactaccgttaccggacgtaacggacacgtagtaggactaagttaaccgacgtgtacgctacgacctacgtcttactctcttcngttccc

SEQ ID NO: 241751 - DNA, 806 bp, Homo sapiens
  misc_feature: GYAE6OF01EEFYF.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatcgaccctagtctccatccctcactgtctgctattcgtgtaggagacagagtccacactcacgttcgggtaccggggcgggacgttacggttaattaaccgaccggttgggttcgggtccgttagggtatacgaacgaccaacggaaaaccgaacgggaaccctccccctagttccgttacccttaagtttccgtttagtagtacgtacctacgttaccccttacgttttacgaaccgttaaaccgggttccgggtacccttacgttaccggttacggttccgacggacccgtacggtaggttacgggtacgttacgggtacgggtaactacggtttacctttccgtacctccctacccaacctaccgtaccggtaaccctaaccgtacggtaaaccgtacccgtaaaggaacggtttacttaccggttacttaaaccttttaacttttaaccgttacgtaaccggaaacccttaattaaatttaaaccgttaaaccgtttaacccggtttaccccgtaccttaacccggtacggtaacccggtaaacggaccgtaacggacgttaagggtaaacgtaaaaccgttacggtaacgttcgggtacgtccggtacacccgtacgtcgttactaccgtttccttaacgtccttaccccgg

SEQ ID NO: 241752 - DNA, 712 bp, Homo sapiens
  misc_feature: GYAE6OF01DMQUG.38.11.A11.1.454.CMB.1.raw
  modified_base (166)..(166): a, c, t, g, unknown or other
  misc_feature (166)..(166): n is a, c, g, or t
  modified_base (368)..(368): a, c, t, g, unknown or other
  misc_feature (368)..(368): n is a, c, g, or t
  modified_base (540)..(540): a, c, t, g, unknown or other
  misc_feature (540)..(540): n is a, c, g, or t
tcagtcgatcacgtcacgaccggtgctcgatttagctacgactgcaggggatcagacccagtcaggacacagcatggacatggagggtcctcgctcagctccgtggggctcctgctgctcttgtttccgaggtgacagatgtagacatccagatcgacctagtccncactcctctactgtcctagctatcgtaggtaggactacgagtacgtcaacctattaccgtacggttgggtccggggacgggtacgaacggttaacttaaccgccggtttgggtaccggtaccgttaggttacaccggaagaccggaaacgaaaaccgggtaggaaccctccctagttaaccgttacccttaatccggtttanacgtctacctaacgttccccgttaattacggaaccgttaaccgggttccgggtacctaagttcggttaacggacgacggtccggactaagggtcgtaacgtacgggtggtaaactgtactttccaacgttcccacgaactacgacaacctaacgtgaactcgtagtaacgtnttactaacgtactttaagttaccataccaacgaaactaacttataaccctaaccgttaccgtacgtaccgtacgagtaacggacacggtaatacgggaacttaacgaacgtccggtagtaccggtcaacgtaccttactagttaacctggtttaccctctacgttaccccgg

SEQ ID NO: 241753 - DNA, 794 bp, Homo sapiens
  misc_feature: GYAE6OF01DPUT0.38.11.A11.1.454.CMB.1.raw
tcagtcgatcacgtcacgaccggtgctcgatttagctacgactgcaggggatcagacccagtcaggacacagcatggacatggagggtcctcgctcagctccgtggggcctcctgctgctctcgtttcccaggtgacagatgtgacatccagatcgacccagtcctccatccctcactgtctgctattcgtaggtaggagacaggacgtccaaccatcctacgttgggtccggggccggggtctaacgggttacttaaccgaccgttgggttcggccttaggtatccgagtacaacggaaaccgtaacgggaaacctccccttagtccgttacccttaagttcgtttagatcgacctacttcctaacgtttcgaacctaacgggttccgggtacctacgttacgttacggtcgaacgtccgacgtaggtcggtacttcggacgggtaactaggttacctttacgaccttctaaccgtaacctacgtacccgtaacctaaccgtagaaacccgtccgttaaggaacttacttacgtacgtaactttaaacgttttactaaccgtaacgtaaccctaaattaacttaaaccgttaaccgtttaaccccggttaaccccggttacctaaccccggtttaccgggaacccgtaaacggggtaccaaaccggggttaccgtaacgggaaaaccggttaaaccgttaaacggtaaccgttcggttaccggtacccgttacgtaacccttaacccggttacgtttcgtacccgttttactacccgttcccgtttacccccg

SEQ ID NO: 241754 - DNA, 805 bp, Homo sapiens
  misc_feature: GYAE6OF01DHFXO.38.11.A11.1.454.CMB.1.raw
  modified_base (133)..(133): a, c, t, g, unknown or other
  misc_feature (133)..(133): n is a, c, g, or t
  modified_base (757)..(757): a, c, t, g, unknown or other
  misc_feature (757)..(757): n is a, c, g, or t
tcagtcgatcacgtcacgaccggtgctcgatttagctacgactgcaggggatcagacccagtcaggacacagcatggacatgagggtcctcgctcagctccgtggggctcctgctgctctcgtttcccaggtnacagatgtgacatccagactcgacccagtcctccatccctcacttgtctgctatccgtaggtaggacgacaggagtcacccattccacgtttgggccggggcgggtactaacggttattaaccgccgttgggttcggtaccgttgggtaactaccgacggaaccgaaaccggaaaaccggaacggggtaaaccgtccccccttagttacccgttacccctttaattccgtttgtaacgttcggaccctacctttacccgtaacgttttaccggaaccgtaaaccgggttccggggtacccctagttaccgtttaacgggttccgaccggtccgtaccggtaggttacgtacggttaccgggtacggtaactaggttaccttttacccgaacccttttacctacccgtaacccaacgtttaacccaacccgtaaaccgtacggtaaacgttacccgagtaaacgttaccttaccgttactactttaaattttacctaacgtccgtaaacctaaacttaactttaacgtaaccgtttaaccgttaccccgttactaaccgggttccgaaccgtaacgggactaaccgtaccgggtaagtaaacgttaacgtaaccgtagttacggngtaccgtaccacgtactactttcgtcgtttactcgttaccttaccccg

SEQ ID NO: 241755 - DNA, 836 bp, Homo sapiens
  misc_feature: GYAE6OF01C9TKG.38.11.A11.1.454.CMB.1.raw
tcagtcgatcacgtcacgaccggtgctcgatttagctacgactgcaggggatcagacccagtcaggacacagcatggacatgagggtcctcgctcagctccgtgggctcctgctgctctgtttcccaggtgacagatgtgacactccagatcgacccagtcctccatcctcacttgtcctgctatcgtaggtacggacgacaggacgttaccaacctattccgtacggtttcggggtaccgggggaccgggggtaccgtaaaccggtttaacgtttaacccgaccggttttcggggtttccgggtaccgttaacgggttacctaccggaaaccggaacccgtaaaaaccgggaaaacccggtaaaccgggggtaaaaccccttccccccgttagttaccccggtttaaccccttttaaacgtttcgtttacgtacgttacgtaccttaccttaccgttacgtttaccgaccgtaaccggttccggtaccctagttacggttacgtacgacgtccgacgtacggtacggtacgtacggtacggtaactacgttacttacctacgtcctaacccgtaactaccgtacccgtaaacctaaccgtagtaaccgtcgtacgtaaacttcttaccttacgttaactttaagtttacctaccgtaacctaactaactttaataaccgttaaccgtttaaccccgttacccgtccgttaacccggtacgaaccggtacggactacgtacggtaacggtaaacttaaacgttaacggtcgttaggaccggtctaacccggtacaaccgtttctacggttacttttcccacgttcccgttaccccg

SEQ ID NO: 241756 - DNA, 836 bp, Homo sapiens
  misc_feature: GYAE6OF01BF5J3.38.11.A11.1.454.CMB.1.raw
tcagtcgatcacgtcacgaccggtgctcgatttagctacgactgcaggggatcagacccagtcaggacacagcatggacatgagggtcctcgctcagctcctgggctcctgctgctctgtttcccaggtgacagatgtgacactccagatcgacccagtctccatccctcactcgtctgctatctggtacggagacagacgtaccaccatcgtacgttcggtccggggcgggtactacggttacttaaccgccgttgggttacggccgttaggtatcgagaacgaacggaaacccgaagggaaacgtcccctaatccggttacccttaagttcttacgatacgctaactcctactttacgaccgttaacggtcccgggtacctacgttacgttacggttaccacgaccggacgtaggtaggtaccgttgggtaggtaacttacgtacttttacccgacccgttaccttaccgaccttaaccgtacccgtaacctacggttaacgaaacccgttaccggtaagttaacgtactttaccgtacggtttaaacctttaccttttaaacgttacctaacccgtaaaccgtaaacctttaaaacctttaaccgtttaaaccccgttttaaccccgttttaacccccgggtaccttaaacccccggggtttagggaacccccggtaaaagggaccccgttaaccggtaacggttaaaccgggttaaccgttaaaaccgtttaaaccgtaacccgggttttacgggaccggtttccgaacgttaccccttaaaccgtcttacccgttttacgtcccccgttatttaacccccggttacccccg

SEQ ID NO: 241757 - DNA, 791 bp, Homo sapiens
  misc_feature: GYAE6OF01CMBHA.38.11.A11.1.454.CMB.1.raw
  modified_base (265)..(265): a, c, t, g, unknown or other
  misc_feature (265)..(265): n is a, c, g, or t
  modified_base (373)..(373): a, c, t, g, unknown or other
  misc_feature (373)..(373): n is a, c, g, or t
  modified_base (587)..(587): a, c, t, g, unknown or other
  misc_feature (587)..(587): n is a, c, g, or t
  modified_base (738)..(738): a, c, t, g, unknown or other
  misc_feature (738)..(738): n is a, c, g, or t
tcagtcgatcacgtcacgaccggtgctcgatttagctacgactgcgaggggatcagacccagtcaggacacagcagtggacatggacgggtcccctcgctcacgtccctcgggtcgggtccttccgtcgcgttcgtcctttggttcccgttaccccggaagggtcaaccgtaaggttgttcggacgaaccttactaccgaaggtctaccggaaccccttactttccccaaccctacttcccggtacttaccgtcgtccttacggntacgttcgagggacgacgtacgacgtaccgtccaccgtacgtccgtaaggttccgggcgggttaccgtagtacccggttagttaccggagtttggtactcgtaggtanaccgacgaacgaacgtaaccggtagtaaccgtcctacgtaccgtactacttcgtacgattccgactaacgtcctacggttaactaccggtaacgtccgcgttaagtcggtacctaggcgtacgtacgttaggaccgtacgttcgaacgtccgttatacgtctacactcccgtagcccgttagacctacgacgtaacgtgttaacgtactacttnaacttaacgttacgaacttacgacgtaaacttaataacgttacgttaaccgttaacccgtacgtaacccgtaccgtaaccgtaaggtacgaaaccgttaccggtaagtaaacgtaaccgtaagtacccgggtgtaaccgtcttaacccggnttaacccgtcgttttaacgaccctttggtaaccctttccgaacccggtttacc

SEQ ID NO: 241758 - DNA, 763 bp, Homo sapiens
  misc_feature: GYAE6OF01ADHXC.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtcgacagatgtgacatccagatcgacccagtctccatcctcactgtctgcatctggtaggagacagacgtccaccatcgtacgttgggtcggggccggggacgtaacggttattaaccgaccggttgggttacggccgttggtactcgaggaccgaacgaaaccggacgggaaaccgtcccctattcgttaccccttaattcgtttagatcgacctacgttcctacgttcgaaccgtaaacggttccgggtacccagttcgttaggtcagaccgtcgaggttcgacgtcggtacgggaactaggttactttaccgaccttcctacctaacccgtacgtaacccgaaccgttaaccgtacgtaaccggtaccgttaaggaacggtttacctttacggtaaccgttaactttaaacctttacgttaaaccgtaaccgtaaacctaaacctttaaacttaacgtttaaacccgtttaaccccgtttaaccccgggttaccccttaaccggttaacccggaacggaaccgggtaaccgtaacccggtaacggttacggaaaccttaaacgttaaaaccggacggttgtaccggtctacgtacctacgttactcgttacgtccttacgtcgttaccccg

SEQ ID NO: 241759 - DNA, 792 bp, Homo sapiens
  misc_feature: GYAE6OF01BI0XQ.38.11.A11.1.454.CMB.1.raw
  modified_base (760)..(760): a, c, t, g, unknown or other
  misc_feature (760)..(760): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgaccccagtcctccatccctcacttgtctgctatcgtagggtagagaccaggtactaccacctatccgtacggttcgggtccgggggcgggtacctaacgggttaacttaaccgaccggttgggttcgtccgttaggtactccgagaactaaacggaaaccggaacgggtaaaaccgtccccttaacgttacccgttaacccgtttaacgtttcgtttacggattccgacccttacgttacccctttaacgttttacggaacccgttaaccgggtaccgggtaacccccttaaggttaccgttaacggggttaccaccggtacccgtaccggttaggtaggtaccgttcggtacgggtaacctaaggtttaccttacgtaccctacgttaacccacccgtacgttaacccgaaaccttacggaccgtaacgtaccgtaaggtaacttcttacgttacgttaattacttttaacgtacaccttaaactaaataaccgtttaacgttaacccgttacccttaacccggtccttacccgtaaaccgggacccaaaggttaccctacggtaagtaaccggtaataaacccgttaagccggtagtacggctaacncaacgttctactcgttacctcgtccttccccg

SEQ ID NO: 241760 - DNA, 888 bp, Homo sapiens
  misc_feature: GYAE6OF01CCI1D.38.11.A11.1.454.CMB.1.raw
tcagtcgatcacgtcacgaccggtgctcgatttagctacgactgcaggggatcagacccagtcaggacacagcatggacatgagggtcctcgctcagctccgtgggctcctgctgctctcgtttcccgaggtgacagatgtgactactccgagtatcgaccctagttcctaccacttccctacgtacgttcgttccgtaggacctagttaccgttagggtaacggaacgaaccgtaacggtaaccgttaccctaaccgtacgttaccgttaacgggtttccgggggtaccggggggaccggggtaaccgttaaaccgggttaacctttaaacccggtccgggtttggggttacggttcccggtttaaggtaaccgtccggaaacgaaccggaaaaaccggtaaaacccggaaacggggttaaacccctcccgtttaaggttaccccgtttaaccgtttaagtttccggtttacgaacgttaccgacctttaaccttacccggttttacgttacggaaaccggttaccgggttcgtaccttaacggtcgtacgtcgacgtccgacgtaggtcaggtccgaggtactagttaccttcgacttaccgaccgtaacctaccgtaccgtaaacctaccgtaacggtacgtaacgtaagtacttcgttactaactttaagtttaacgtttaacccgacgttaacctaaactaaattaaccgttaacgtttaccccgttaaccgttccggtaaacccgtcggtaaaccccggaagtaaccggtacaacggggttaccgaaaagttaaccgtaacggttaccggtaacggtttcgaccggacttaccctacgttacccgttattcccgttaagttcccttgttcccccgttacccg

SEQ ID NO: 241761 - DNA, 831 bp, Homo sapiens
  misc_feature: GYAE6OF01C8T5R.38.11.A11.1.454.CMB.1.raw
  modified_base (814)..(814): a, c, t, g, unknown or other
  misc_feature (814)..(814): n is a, c, g, or t
tcagtcgatcacgtcacgaccggtgctcgatttagctacgactgcaggggatcagacccagtcaggacacagcatggacatgagggtcctcgctcagctccgtgggctcctgctgctcttcgtttacccgaggtgaacagatgtacgactacgtaccagactcgacccagttcctccactcctacgtacttcgtcgtcgctattcgtaggagacgaacgacgtaccgtaccaacctagtccgtacggttcggggaccgggggccgggtaccgtaacggttacttaaccgtcggtttgggttccgtaccgttaggtactcgaacggaccgaaaaccggaaaccggtacggtaaccctaccccttaggttacccgtttaaccctttaattttcgttacgacgttaccgaccttacccgtttaccgtttacgttaaccggaaccggttaaccgggttcccggtaaccttagttacggttaaccggttccgaaccgggcccttaaacggggtaggtttaccggtaacgttaacgggtacggtaaacttacgttttaacctttaccccgacccttttaacgcccgtaaaccgtaaccgtaaccctaaacgtaaccgttacggaaccttaccggttaagtaacgttcttaccgtacgttaactttaaccgtttacgacctaaccgtaaactaaacttaacgttaaccttaacccgttaacccgttaccccgtagtacccggtaacggacgtaacggtacctacggtacgtaggaaacgttacgtaagtcggtagtcgactacgtactacggtcttaactnttaccgctcccggtacc

SEQ ID NO: 241762 - DNA, 612 bp, Homo sapiens
  misc_feature: GYAE6OF02ICMMP.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggcacggtattaacacctggttcggcctggtatcagcagaaaccgagggaaacgcccctatcgtaccctaatctttgatgcatcctactttgactaaacgtcgggtcccatctaggtcagcgcagtgatcgtggacagtattcactctcacctatcgacaacctgaacgcctagaagtacttctacgtacttaaattttacttacttacgaccaaactaaattaacttaacttaaccgtttaccccggtacctaacccgtttaccgggacctaaacggggtaaccaaccggtaaccgtagggtaacgtaacgtttaaaccggtaaacgttacggttacgggaccgttacgaccctaaccgtacttaccttacggttacctttaccgtactttaccccg

SEQ ID NO: 241763 - DNA, 578 bp, Homo sapiens
  misc_feature: GYAE6OF02I6NKR.38.11.A11.1.454.CMB.1.raw
  modified_base (132)..(132): a, c, t, g, unknown or other
  misc_feature (132)..(132): n is a, c, g, or t
  modified_base (167)..(167): a, c, t, g, unknown or other
  misc_feature (167)..(167): n is a, c, g, or t
  modified_base (189)..(189): a, c, t, g, unknown or other
  misc_feature (189)..(189): n is a, c, g, or t
  modified_base (229)..(229): a, c, t, g, unknown or other
  misc_feature (229)..(229): n is a, c, g, or t
  modified_base (330)..(330): a, c, t, g, unknown or other
  misc_feature (330)..(330): n is a, c, g, or t
  modified_base (438)..(438): a, c, t, g, unknown or other
  misc_feature (438)..(438): n is a, c, g, or t
tcagtcgatcacgtcacgaccggtgctcgatttagctacgactgcagggatcagacccagtcaggacacagcatggacatgagggtcctcgctcagctcctgggctcctgctgctctgtttcccaggtgacngatgtgacatccagatgacccagtctccatccctnacgtgtctgcaatctgtagganacagagtcaccatccattgcgggcgggcaggtattaaccncctggttggcctggtatcagcagaacccagggaagcccctatcgtaccctaatctttgattgcatccactttgctaacgtgggtcccatctaggttcagcnccagtgatctgggacagtactttcactcctcacctgtaccgacaaacccgttgaacgtccctagaaacgtatttcctagaccttaaattttacttactcgacctaaanaattaataactaccttacccggttcacgtttaccgcctaaagggaccacggtacttgggaactaacgtttaaacggaacttaggtcgggtactacgacccgtacgaacttccgttaggtaccctttagaacctttcccgg

SEQ ID NO: 241764 - DNA, 513 bp, Homo sapiens
  misc_feature: GYAE6OF02JGINP.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcggggcacggtattaacacctggttggcctggtatcagcagaaaccagggaaagcccctatgtccctaatctttgatgcatccactttgcaaactggggtcccatctaggttcagcgccagtggatcgtgggacagtatttcactctcaccatcgacaacctgaagcctgaagtattctgactaattttattactgaccaacaattataaattaccttaacccggtctaaccttcggaccaaagggaccaacgactggagtaataacgaactgtaggctgcaccatctgtcttcattcccg

SEQ ID NO: 241765 - DNA, 702 bp, Homo sapiens
  misc_feature: GYAE6OF02I3ROT.38.11.A11.1.454.CMB.1.raw
  modified_base (193)..(193): a, c, t, g, unknown or other
  misc_feature (193)..(193): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacaggatgtgacatccagatcgacccagtcctccactcctcactgtctgcatctggtagganacagacgtaccaccatctacgttcggtccggggccgggacgtacggttaacttaacctaccgttggttcggccgtaggtactcgagacaacgaaaccgaagggaaaccgtccctagtccgtaccctaattcttagatcgctactccttactttcgactaaacggttcgggtaccctattcgttacggttacacggccgaccgtaggtggtacttcggtacgggaactaagttactttaccgtaccttccgtacccaacctacgtacccgaacctaaccgtaggaaccgtccgtaagaacgttacttcgtacgtaacttaaattttacttacgtacgaacctaaactaagttaacttaaaccttaacccgtttacccgtacctacccggttaccgaaccgtaaacggaccaacgtaacgtacggaagtaaaccgttaaacgtaacgttacggtacggtacttacggacctacctacgttcctacggtttaccttacctacctttaccccg

SEQ ID NO: 241766 - DNA, 768 bp, Homo sapiens
  misc_feature: GYAE6OF02JKY7O.38.11.A11.1.454.CMB.1.raw
  modified_base (756)..(756): a, c, t, g, unknown or other
  misc_feature (756)..(756): n is a, c, g, or t
tcagtcgatcacgtcacgaccggtgctcgatttagctacgactgcagggagtcagaccagtcaggacacagcatggacatgagggtctcgctcagctcctgggctcctgctgctctgtttccaggtcgacagatgtgacatccagatgaccagtctccatcctcacgtgtctgacatctgtagacgacagagttcaccatccaacttgtcgggccggggcacggtattaaccacctggttggacctggtactcgagcagaaaccagggaaaacgccccgtatacgtaccctaattcgtttacgaacttggacactaccgtacttttacgccgtaaaaccgttcgggggtacccctaagttccgtaagggtttacccaaggtaccggttacccaggtttacgggtaacttcccggttagggggtaaaccctaagggtaacttttttccggaaaccctttacgtttacccgtaaaccgtacgtttaacccgaaacccgtaaaccgttacgtaaaccgggacccttacggtaaacggtactttacccgttacgtaccgttaaacgtttttaacctttaacgtaccgaaccgttaaactaaacgttaacttaaacgtttacctttaaccccgggttacttaacccgttacggtaacctaaacgggtaaccaacgtacgttacggagttaaccttaaacggtaaccttaggtacggtaaccgtcggttaacaacccggtattcctaaggtttcccgtttanaccgtttacccg

SEQ ID NO: 241767 - DNA, 555 bp, Homo sapiens
  misc_feature: GYAE6OF02HULJ4.38.11.A11.1.454.CMB.1.raw
  modified_base (396)..(396): a, c, t, g, unknown or other
  misc_feature (396)..(396): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcggggcacggtattaacacctggttggcctggtatcagcagaaaccagggaaagcccctatcgtccctaatctttgatgcatccactttgcaaactgggtcccatctaggttcagcgccagtggatcgtgggacagtatttcactctcaccatccgacaacctagaacgcctagaagtattcngactaaattttatactgaccaacaattaataaacttaaccttacccggtactaccgttacggccaaagggaccaacgactaggagtaacgttaaaccgaacttacggtacggacttcggacctaaccagttccgtacgtttacctttaccatttccccg

SEQ ID NO: 241768 - DNA, 537 bp, Homo sapiens
  misc_feature: GYAE6OF02JIEM5.38.11.A11.1.454.CMB.1.raw
  modified_base (228)..(228): a, c, t, g, unknown or other
  misc_feature (228)..(228): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggcaggtattaacncctggttggcctggtatcagcagaaaccagggaaacgccctatcgtccctaatctttgatgcatccactttgacaactgggtcctatctaggtcagcgcagtggatcgtggactagtacttcactctacacctactcgaacaacttacgaacgtcctagaacgtacttcgtagtactaatttattactacgtacctaataataactaactaccgttaccgtactaccgttacgaccaacggactacgtacgtaggactaagttaacgacgtagtcggtactcgacacctatcgtgtacttcattacccg

SEQ ID NO: 241769 - DNA, 562 bp, Homo sapiens
  misc_feature: GYAE6OF02J1OVR.38.11.A11.1.454.CMB.1.raw
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagtcgatcacgtcacgaccggtgctcgatttagctacgactgcagggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggcgggcgggcacggtattaacgcctggttggcctggtatcagcagaaacccagggaacgccctatcgtccctaatcttgatgcactcactttgacaacgtcgggtcccatctaggttcagcgccagtgatcgtggacagtacttcactctcacntacactaacngaacgctanaagtnttctgacttaatttatacttcgactaacaacttataacttaccgttacccgttactaccgtttaccgaccgtaaaggtaccaaccggtacttagggaacgtaactttaaaaccgggacttacggacggtacttacgacccgaacttacgtcttacggttacttaccgtacttacccgg

SEQ ID NO: 241770 - DNA, 630 bp, Homo sapiens
  misc_feature: GYAE6OF02IRJIK.38.11.A11.1.454.CMB.1.raw
  modified_base (229)..(229): a, c, t, g, unknown or other
  misc_feature (229)..(229): n is a, c, g, or t
  modified_base (269)..(269): a, c, t, g, unknown or other
  misc_feature (269)..(269): n is a, c, g, or t
  modified_base (376)..(376): a, c, t, g, unknown or other
  misc_feature (376)..(376): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggcacggtattaacnccgtggttggcctggtatcagcaagaaaccgagggaaacnccctatcgtacctaatcttgatgctactcctactttgacctaaacgtcgggtaccctatcgttaggttcagccgaccaggtgactcgtggactagtactttcactcncacatcgacactgaacgcctagaagtattctacgtacttaaagttttacttaactacgtaacctaaactaaattaacttaaacttaacccgttaaccccggtaccttaacccggtttaccgggaacccgtaaacggggaaccaaccggtaacgtacgggtaacgttaacgtttaaaaccggtaacgttaggtacggtacctaccggacctaaccgttactcccgtttagttcccttacctaccgtttacccccg

SEQ ID NO: 241771 - DNA, 625 bp, Homo sapiens
  misc_feature: GYAE6OF02IAB2H.38.11.A11.1.454.CMB.1.raw
  modified_base (226)..(226): a, c, t, g, unknown or other
  misc_feature (226)..(226): n is a, c, g, or t
  modified_base (602)..(602): a, c, t, g, unknown or other
  misc_feature (602)..(602): n is a, c, g, or t
tcagtcgatcacgtcacgaccggtgctcgatttagctacgactgcaggggatcagacccagtcaggacacagcatggacatgagggtcctcgctcagctcctgggctcctgctgctctgtttcccaggtgacagatgtgacatccagatgacccagtctccatcctcactgtctgcatctgaggagacagagtcaccattcacttggcgggcgggcaggtataacncgtggttgcctggatcgagcagaaaccagggtaaacgccctatgtaccctaatctttagatgcatcctactttgacaaacgttcgggtaccctagtccgttagggttaccaggtccgtaccgaaggttcggaacttcggtacggggaacctaaggttaacttttccgaacttccttaccgaacctacgttacgaaacctaacccgtaacggaacggacccgttagaaagtactttactaggacttaaagttttacttactacgaacctaacaaattacttaaactaccgttaacccgtacgtaccttaccggacaacgggacacgtactaggactaagtttaacgaacgttagtcggtactaacgtccacgttacnctttacggcctttacacttcccg

SEQ ID NO: 241772 - DNA, 484 bp, Homo sapiens
  misc_feature: GYAE6OF02GI58U.38.11.A11.1.454.CMB.1.raw
  modified_base (228)..(228): a, c, t, g, unknown or other
  misc_feature (228)..(228): n is a, c, g, or t
  modified_base (383)..(383): a, c, t, g, unknown or other
  misc_feature (383)..(383): n is a, c, g, or t
  modified_base (449)..(449): a, c, t, g, unknown or other
  misc_feature (449)..(449): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggcacggtataacnctggttggcctggtatcagcagaaacccagggaaagcccctatgtccctaatctttgatgcatccactttgcaaactggggtcccatctaggttcagcgccagtggatctgggacagatttcatctcaccatcgacaactgaagcctgagattcngctaatttatactgaccaacaatataataacttacccgtctaccgttcgccaaggacacgactganataacgaatgtggctgcacatctgtcttcatcccg

SEQ ID NO: 241773 - DNA, 516 bp, Homo sapiens
  misc_feature: GYAE6OF02H5OIF.38.11.A11.1.454.CMB.1.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (298)..(298): a, c, t, g, unknown or other
  misc_feature (298)..(298): n is a, c, g, or t
  modified_base (325)..(325): a, c, t, g, unknown or other
  misc_feature (325)..(325): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
tcagtcgatcacgtcacgaccggtgctcgatttagctacgactgcaggggagtcagacccagtcaggacacagcatggacatgagggtcctcgctcagctcctgggctcctgcctgctctgtttcccagtgacagatgtgacatccagatgacccagtctccatcctcactgtctgcatctgtaggagacagagtcaccatcattgcgggngggcaggtattaacnctggtggcctggtatcagcagaaaccagggaaagtcccctatgtccctaatctttagatgcatccacgtttnacaaacgtgggtcccatctaggttcancgccagtcgatctgggacagtattccatctcaaccntcgacaacgtgaancctaggaatctacgtcataatttactatcgactaaacattaagtaactaccttacccggactaccttccggacaacgggtacaacgacttgacgaattaacgactaagtcgatacgacgactatcttcgtcttcagttccc

SEQ ID NO: 241774 - DNA, 600 bp, Homo sapiens
  misc_feature: GYAE6OF02JMEMG.38.11.A11.1.454.CMB.1.raw
  modified_base (133)..(133): a, c, t, g, unknown or other
  misc_feature (133)..(133): n is a, c, g, or t
  modified_base (188)..(188): a, c, t, g, unknown or other
  misc_feature (188)..(188): n is a, c, g, or t
  modified_base (227)..(227): a, c, t, g, unknown or other
  misc_feature (227)..(227): n is a, c, g, or t
tcagtcgatcacgtcacgaccggtgctcgatttagctacgactgcaggggatcagacccagtcaggacacagcatggacatgagggtcctcgctcagctcctgggctcctgctgctctgtttcccaggtgacngatgtgacatccagatgacccagtctccatcctcactgtctgacatctgtagganacagagtcaccatcacttgcgggcgggcacggtataacncgtgttgctggtatcagcagaaccagggaaagcccctatcgtaccctaatctttagatcgcactcctactttgccaaacgtgggtacccactcgtacgttcacgcgcagtggatctgggactagtactttcacgttctacaccatccgaacaacctgaacgccctagaactacgttccgtagtactaattttacgttactagtaccctaaaactaattaacttaaacgttacctttaccccggtactacccgttacggtacccaaacgggtactaaccggtagacgtacgtaacgttaaaccggtaaacgttgttaaccgggtcctagtacccgtaacctacgttaccgtatttcccgttactacgtttcccc

SEQ ID NO: 241775 - DNA, 563 bp, Homo sapiens
  misc_feature: GYAE6OF02GT7FV.38.11.A11.1.454.CMB.1.raw
  modified_base (263)..(263): a, c, t, g, unknown or other
  misc_feature (263)..(263): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggcacggtattaacacctggtgcctggtatcagcagaaaccagggaaancccctaatcgtccctaatctttgatgcactcctactttgacaaacgtcggggtacccattcgtaggttcagcgccagtggatcgtgggacagtattcactctcactatacgaactaactagaacgcctagaacgtacttctgtacttaatttacttactacgacctaaactaattaataacttaaccgttacccgtactaccgtacgtaccgaacggacaaccgtacgtaggtacgacttaacggtaacgtagtcggtacgtacgaccacctactaccttcgtacttaccgactttcccg

SEQ ID NO: 241776 - DNA, 510 bp, Homo sapiens
  misc_feature: GYAE6OF02GGONR.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggcacggtattaacacctggttggcctggtatcagcagaaaccagggaaagcccctaatgtccctaatctttgatgcatccactttgcaaactgggtcccatctaggttcagcgcagtggatctgggacagatttcactctcaccatcgacaacctgaagcctgaagattctgactaatttattactgacctaacaatattaaactacctttacccggtactaccttcggacctaacgggacaacgactggagagttaaacgaactgtacggcttgcacactctgtcttcattccc

SEQ ID NO: 241777 - DNA, 517 bp, Homo sapiens
  misc_feature: GYAE6OF02FX6SP.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcggggcacggtattaacacctggttggcctggtatcagcagaaaccagggaaagcccctatcgtccctaatctttgatgcatccactttgcaaactggggtcccatctaggttcagcgcagtggatcgtgggacagtatttcactctcaccatcgacaacctgaacgcctagaagtacttctagactaatttattactcgacctaacaattaataataccgttacccgtctaccgttcgaccgaaggacacgtactaggataataacgaactgtacggctcgacacactctgtcttcattcccg

SEQ ID NO: 241778 - DNA, 561 bp, Homo sapiens
  misc_feature: GYAE6OF02GJOFE.38.11.A11.1.454.CMB.1.raw
  modified_base (230)..(230): a, c, t, g, unknown or other
  misc_feature (230)..(230): n is a, c, g, or t
  modified_base (267)..(267): a, c, t, g, unknown or other
  misc_feature (267)..(267): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtccaccatcacttggtcgggcgggcacggtataacncctggttgcctggtatcagcaagaaaccagggaaacnccctatcgtaccctaatctttgatgcatcctactttgactaaacgtcgggtcccattctaggtcagcgcagtggatcgtgggactagtactttcactctacaccatcacactagaacgctagatactctagtacttaatttactactacgacctaaataattaactaacttaccttacccgtactacccgttacggaccgaacggaccaacgtacgtaggactaacgttaaacgaacgttggtacggcttacgacctaacgtacttaccgttctttccgttactacgttccccg

SEQ ID NO: 241779 - DNA, 589 bp, Homo sapiens
  misc_feature: GYAE6OF02GYQW5.38.11.A11.1.454.CMB.1.raw
  modified_base (188)..(188): a, c, t, g, unknown or other
  misc_feature (188)..(188): n is a, c, g, or t
  modified_base (229)..(229): a, c, t, g, unknown or other
  misc_feature (229)..(229): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (564)..(564): a, c, t, g, unknown or other
  misc_feature (564)..(564): n is a, c, g, or t
tcagtcgatcacgtcacgaccggtgctcgatttagctacgactgcaggggatcagacccagtcaggacacagcatggacatgagggtcctcgctcagctcctgggctcctgctgctctgtttcccaggtgacagatgtgacatccagatgacccagtctccatcctcactgtctgcagtctgtagganacagagtcaccatcacttgcgggcgggcacggtattaaccncctggttgcctggtatcgagcagaaaccagggtaaacgcccctagtcgtaccctaatccttagatgacatccactttcgacaaacgtggggtaccccatcgttaggttcagcncctagtggattcgngggacagtatttcgacttactcacgaactccgaactaaccgtagaaacgccctaggaacgtacttcgtagtacctaaattttacttacttaccgtacaaaaccgtaatttaaacttaattaacccgttaccggtacctaaccgttaccgacgaaacggacctacgactaggacaactaacgaacgtgttacggccttagcctaaccgnttaccgtgtaccttagaccttcccg

SEQ ID NO: 241780 - DNA, 555 bp, Homo sapiens
  misc_feature: GYAE6OF02F40JK.38.11.A11.1.454.CMB.1.raw
  modified_base (377)..(377): a, c, t, g, unknown or other
  misc_feature (377)..(377): n is a, c, g, or t
tcagtcgatcacgtcacgaccggtgctcgatttagctacgactgcaggggatcagacccagtcaggacacaacatggacatgagggtcctcgctcagctcctggggctcctgctgctctgtttccccaggtgacagatgtgacatccagatgacccagtctccatcctcactgtctgcatctgtaggagacagagtcaccatcacttgtcgggcgggcacggtattaacacctggttggcctggtatcagcagaaaccagggaaacgccctatcgtccctaatctttgatgcatccactttgacaaacgtgggtcccatctaggtcagcgcagtgatcgtggacagtatttcactctcaccatcgaacacctgaacncctagaagacttctgtacttaatttatactcgacctaaactaattaataacttaccgttaccgtcctaccgttacggaccaacggtaccaacgtacgtagaagtaacgttaaaccgacgttacggtacggtctaccgacaaccgtagtccttcgttccttactacttcccttaccccg

SEQ ID NO: 241781 - DNA, 585 bp, Homo sapiens
  misc_feature: GYAE6OF02GKYU0.38.11.A11.1.454.CMB.1.raw
  modified_base (151)..(151): a, c, t, g, unknown or other
  misc_feature (151)..(151): n is a, c, g, or t
  modified_base (195)..(195): a, c, t, g, unknown or other
  misc_feature (195)..(195): n is a, c, g, or t
  modified_base (239)..(239): a, c, t, g, unknown or other
  misc_feature (239)..(239): n is a, c, g, or t
  modified_base (539)..(539): a, c, t, g, unknown or other
  misc_feature (539)..(539): n is a, c, g, or t
  modified_base (545)..(545): a, c, t, g, unknown or other
  misc_feature (545)..(545): n is a, c, g, or t
tcagtcgatcacgtcacgaccggtgctcgatttagctacgactgcaggggatcagacccagtcaggacacagcatggacatgagggtcctcgctcagctcctggggctcctgctgctctcgtttcccgggtgacagatgtgacatccaagntgacccagtcctccatcctcactgtctgctaatcgtagtagganacagagtccaccagtcacttggcggggcgggcacggtattaacncctggttgcctggtatcagcagaaaccagggtaaacgcccctatcgtaccctaagtcttgatcgacactcctactttgactaaacgttggggccctattacgttacggttcacgtcgaccgtgtacggatccggtagggacaggttaatttccaacgtccttcaacgtatacgaactaaccgtgaacggtcctaggaactattcgatactaatttactaactcgaacctaacaatagtaaacttcgtaaccgttcaacgttcggaactaagggaccaacgtcgtaacgatacttaaacgnttcggngactggacaccgtatcgtagtcttactagtacccttccgg

SEQ ID NO: 241782 - DNA, 591 bp, Homo sapiens
  misc_feature: GYAE6OF02HA1S1.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgcgggcgggcacggtataacgctggttggcctggtatcagcaagaaaccgagggaacgcccctagtcgtacccgtaatcgtttgactgcacttccactttgacaaacgttcgggtaccctagttcgtaggttcaacgtccgcctaggtggactcgtagggacagtacttcactctacacatacgactaaccgtagaacgtcctagaacgtattcgtagacttaaatttattaactagtaccaaactaataaacttaaacttaacccgtttacccggtacctacccgttacggacgtaaaccgggtaaccacgaacgtagtacgtaacgtttaaacggaactcggtacgtcgtacgctaccgtactcttcgtactttcacttcccg

SEQ ID NO: 241783 - DNA, 638 bp, Homo sapiens
  misc_feature: GYAE6OF02G0XG9.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatctacttggtcgggcggggcacggtattaacaccgtggttcggcctggtactcagcaagaaaccgagggaaacgcccctatcgtaccctaatctttagatgctactcctactttgactaaacgtcggggtaccagttcgtaggttcgacgcgaccgtagtcggaactcgtagggaactacgtactttctaactcctaccgaacccagtaccgacctaaaccgttagaaccgtcctaggtaacgtactttccgtagtaccttaaagttttacttaacgtacgaacctaaacttaaataacttaaacttacccgttacccggttacctaaccgttaccggaaccgaacgggtaactaccgtaacgtacggacgtaaacttaaaccggaactcggtacggcgtacgaccacgtactaccgtgttaccttcgtacttccccg

SEQ ID NO: 241784 - DNA, 1023 bp, Homo sapiens
  misc_feature: GYAE6OF02FYPE6.38.11.A11.1.454.CMB.1.raw
  modified_base (119)..(119): a, c, t, g, unknown or other
  misc_feature (119)..(119): n is a, c, g, or t
  modified_base (127)..(127): a, c, t, g, unknown or other
  misc_feature (127)..(127): n is a, c, g, or t
  modified_base (130)..(130): a, c, t, g, unknown or other
  misc_feature (130)..(130): n is a, c, g, or t
tcagtcgatcacgtcacgaccggtgctcgatttagctacgactgcaggggatcagacccagtcaggacacagcatggacatgagggtcctcgctcagctcctggggctcctgctgcctnttcctcgngtnagatgtgacatctacgagtagtaccgaccgtactccactaccttccactacgttcgtcgtcactacgttcgtaggtaggacaacgagtacgaccactactacctagttcgggcggggcggacgtacgttaactaaccgtcggttgggtccgtcggttagtacacgacgaacgaaaaccggaacgggaaacggtaacccccgtaccttaggttccccgttaacttaacgttttcgtaaggctcaactaccttacctttagtacgaaaaccgtacggggttcccgaaccttagttacgggttaccgacgtaccggcccgtacggttagggtacgttacccgttcgggggaacgtaaacgttactttttacccgttaacccgttcctttaaccccggtaaacccctaaacgtttacccgggtaaaaccccgtaaaaccccgtttaaaccggggtaaacgggtaaccccgtttaacccggttaaaaaaggggtttaaacccgttttacctttaccccgggtaacgtttaaaaaacctttttttaactttttaaacccgtttacccgggaaaacccctaaaaccctttaaaaaagtttaaaaaccttttaaaccgtttaaaacccccggtttttaaacccccccgggtttaccccgtttaaccccgttttaaacccgggggttaacccggaaaaacccggggggtaaacctaaaccccgggttaaaccgttagggggttaaacgtaaaacccgttttaaaaaacccggtttaaccggtaaccgggtttttcggggaacccgtttaacccgtccccggaaaacccttaaccgttttcgttttaccggttttaaccccttttaccggttaaccccttttacccccgttttccccccccgg

SEQ ID NO: 241785 - DNA, 651 bp, Homo sapiens
  misc_feature: GYAE6OF02JPF56.38.11.A11.1.454.CMB.1.raw
  modified_base (120)..(120): a, c, t, g, unknown or other
  misc_feature (120)..(120): n is a, c, g, or t
  modified_base (439)..(439): a, c, t, g, unknown or other
  misc_feature (439)..(439): n is a, c, g, or t
tcagtcgatcacgtcacgaccggtgctcgatttagctacgactgcaggggatcagacccagtcaggacacagcatggacatgagggtcctcgctcagctcctggggctcctgctgctctntttcccaggtgacagatgtgacatccagatgacccagtcctccatcctcactgtctgtcatctggtagagacagagtcaccatcacttggtcgggcggggcgaacggtattaacaccgttggtgtccgtggtatcgagcaagaaaccgaggaacgccctagtcgtaccctatctttgactgacctatcctactttagctaacgtcgggtaccctataccgtaggttcaacgccgtacgtagtcggtactacggtggactaggtacttttcgaccgtcttacccacgtactaccaccgtaactcgaacgtcctaggtaanacttcgtactacgttaaatttacgtacttacgactaaactaacgttaattaaaccgttaaccgttacccgtaaccgtacccttaccggaaccgtaacgggtaaccaaccgggtaataccggtaagttaaccgtaaacggttaaccgtagttacgggtaccgtagaaccctacgtaaccttccgttacggtttacctcggtaaccttccccgg

SEQ ID NO: 241786 - DNA, 548 bp, Homo sapiens
  misc_feature: GYAE6OF02GPOIN.38.11.A11.1.454.CMB.1.raw
  modified_base (228)..(228): a, c, t, g, unknown or other
  misc_feature (228)..(228): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgaccccagtctccatcctcactgtctgcatctgtaggagacagagtcaccatcacttgtcgggcgggcacggtatacncctggttggcctggtatcagcaagaaaccagggaaacgcccctatcgtccctaatctttgatgcatcctacttttgacaaacgtcggggtcccatctagttcagcgccagtggactcgtgggacagtatttcactctcaccataccgaccaaaccgtgaacgcccgtagaacgtatttctagtacttaattttacttactcgacctaaacaactaattaacttaccgttacccgtactaccgttacgaccgaaggacaacgactaggagtaataacgtaactagtcggtctgaccaccgattcctagtcttacattcccg

SEQ ID NO: 241787 - DNA, 711 bp, Homo sapiens
  misc_feature: GYAE6OF02FLEFW.38.11.A11.1.454.CMB.1.raw
tcagtcgatcacgtcacgaccggtgctcgatttagctacgactgcaggggatcagacctagtcaggacacagcatggacatgagggtcctcgctcagctcctggggctcctgctgctctgtttcccaggtgacagatgtgacatccagatgacccagtctccatcctcactgtctgcatctgtaggagaccagagtcacccatcctaccgttggttccggggcgggggtcctaaccggggttactttaaccgacccgtggttcggcctggtactcagccagaaacccgagggaacgcccctatcgtccctaatcttagatgcatccacttcgacaaacctggggtaccccattcgtaaggttcacgccgaccaggtacggactcgtgggacaggtaactttccgaaccttccgtaccacctactccgaacctaacccgtagaaccgcctagaacgtacttctagtacttaactttacttacgcgtaacccaacgtaaactttaacgttaaaaccgtaccgtttaaacccccgggtacctaaccccgttaaccgggacccgtaaaacgggtaaccccgtaacgtaaccgtacgggtacgtaaaccgtttaaaccggtaacctcgggtaaccggtacccgttacggaccccgttaaccccgtacgtttacccgttccggttacccctttacccgtaacccgtttaccccccgg

SEQ ID NO: 241788 - DNA, 662 bp, Homo sapiens
  misc_feature: GYAE6OF02GJ77Q.38.11.A11.1.454.CMB.1.raw
  modified_base (189)..(189): a, c, t, g, unknown or other
  misc_feature (189)..(189): n is a, c, g, or t
tcagtcgatcacgtcacgaccggtgctcgatttagctacgactgcaggggatcagacccagtcaggacacagcatggacatgagggtcctcgctcagctccgtggggctcctgctgctctgtttcccaggtgacagatgtgacatccagatgacccagtctccatcctcactgtctgcatctgtagganacagagtccaccatcacgttggtcggggcgggcacggtattaaccgaccgtggttggcctggtatcagcaagaaaccgagggaaacgcccctatcgtaccctaattcttgatgctactacctactttacgacgtaaacgtcgggtaccctagtcgtaggttcacggccgacgagtggacgttcgtgggaactagtactttaccacttcctactacctataccgaacctaacctagaacgtaccgtagaagttacttctagtacttaaatttacttacgacgtaacctaaactaattaacttaaaccttacccgttaacccggtcctaacccggttaccgggaacccgtaaacgggaccgtaaccggtaccgtacggtaacgttaaccgttaaaccggtaacgttacggtacgggtaccgtacgtacccgtaccttacgttccggttacttcccgtttactaccgtttaccccg

SEQ ID NO: 241789 - DNA, 538 bp, Homo sapiens
  misc_feature: GYAE6OF02H6INN.38.11.A11.1.454.CMB.1.raw
  modified_base (273)..(273): a, c, t, g, unknown or other
  misc_feature (273)..(273): n is a, c, g, or t
  modified_base (510)..(510): a, c, t, g, unknown or other
  misc_feature (510)..(510): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttggtcgggcgggcacggtacttaacaccgtggttcggccgtggtatcagcaagaaaccgagggaacnccctatcgtaccctaatctttgatcgacactcctactttgaccaaacgtcgggtaccctagtctaggttcacgcgccagtggatcgtggactagtacttcactctacacactcgacaacgtgaacgtcctagatacttctagtacttaatttatactcaactaacaatattaactacttacccgtctacgttcgacaggacacgacgtgtagtactaacgacgttgacggtactacnccactactcgtactttctctacttcccg

SEQ ID NO: 241790 - DNA, 659 bp, Homo sapiens
  misc_feature: GYAE6OF02H91J4.38.11.A11.1.454.CMB.1.raw
  modified_base (266)..(266): a, c, t, g, unknown or other
  misc_feature (266)..(266): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttccccaggtgacagatgtgacatccagatgacccagtctccatcctcactgtctgcatctgtaggagacagagtcaccatcacttggtcgggcgggcacggtattaacgcctggtcgcctggtatcagcaagaaccgaggaacnccctatcgtaccctaattctttagatgactactcctacgtttacgacgtaaacgtcgggtacccacgttcgtacggttcacgtcgacctggtaggatcggtaggactagtactttccactcctcaaccagtacccgaactaaccgttaggaaccgtccgttagaaacggtactttcgtagtacctttaaattttacttaacgtcgtaaccaactaataacttaactacccgtttacccgacttaacccggtccggtaacccgaaacgggtacctaaccggacgttaggaacgtaaaccgttttaaaccggaatttaccgggtagtaacccgttaccgaacccgttacctaaccgtttaccgttcgttttcccgttactccctttaccccccgg

SEQ ID NO: 241791 - DNA, 903 bp, Homo sapiens
  misc_feature: GYAE6OF02GWA46.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtcctccatcctcacgtgtctgcattcgtaggtagggagacaggacgtccaaccaattccaacgtttgggccgggggtaccgggggactaaccgggttaattaaaccaccgttgggttggcccgtggttatcgagacaacgaaaccgaaggggaaacgccccctaagtcggtacccttaaattcgtttgactcgtaccacttaccctacgttttacgaaccgtaaaaccgttcgggggtaccccaacgtttacttaacggggtttccaagggacccgttaccgtaagggttaccgggtaacttaccggtacgggggtaacctaagttacgtttttaccgtaaccctttcctacccgtaacccgtaacgtaacccgtaaacccgtaaacccgttacgggtaaaaccgtcccgttaaacggtaaacgttacgttttaccttaggttaaccttaaagtttttaaccgttttaaccgtaccgtaacccttaaaactaaaacttttaaactaaaccgtttaacccgttttaaccccggttaccgttaacccccgtttacgggtaaacccggtaaaccgggtaacccgtaaaccggttaaccgtaacggggttaacgttaaaccggttttaaaaccgggtaaaccggtttaacgggttaaccggtacccggttaacggtacccgttaaacccggttacgtttacccgtttacgggttttacccttttaccggttaaccccttttaacccccgg

SEQ ID NO: 241792 - DNA, 775 bp, Homo sapiens
  misc_feature: GYAE6OF02J1B44.38.11.A11.1.454.CMB.1.raw
  modified_base (227)..(227): a, c, t, g, unknown or other
  misc_feature (227)..(227): n is a, c, g, or t
tcagtcgatcacgtcacgaccggtgctcgatttagctacgactgcagggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgcgggcgggcacggtattaacnctggttggcctggtatcagcaagaaccagggaaacgcccctatcgtaccctaatctttagattgctaactcctaactttgacctaaacgttcggggtacccctagtcgttaacggttcaggtccgactaacggttggaagttcgtagggaactaggtacttttccgaacttcgtacctaaccgtacttaccggaaacctaaccgttacgaaacggtacccttaacggtaaacgttaaccgtttccgtacggtaacctttaaacgtttttaaccgttaaccgttaccggtaaaccctaaacttaaaacgtttaaaactttaaacccgtttaaacccgtttaaaccccccggggttacctaaccccggttttaacccgggaacccgttaaaacggggtaaaccccgtaacgtaacccgttaaggggtaaccgttaaacgtttttaaaacccggaaacgtttcggttacgggaacccgttttaccggaaccttacccgttaacgttacccgttaagggttttacccctttacccgtaacgttttacccccg

SEQ ID NO: 241793 - DNA, 513 bp, Homo sapiens
  misc_feature: GYAE6OF02GBVUP.38.11.A11.1.454.CMB.1.raw
  modified_base (427)..(427): a, c, t, g, unknown or other
  misc_feature (427)..(427): n is a, c, g, or t
  modified_base (477)..(477): a, c, t, g, unknown or other
  misc_feature (477)..(477): n is a, c, g, or t
tcagtcgatcacgtcacgaccggtgctcgatttagctacgactgcaggggatcagacccagtcaggacacagcatggacatgagggtcctcgctcagctcctgggctcctgctgctctgtttcccaggtgacagatgtgacatccagatgacccagtctccatcctcactgtctgcatctgtaggagacagagtcaccatcacttggcgggcgggcacggtattaacacctggttggcctggtatcagcagaaaccagggaagcccctatcgtccctaatctttgatgcatccactttgactaacgtcgggtacccatctaggttcagcgccagtggatcgtgggacagtatttcactctcaccataccgacaacctgaacgtctagtaagtacttactgtacttaatttacttacgtcacctaaanaattataactacttaccgtacgtaccttcgacaaggacacgacgtagganaataacgatagtagctgcacactctagtctcattcc

SEQ ID NO: 241794 - DNA, 542 bp, Homo sapiens
  misc_feature: GYAE6OF02JAM3O.38.11.A11.1.454.CMB.1.raw
  modified_base (235)..(235): a, c, t, g, unknown or other
  misc_feature (235)..(235): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
  modified_base (427)..(427): a, c, t, g, unknown or other
  misc_feature (427)..(427): n is a, c, g, or t
tcagtcgatcacgtcacgaccggtgctcgatttagctacgactgcagggggatcagacccagtcaggacacagcatggacatgagggtcctcgctcagctcctggggctcctgctgctctgtttccaggtgacagatgtgacatccagatgacccagtctccatcctcactgtcgtgcattctggtaggagacaggacgtcacatctacgttggtcgggcgggcacggtataacncgtggttcgcctggtactcacgcaacgaaaccagggaacgccctatcgtccctaatcgttgatgctatcctacgtttcgactaacgtcggggtaccagttcgtaggttcagcgctagtcggatcgnggacncgattcactctacacatcgaacaactcgaacncgtagaatnttctgacttagtttactacncaccaatataactaatccttaccggctaccgtacgaccgaaggactacgacttagagtaactaacggattacggtcgtacgtgactactacgttcttacttcttacaccgttccc

SEQ ID NO: 241795 - DNA, 545 bp, Homo sapiens
  misc_feature: GYAE6OF02FI3DX.38.11.A11.1.454.CMB.1.raw
  modified_base (231)..(231): a, c, t, g, unknown or other
  misc_feature (231)..(231): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatccacttgtcgggcggggcacggtattaacncctggttggcctggtatcagcagaaaccagggaaagcccctatgtccctaatctttgatgcatccacttgcaaactgggtcccatctaggttcagcgccagtggatcgtggacagatttcactctcaccatcgacaacctagaagcctagaagattctgtactaatttattactcgacaacaataacttaactaactttaaccccggtacctacccgtttacggaccctaaacgggacacgacgtaggtagaacgttaaacgaacgtgtacggtacctagaccgtacctagtccttgtcctttacatttccccg

SEQ ID NO: 241796 - DNA, 659 bp, Homo sapiens
  misc_feature: GYAE6OF02JZK6K.38.11.A11.1.454.CMB.1.raw
  modified_base (156)..(156): a, c, t, g, unknown or other
  misc_feature (156)..(156): n is a, c, g, or t
  modified_base (167)..(167): a, c, t, g, unknown or other
  misc_feature (167)..(167): n is a, c, g, or t
  modified_base (180)..(180): a, c, t, g, unknown or other
  misc_feature (180)..(180): n is a, c, g, or t
tcagtcgatcacgtcacgaccggtgctcgatttagctacgactgcaggggatcagacccagtcaggacacagcatggacatgagggtcctcgctcagctcctgggctcctgctgctctgtttcccaggtgacagatgtgacatccagatgaacccngtctccatccncactgtctgactntctaggtacggagacagtacgtacaccataccagttcgggtccggggccggggtacctacgggttaacttaaaccgtccggttgggttacggccgttacgggttatacgtaggacaaacggaaaccgaacgggaaaccggtccctaatcgtacccgttaacttctttagactacgctactacttacttacgtacgaaacggttcgggtacctagtacgttacggtacacgacgtaccgaggtagtaactcggtacggtacgtacgttacgttactactccgtacctacgtacgtaccgtaacccgtacgttacggaactaccgtagtaacgttaacttcgtactacgttaatttaacgttcagcctaaagtacttactaacttaccgtaccgtactacgtaccgacgaacgcaagacgtagacgtaataaccggaagttagcgacgtacacgtacttcgacttgtacttctaacttccg

SEQ ID NO: 241797 - DNA, 595 bp, Homo sapiens
  misc_feature: GYAE6OF02FPXIS.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacaccgtggttggcctggtatcagcaagaaaccagggaaacgcccctatcgtaccctaattctttgatcgcatcctactttgactaaacgtggggtacccatctaggttcagcgccagtggatcgtaggactagtacttcactctcacactcgaacactagaacgtcctagaacgtacttctacgtacttaatttacttactacgtacctaaactaattaacttaaacgttaaccgttaacccggtacctacccgttaccggtaaccgaaacgggtaccaacggtaccgtaggtacgtaacgttaaaccgaacgtggttaccggacttacgactaccgtacttccgttcgtcttacgtacttaccccg

SEQ ID NO: 241798 - DNA, 729 bp, Homo sapiens
  misc_feature: GYAE6OF02JAEJ8.38.11.A11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagctacgactgcaggggatcagacccagtcaggacacagcatggacatgagggtcctcgctcagctcctgggctcctgctgctctgtttcccaggtgacagatgtgacatccagatcgacccagtcctccatcctcactgtctgctatcgtgtaggagacagngtccacctatccacgttcgggtcggggccgggctaacggttattaaccgaccgttgggttcggtcccttgggtaactccgaagaccgtaaacggaaacccgaggggtaaacctcccccgttaatcggttaaccccttaattccgtttagactacggtacctaaccgttccccttaacgttttacggaaccgttaaaaccggttccggggtacccctaagttccgttaacggttacacggtccgacccggtaggtcggtacttcggtacgggaactaaggttctttaccgaccttccgtaccaaccgtactaacccgaacctaaccgtacgaaccgtaccgtagtaacgtacttaccgtagtaacttaattttacgtacctacgtaacctaaactaacttaataaccgttaccgttacccgtaccgtaccgtacggaccgaacggacctaacgtacgtacgtagtaacgttaacggacggtttcgacggacttcggacctaccgtactccgttacttccgtactccgttacccg

SEQ ID NO: 241799 - DNA, 741 bp, Homo sapiens
  misc_feature: GYAE6OF02G40NF.38.11.A11.1.454.CMB.1.raw
  modified_base (229)..(229): a, c, t, g, unknown or other
  misc_feature (229)..(229): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttgcgggcgggcacggtattaacncctggtggcctggtatcagcaagaaaccgagggaaacgccctatcgtacccgttaactctttagatgctaacgtcctactttacgactaaacgtcggggtaccctacgttacgtacggtttacaggaccgtaccgtaaggtggtaactcggtacggggtaactaaggtacttttacaccttacctaccctaaccacgttacccgaaacgaaacccgttacgaaaccgtacctaacggtaaacggtacctttacggtacgtaaccttaaatttttaaacgttaaccgtttacgaaccctaaaacttaaattaaacgtttaaaaccgttaaccccgtttaaccccggttaacccgtaacccggtttaaccgggaacccgtaaaaccggggtacctaaacccgggttaacgtacggggtaataaccgttaaaaccggtaacggttaagggttaccggtactacgggaacctaacccgtacgttaccttacggttaccttacctacccttaccccg

SEQ ID NO: 241800 - DNA, 813 bp, Homo sapiens
  misc_feature: GYAE6OF02H8MND.38.11.A11.1.454.CMB.1.raw
tcagtcgatcacgtcacgaccggtgctcgatttagctacgactgcaggggatcagacccagtcaggacacagcatggacatgagggtcctcgctcagctccgtggggctcctgctgctctgtttcccaggtgacagatgtgacatccagatcgacccagtcctccatccctcactgtctgctatctaggtaggacgaacaggtagtccaacctatcctacggtttcgggtaccgggggcgggggacctaaccgggtttaattaaccgtccggttcgggttcgggtcccgttgggttactaccgtaacggacgaaaccggaaaaccggtaacgggggaacctacccccgttaattaccgttaccccctttaagtttccgtttttacgaacgttcgacctaccttacccgttacgtttcgaaccctaacgggttccggggtaccctacgttaccgttacggttccgaacggaccggtaccgtaggtaggtacctacgggtacgggtactaagtttactttaccgccttacctccgtaaccgtacgttaccgaaaccccgtaacgttacgaaccgtcgttaaggtaacgttcttcgtaacgttacttaacgttttactacgtacgtaacctaaacttaacttaacgttaaacctttaacccgttcccggttaacccttaccggttaccggtaaaccggtaaccggacctaaacggtcgtaacggtaacggttaaccgttaaacggtcgttaccgggtacgtaccgttacgtaccgtaccttacgttccgttacgttactttccaccgtttaccccg

SEQ ID NO: 241801 - DNA, 953 bp, Homo sapiens
  misc_feature: GYAE6OF02H1QY0.38.11.A11.1.454.CMB.1.raw
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatcgacccagtcctccatccctcacgtgtctgactatctggtaggacgacaggagttccaccattccgaacgtttcgggccgggggcggggtacctaacgggttaacttaaccgaccgttgggttcggtccgttagggttactcgagaccgaacggaaaaccggaacgggtaaaccgaccccgttacgtacgttaccccgttaaactttccgttttacggtacgtacgtaccgtactacccgttaaccgtttacgtaaccgtaaaccggttccggggtacccgtacgttaccgttaacggttaccgtaccggtccggtaccgtacggtacggtaacgttaccggacgggttttttaaccgaacgtttaaccgtttaaccgtaccttaccgtacccgtaacccgttaaccgtacccggtaaacccgttaacccgttaacggtaaacccggttaccgttaaccgggtaaacggtttaaccgttaccgttaacggttaaacctttaaacgtttttaaccgtttaaccgtaacccggttaaacccttaaaacctaaacctttaaaccgtttaaaaccctttaaccccggttttaaaccccggtttaaccccgttaaccccggtttaaccccgggtaaacccgggtaaaccggggtaaaccggtaacccggtaaccgggttaaggtaaccggttaaaccgtttaaaccggtaaaccggtttaacgggttaccggtaccgttaaccggtacccgtaacccgttacgttacccgtttaccgtttacctttaccggttacctttaacccccgg

SEQ ID NO: 241802 - DNA, 732 bp, Homo sapiens
  misc_feature: GYAE6OF02JLQ29.38.11.A11.1.454.CMB.1.raw
  modified_base (230)..(230): a, c, t, g, unknown or other
  misc_feature (230)..(230): n is a, c, g, or t
  modified_base (282)..(282): a, c, t, g, unknown or other
  misc_feature (282)..(282): n is a, c, g, or t
tcagtcgatcacgtcacgaccggtgctcgatttagctacgactgcaggggatcagacccagtcaggacacagcatggacatgagggtcctcgctcagctcctgggctcctgctgctctgtttcccaggtgacagatgtgacatccagatgacccagtcctccatccctcactgtctgcatctgtaggagacaggatccacatcacgttgccgggcgggctacggtatacnccgttggtcgccgtggtactcgacggacctaagaaaccgaaggggtaaaccncccccgttaagtccgttaaccccttaagttccgtttggaactcgactactcctacgtttcgacgtaaacgtccgggtacctatcgttagtcgacgtccgtacaggttacggacttacggagggtactaacggttactttacccgacgtttaccaccgaacccgtagtacccgtaaaccgtaccgtacggtaaaccgtccggtaagtaacgttactttaccggtactaacctttaaagttttacttaaccggtactaaaccctaaacgtaaacgttaactaaccgttaaacccgtttacccgttaacgttaacccggttaacccgggaaccgtaaaccggtaactaaccggtaacgttagaacgttaaccgttaacggtaacgttacggtacgaaccgtccgtaacctaccgttaacgttccgttacgtttcttacccgtacttaccccgg

SEQ ID NO: 241803 - DNA, 602 bp, Homo sapiens
  misc_feature: GYAE6OF02IBMN3.38.11.A11.1.454.CMB.1.raw
  modified_base (317)..(317): a, c, t, g, unknown or other
  misc_feature (317)..(317): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
  modified_base (456)..(456): a, c, t, g, unknown or other
  misc_feature (456)..(456): n is a, c, g, or t
  modified_base (469)..(469): a, c, t, g, unknown or other
  misc_feature (469)..(469): n is a, c, g, or t
  modified_base (501)..(501): a, c, t, g, unknown or other
  misc_feature (501)..(501): n is a, c, g, or t
tcagtcgatcacgtcacgaccggtgctcgatttagctacgactgcgagggggatcagacccagtcaggacacgagcatggaccatgagggtcctcgctcagctcctggggctcctgctgctctgtttcccaggtgacagatggtgacatccagactcgaccccagttcctccactccctcactgtcctcgcactctggtacggagacagacgtcaacctatcctactttggtccggggccgggtctaaccggttaacttaacgtaccgttgggttcggccgtacggtactcgacgccaaggaaaccgaagggaaacncccctaatcgtaccctaattcctttagactcgacactcctactttcgactacgtcgggtccatcgtagttcacgcgccgagtgntcgnggactacgtnttcactctaccactctacgaccactagactctagatcttcntacttattatacngtacaactaatacgtacgtaccgttacgtccncgttaccgagtaaccggactaccgtagtagacgtaactaacggactggtaccgtcacgtaccaacgtcgttaccgttcgttactttacccagtttaccccg

SEQ ID NO: 241804 - DNA, 644 bp, Homo sapiens
  misc_feature: GYAE6OF02JRHIS.38.11.A11.1.454.CMB.1.raw
  modified_base (138)..(138): a, c, t, g, unknown or other
  misc_feature (138)..(138): n is a, c, g, or t
  modified_base (203)..(203): a, c, t, g, unknown or other
  misc_feature (203)..(203): n is a, c, g, or t
  modified_base (372)..(372): a, c, t, g, unknown or other
  misc_feature (372)..(372): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
  modified_base (590)..(590): a, c, t, g, unknown or other
  misc_feature (590)..(590): n is a, c, g, or t
  modified_base (626)..(626): a, c, t, g, unknown or other
  misc_feature (626)..(626): n is a, c, g, or t
tcagtcgatcacgtcacgaccggtgctcgatttagctacgactgcaggggatcagacccagtcaggacacagcatggacatgagggtcctcgctcagctcctggggctcctgctgctctcgtttcccaggtgacagtntgtcgacactccagatcgacccctagtcctcactccgtacactgtctgctacttctggtacggancagagtaccaccagttcacgttcgggcgggcgggaccacgggttaacttaaccgccggttgggtttcgcctaggttactcaggaccgaacgtaaacgaacggggaacgccctaatcgtaccctaagtctttcgatcggactactctaccttgaccgtaacgccggtacntctagttcacgtcgntacgngtcncgggtagacctaagttcttacgcttccncgaactacgtacgacctaactcgacgtctagaacgtacgtcacgttctaatttaactcggtcaaccgtaaatactttaaacgactttacccgttacctcgttaccccgttaaggcgttaacggacctaacgacgttaaggactaaacggttaaccgtcggtacgtntaaaccggttcaaacgtcctactccgttttaaccgngtttacccacggttcccc

SEQ ID NO: 241805 - DNA, 799 bp, Homo sapiens
  misc_feature: GYAE6OF02FQX2O.38.11.A11.1.454.CMB.1.raw
  modified_base (277)..(277): a, c, t, g, unknown or other
  misc_feature (277)..(277): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgactatccagatgacccagtctccatcctcactgtctgcatctgtaggagacagatccacatcacttgggtcgggcggctacggtattaaccgaccgttggtcgccgttgtactcgagacaaggaacctaagggaacnccccgttagtccgtaccctaattcgttagactcggactacttccgtacttcgacgtaaacggttcgggtaccctagttcggtacggttacgacggtacgaccgtaggttacggacgttcggtacgggaacgtaacgtttacgtttaccgaccgttcctaccgtaaccctacgttaacccgaaaccgttaacggtaccgtaaaccggacccgtaaacgtaaacgtttaccgtttaccgtacgtttaaacttttaaacgttttaaaccgtttaaccgtaaccggttaaaccctaaaacttaaaacggtttaaactttaaaccggttaccccgtttaaaccccgggtttacccttaaccccgggtacgggttaaaccccggtaaggggtaaacccttaaaccggtccggtaacgggtaacttaaacggttaaaccggttaacggttacggttaaacggttacctaccggtaacctaaccgtttacgttacggtttaccttaccgttccgttaacctttcccccgg

SEQ ID NO: 241806 - DNA, 801 bp, Homo sapiens
  misc_feature: GYAE6OF02I7ZVC.38.11.A11.1.454.CMB.1.raw
  modified_base (323)..(323): a, c, t, g, unknown or other
  misc_feature (323)..(323): n is a, c, g, or t
tcagtcgatcacgtcacgaccggtgctcgatttagctacgactgcaggggatcagacccagtcaggacacagcatggacatgagggtcctcgctcagctccgtggggctcctgctgctctcgtttccaggtgacagatgtagacactccagatcgaccctagtcctccactcctacactgtctgactatcgtaggtaaggacgaacagtacgtaccaacctatccgtacgttcgggtacgggggccggggacgtaacggttaattaaccgtccgttgggttcgccgttggtactcgaacgacgaacggaaaccggaggaaccncccttataccgtaccttaattcttggatcgactacttacctacgttacgacgtaacggtcggtacctagttacgtacgtacacgccgtacgtaggtcgtactcggtacgtactagtttacctaccgtaccttcctacaacgtacctacccggaaacctaaccgtaggtaaccgtacggttaacgtaacgttaccgttacgtacgttaacttttaaaccttttaccgttaaccgtaaccgtaaaccttaaaaccttaaccgtttaaaacgtttaacccgtttaaccccggtttaacccggttacccttacccgggtaacccgtaaaccggtaaccgggtaaccgtaaccggttaccggtaaggtaaaccggttaaccggttaaccggtacggttaacgggttcggtacccgtaacggtccccttaaccgttcgtttaacccgtttagtttaccccttacgttaccccctttaaccccgg

SEQ ID NO: 241807 - DNA, 703 bp, Homo sapiens
  misc_feature: GYAE6OF02JOTIN.38.11.A11.1.454.CMB.1.raw
tcagtcgatcacgtcacgaccggtgctcgatttagctacgactgcaggggatcagacccagtcaggacacagcatggacatgagggtcctcgctcagctcctgggctcctgctgctctcgtttcccaggtgacagatgtgacagtccagatgacccagtctctatcctcactgtctgcatcgtggtagacgacagacgtccaccatctacgttggtcggggcgggtctaacggtactaacgccgttggtcgtacgtggtactcagtacaacgaaccgtaggaaccgacctatacgtacctaactcgttagactcgactacgtaccgtacttacgtaccgtaacgtcgggtacctacgtacgtacgtacgacgtccgacgtaggtacgtagtcggtagtacgtagttacttacgacctcgtacacgtactacgtaactacgtaacgacgtaccgtaagtacgtacttactacgtaacgttaacttacgttacgtaacgtaacctaaataaacttaaacgttaacctttaacccgtacccgttaaccgtacccgttaaccgggaaccgttaacgggaacctaaccgtaacgtaccggtaacgttaaaccggttaaccggtaaccggttaacggttccggtaaccgtaaccgttaacgtaaccgttacgttacgttaccctttacgtacctttcccgttaaccccg

SEQ ID NO: 241808 - DNA, 741 bp, Homo sapiens
  misc_feature: GYAE6OF02H8Z43.38.11.A11.1.454.CMB.1.raw
  modified_base (315)..(315): a, c, t, g, unknown or other
  misc_feature (315)..(315): n is a, c, g, or t
tcagtcgatcacgtcacgaccggtgctcgatttagctacgactgcagggggatcagacccagtcaggacacagcatggacatgagggtcctcgctcagctccgtgggctcctgctgctctgtttacccaggtgacagtatgtcgacatccgagatcgacccagtcctccattccctcactgtctacgctattcgtaggtaaggacaacgaggactccaacctatccgacgtttggccggggggacggtctaacggttacttaaccgcggttggttacgccgttgtactcgacgacaaacgaaccggaaggtaccnccctattacgtaccttattcgttcgatcgacctacttcctagtttcgaaacctacggtcggtacctagttcgtaggtacacggccgtacgtaggttaccgagtacgacgggtaacttacggttaacctttacacccgttactaccgtaacctacgtacccgaaacttaacggtacggaaccgtcgttaaggaccttagttaccgtacgttaatttaactttactacgtaacgtaaccctaaacgtttaaacttaacgttaaacccgtttaaccccgttacccgtaccgttaacggttaccgaacccggtttaaaacggccgttaaacggtacgttaaggacgttaaaacgttaacggtcgtaaggtttaccgcgttaaccgacgtaccgttacgttcgtttacctacgttacccgtacttccccgg

SEQ ID NO: 241809 - DNA, 710 bp, Homo sapiens
  misc_feature: GYAE6OF02G3YSV.38.11.A11.1.454.CMB.1.raw
tcagtcgatcacgtcacgaccggtgctcgatttagctacgactgcaggggatcagacccagtcaggacacagcatggacatgagggtcctcgctcagctcctgggctcctgctgctctgtttcccaggtgacagatgtgacatccagatcgacccagtcctccatccctcactgtctgctatcgtggtaggagacagacgtccaccatccacgtttgggccggggcggggctaacggttacttaaccgtaccgttggttcggccgttggtactcgagcgaacgaaaccgaagggaaacgacccctagttcgtaccctaattctttagatcgcacttcctactttacgacgtaaacgtcggggtaccctagttacgttacggttcaacggtccgaccgtaggtacggtacgttcggttacgggactacgttatttaccgtacttcctactacctacgtaccgaacctaaccgtagaacgtacctagtaaacgtatttacgtacgttacttaaagttttacgttaccgttacgtaaccctaaaccttaagttaaacttaaccttaacccgtttacccggttacctaaccggttacccgtaaccgtaaaccgggtactaaccgtacgtaggaacttaacggtaaacgtacgttacgtacggtcgttaccgacctaacctcgttacttacgttaccttacgttaccttaccccg

SEQ ID NO: 241810 - DNA, 720 bp, Homo sapiens
  misc_feature: GYAE6OF02IHRJM.38.11.A11.1.454.CMB.1.raw
  modified_base (129)..(129): a, c, t, g, unknown or other
  misc_feature (129)..(129): n is a, c, g, or t
  modified_base (303)..(303): a, c, t, g, unknown or other
  misc_feature (303)..(303): n is a, c, g, or t
  modified_base (678)..(678): a, c, t, g, unknown or other
  misc_feature (678)..(678): n is a, c, g, or t
tcagtcgatcacgtcacgaccggtgctcgatttagctacgactgcaggggatcagacccagtcaggacacagcatggacatgaggtcctcgctcagctccgtgggctctgctgctctgtttcccaggtnacagatgtacgacatccagatacgacccagtcctccatccctcactgtactgacacttcgttaggaacggagaccagtacgtccacctacttacctacgttcgggtccgggggaccgggtcctaaggttaacttaaacccgtccggttggggttcggtacccgttaggttaacncggaacgtaccgaacggtaaaacccgacgggaaaccttccccctaagtttacccgtaaccccttaatttccgtttagactaccgtctaaccgttccttaacgtttacgaaaccgtaaccggtcgggtacccctagttacgtacggttcaccggcgttaccgaaggtcgagttacggtaggcttaacgtcgtttccaccgtacctacacctacgaccgtaacccaacgtacgtacctacgtaagacgttacttcgtacgttaatttaatttacctacggtacaaccgtaataaaccgtattaaccgttaccgttacccgacttaccgtacggaccaaacggcctaccgagtcgaacttaacgtactacgtcgtacnccgtacgactaccgtacttacgtcttactcctaccttacccg

SEQ ID NO: 241811 - DNA, 616 bp, Homo sapiens
  misc_feature: GYAE6OF02GRWWD.38.11.A11.1.454.CMB.1.raw
  modified_base (236)..(236): a, c, t, g, unknown or other
  misc_feature (236)..(236): n is a, c, g, or t
tcagtcgatcacgtcacgaccggtgctcgatttagctacgactgcaggggatcagacccagtcaggacacagcatggacatgaggtcctcgctcagctcctggggctcctgctgctctgtttcccaggtgacagatgtgacatccagatcgacccagtctccatcctcactgtctgcatctgtaggagacagacgtccaaccatcacgttggcgggcgggctaacggtattaaccncgttggttcgacctggtatacgagcgaacgaaacgagggaaactcccctagtccgtaccctaattcgttagatgacacttcctacgtttcgacctaacggttcggtaccctatacgttaggtcacgcgaccgaggtcgtagtcggtaggactagttacttaccgacttccgtacaaccgtctacgaacctaacgtagaacgtcctaagtaactcttcgacgtattaacgtttactactacgaactaattaagttaacttaaccgttaccgttaccgttacccgtaccgttaccgaacgtacggaactaaccgtcgtaggtaactaacgtaacgtaagtcggtactacacgtccacgtctcttacttctacctactcccgg

SEQ ID NO: 241812 - DNA, 689 bp, Homo sapiens
  misc_feature: GYAE6OF02GKFNN.38.11.A11.1.454.CMB.1.raw
  modified_base (443)..(443): a, c, t, g, unknown or other
  misc_feature (443)..(443): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagactgtcgacatccagatcgacccagtctccatcctcactgtcctgcatcttaggaggagacagtacgtccaaccgtatccgtaacgttcgggtcgggggaccgggggtactaacgggttaacttaaccgtccggtttgggttcggtaccgtggttacctacgaacggacctaaacggaaacccgaaggggtaaaccctccccgttagttaccgttacccttaagtttccgttaggaactcgacttactcctacgttacgactaacggtcggtaccattcgtagtcacgcgacgtaggtcgtcgtcggngtaactagttacttcacttccaccactacgtacaccgtaacgtacgacgtaccgtagacgttacttctacgtacttaactttactacgaactacgtaaactaattaaccgttaacttacccggtttaccgtaccgtttaccggacgtaaccggaacggaaccgtacgtaacgtaggttacgtaaacgtaagtaccgtagtcggacttcgaccttaacgtcttccttacgtccttacgccttacccg

SEQ ID NO: 241813 - DNA, 941 bp, Homo sapiens
  misc_feature: GYAE6OF02GY87Z.38.11.A11.1.454.CMB.1.raw
tcagtcgatcacgtcacgaccggtgctcgatttagctacgactgcagggggagtcagacccagtcaggacacagcatggacatgagggtcctcgctcagctcctggggctcctgctgctctgttcccaggtgacagatgtagacactccagatcgacccagtcctccactcctcactgtctgcattcgtggtaggacacgagtacgtccaaccgtatccgtaccgttcggccgggggaccgggtaccgtaaccgggttaattaacccggtaccgttcgggttcggtcccgttaggttaactacggtacgaccgaaacggaaaacccggaagggtaaaccgtccccgtaacgttacccgttaccccttaaagtttccgtttacgacgttaccggaccttaccgttacccgtttagtttaccggaaccgtaaccgggttccggggtaacccctaacggtttaccggttacggttaccgaacggtacccgggtaccgtaggttacgggtaccgttaccggggtaacggtaacccgtaaggtttacctttacccgtaccgttacccgtaacccgaacccgtacgttaaacccggaaccccttaaaccggtaccggtaaacccgttaccggtaaacgtaacggttactttacccgtacggttaacctttaaacgtttttaccgttaagttaccccgtaaacctaaaacctttaagttaaaaccgttaaaccctttacccccggtttaacccgggttacccttaaaccccggggttaaccgtaacccggttaaacgggtaccctaacggtaaccgggttaaggtaaacccgtttaaaacggtaacccggtttaacgtacggggaccgttaaccggtacccggtaaccttacccggttactttacccggttacggttaacccctttaccgggttaccccttaccccgg

SEQ ID NO: 241814 - DNA, 584 bp, Homo sapiens
  misc_feature: GYAE6OF02GR0F6.38.11.A11.1.454.CMB.1.raw
  modified_base (284)..(284): a, c, t, g, unknown or other
  misc_feature (284)..(284): n is a, c, g, or t
  modified_base (386)..(386): a, c, t, g, unknown or other
  misc_feature (386)..(386): n is a, c, g, or t
  modified_base (575)..(575): a, c, t, g, unknown or other
  misc_feature (575)..(575): n is a, c, g, or t
tcagtcgatcacgtcacgaccggtgctcgatttagctacgactgcaggggatcagacccagtcaggacacagcatggacatgagggtcctcgctcagctcctggggctcctgctgctctgtttcccaggtgacagatgtgacatccagatgacccagtctccatcctcactgtctgcatctggtaggagacagacgtcaccatctacgttggtcggggcggggctaacggtattaaccgccgttggttcggccttggtactcgagcaagaaaccgagggaaccnccctagtccgtacctaatctttagatcgacacttcctactttgactaacgtcgggtaccatcgtagtcacgcgacagtgactcgaggatacgtattcactcncgactactcaacacgtgacgtcgtagtaagtcttacgtcgtacttaactttactactagaacctaaactaattataaccgttaccgttacccggtcttacccgtacggtaccgaacggtacctacgacgtagagtaacgtaacgaacgttgtacgactaccgactaccgtgttaccgttcgtcttaccncttaccccg

SEQ ID NO: 241815 - DNA, 724 bp, Homo sapiens
  misc_feature: GYAE6OF02JBGEA.38.11.A11.1.454.CMB.1.raw
  modified_base (180)..(180): a, c, t, g, unknown or other
  misc_feature (180)..(180): n is a, c, g, or t
  modified_base (209)..(209): a, c, t, g, unknown or other
  misc_feature (209)..(209): n is a, c, g, or t
  modified_base (283)..(283): a, c, t, g, unknown or other
  misc_feature (283)..(283): n is a, c, g, or t
  modified_base (538)..(538): a, c, t, g, unknown or other
  misc_feature (538)..(538): n is a, c, g, or t
  modified_base (685)..(685): a, c, t, g, unknown or other
  misc_feature (685)..(685): n is a, c, g, or t
tcagtcgatcacgtcacgaccggtgctcgatttagctacgactgcaggggatcagacccagtcaggacacagcatggacatgagggtcctcgctcagctcctggggctcctgcctgctcttcgtttcccgaggtcgacagatggtcgacatccagactagaccctgtacctccaagtccncacttgtctcgactatcgtggtaaggganacctagtacctaccaaccgtattccgacggttcgggtcgggggaccgggggactaaacccggttaattaacccncggttacggtgtaccttgggtactaccgagaacacggaaacgaaggtaacctaccccgtatccgttaccctaacttaccgttagactacgactactaccgtacttaggtacctaaacgggtcgggtacccgtagttacgtaccggttacgaccggtaccgtcgtaacgcggttacgaccgtttgggaaacgttagttaccgtttccaacttacccacgtaaccgacgttaaacccgaacacccgttaaggtaccncgttacgtaactacgttacctccggttaacttaataccgtttagtactaccgtaaataacgttactaacttacccggtttacccgctaaccggtccgtaacgaacggtaaccaacgtaccggtaagaccgttaagtaacgtaactgnggtactagaccactcgttacgtctactacgcccttaccg

SEQ ID NO: 241816 - DNA, 799 bp, Homo sapiens
  misc_feature: GYAE6OF02ISH3Z.38.11.A11.1.454.CMB.1.raw
  modified_base (146)..(146): a, c, t, g, unknown or other
  misc_feature (146)..(146): n is a, c, g, or t
  modified_base (220)..(220): a, c, t, g, unknown or other
  misc_feature (220)..(220): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
tcagtcgatcacgtcacgaccggtgctcgatttagctacgactgcaggggatcagacccagtcaggacacagcatggacatgagggtcctcgctcagctccgtgggctcctgctgctcttgtttacccaggtcgacagtatggtanacactaccgagtatcgaccagtcctacactcctcacgtgtctgcctatcgtagacgagacagtaacgtcaaccntctacggttcggcgggacgggtacaacggttaacttaaccggtcggttggttacggaccgttaggtaacgtacgtacggaaactaaccgggtaaaaaccggacggtaaaccgtcccgttaagttacctacccttaaattcgtttgaaacttcggacctaacgtacttaacgttacgaaccgtaacggtcggtacctagtacgtacgtancgtctaacggngtaggtacgtacgggacggactaacgtcttaccgtaacgtcgtaaaccctagaaccgttaacgtaaaccgtaaccgttaacggaaaccggttaccgttaaacgtaacgttacgtaaccgttaacgttaaactaaacggtttttacgtaaccgtactaaaacccgtaaataaccttaaagtaaactttaaaccccggtacccgtaacccgttaaccggtacccgggtaaacgaaaccggtaaccggtaacgaaacgttaacggtaacttaaaccggtaaacgggtaccttaagggtacggaaccttacggaaccttaccggaccgtacgttaccctaaggttacccaccgtttaaccccg

SEQ ID NO: 241817 - DNA, 792 bp, Homo sapiens
  misc_feature: GYAE6OF02JXZA4.38.11.A11.1.454.CMB.1.raw
  modified_base (129)..(129): a, c, t, g, unknown or other
  misc_feature (129)..(129): n is a, c, g, or t
  modified_base (135)..(135): a, c, t, g, unknown or other
  misc_feature (135)..(135): n is a, c, g, or t
  modified_base (152)..(152): a, c, t, g, unknown or other
  misc_feature (152)..(152): n is a, c, g, or t
  modified_base (413)..(413): a, c, t, g, unknown or other
  misc_feature (413)..(413): n is a, c, g, or t
  modified_base (510)..(510): a, c, t, g, unknown or other
  misc_feature (510)..(510): n is a, c, g, or t
  modified_base (630)..(630): a, c, t, g, unknown or other
  misc_feature (630)..(630): n is a, c, g, or t
  modified_base (638)..(638): a, c, t, g, unknown or other
  misc_feature (638)..(638): n is a, c, g, or t
tcagtcgatcacgtcacgaccggtgctcgatttagctacgactgcaggggatcgagacccagtcaggacacagcatggacatgagggtcctcgctcagctactgggctcctgctgcctatgttccagtnactagntgtgacataccagtacncgtaacccgagttccacctaccttaccgtacacttggtcctcgtacgtacgttacgtaggtacgggaacgacgtaggtaactccaacctcgttaccgtacggttggggacccgggaccggggtacttaaaccggtatttaacccgacggtttggtaaccggtccgtttagggaacttcgaacgggtaaccctaaaggaaaccggtaacggggtaaaccctccccgttaatacccgttttaccggaagtttccgttaagtcncggaccctaccggtttctaaacgggtctaaaccggtaacggttcccggaactacgttaggtacccgtaagcctacggggtaccttagggtaaccgtnttacggacgtaattaccgttactacccgtactacgtgaaccctacgtaactaccgtaacgtaagacgtaccggttatacgtacttgtaaactagttaacttcgtaacaattacaacgttnaaccgttntaccccgtactacgttaccggactaaaccgggtctaaccggaacgttaacgaacgtacgttaaaccggtacgtaaccggttcgtaaacgggtactaccggtaccggttaactaccgttaccggttacttacgtccgtttaacccgttaaccccg

SEQ ID NO: 241818 - DNA, 495 bp, Homo sapiens
  misc_feature: GYAE6OF01C6G7O.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtccccagtcaggttcagtggcagtggctctgggacagagttcactctcaccatcagcagcctgcagtctgagtatttgctagtttattactgtcagacaatataatagctggcctcgagttgctacttttggccgtaggggaccaagcgtggagatacaaacgaactggtggcgtcg

SEQ ID NO: 241819 - DNA, 503 bp, Homo sapiens
  misc_feature: GYAE6OF01CYH8K.35.85.H08.1.454.CMB.1.raw
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccccacctctcctgcagggccagtcagagtgttagcagcaacttagcctggtaccagcaagaaagttggccaggctccaggcctcctcattctttggtgtgtccactagggccntggtcnccagtcaggttcagtggcagtggctcgngggacagtagttcactctcaccatcagcagcctgcagtctgaagtatttgctagtttattactgtcagcaatataatagctggcctccgagttgctacgtttggccgtaggggaccaaggcgtaggagatacgaaaacgaagtggtggcgtcg

SEQ ID NO: 241820 - DNA, 493 bp, Homo sapiens
  misc_feature: GYAE6OF01DY89K.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctctgggacagagttcactctcaccatcagcagcctgcagtctgaagtatttgctagtttattactgtcagctaatataatagctggcctcgagttgctactttggccgaggggtaccaaggctaggagactacaaacgatgtgcgtacg

SEQ ID NO: 241821 - DNA, 495 bp, Homo sapiens
  misc_feature: GYAE6OF01CAHWU.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccagtagggccgctggtgtcccagtcaggttcagtgcagtggctcgtgggacagagttcactctcaccatcagcagcctgcagtctagagtatttgctagtttattactgtcagactaatataatagctggcctcgtagttgctactttggccgtagggaccaaggcgtaggagactacaaacgaactgtgcgtcg

SEQ ID NO: 241822 - DNA, 507 bp, Homo sapiens
  misc_feature: GYAE6OF01BMEBC.35.85.H08.1.454.CMB.1.raw
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttagcctggtaccagcagaaagttggccaggctccaggctcctnatctttggtntgtccactagggccnctggtcgtcccagtcaggttcagtggcagtggctcgtgggacagtagttcactctcaccatcagcacgcctgcagtctagaagtatttgctagtttattactgtcagcaatataatagctgtcctcgagttgctacgtttggccgtagggaccaaggtccgtaggacgagtaaccgaaacgtaagtggtggcgtacg

SEQ ID NO: 241823 - DNA, 569 bp, Homo sapiens
  misc_feature: GYAE6OF01B5K9K.35.85.H08.1.454.CMB.1.raw
  modified_base (326)..(326): a, c, t, g, unknown or other
  misc_feature (326)..(326): n is a, c, g, or t
tcagtacagatcgtcacgaccggtgctcgatttagtatcactcagtcggcggggaggaacgtgctcagtttaggacccagacggaaccatgggaagccccaggcgtcagtcttctcttcctcctgctagttctgggctacccagatatcactggagaaatagtgatgacgcagtctccaaccactctgtctgtgtctccgaggggacagagcccaccctctcctgcagggccagtcagagtgttagcagcaacttagcctggtaccagcaagaaagttggccaggctcccgggctcctcattctttggtgtgtccacgtagggccncgtgggtcgtcccagtcgaggttcagtggcagtggctcgtgggacaggtagttcactctcaccatcagcagcctgcagtctgaatatttgctagtttattactgtcagctaatataatagtcgtcggtcctccgtagttcgtaccttacgttttcgggaccgtaacgggggtacccaaaggtccggtagggaacgtaacgttaaccgaaaaccggtaacgttaggtcgggtccgtggtaaccc

SEQ ID NO: 241824 - DNA, 505 bp, Homo sapiens
  misc_feature: GYAE6OF01C1H99.35.85.H08.1.454.CMB.1.raw
  modified_base (285)..(285): a, c, t, g, unknown or other
  misc_feature (285)..(285): n is a, c, g, or t
  modified_base (311)..(311): a, c, t, g, unknown or other
  misc_feature (311)..(311): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctnattctttggtgtgtccactagggccncgtggtcgtcccagtcaggttcagtggcagtggctcgtgggacagagttcactctcaccatcagcagcctgcagtctagaagtagttttgctagtttattactgtcagcaattataatagctggcctcgtagtgtctacgtttggccgtacggggaccaaggcgtaggagtatacgaacgaactgtggcgtacg

SEQ ID NO: 241825 - DNA, 505 bp, Homo sapiens
  misc_feature: GYAE6OF01A593D.35.85.H08.1.454.CMB.1.raw
  modified_base (312)..(312): a, c, t, g, unknown or other
  misc_feature (312)..(312): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccnctggtgtcccagtcaggttcagtggcagtgctcgtgggacagagttcactctcaccatcagcagcctgcagtctgaagtatttgctagtttattactgtcagcaatataatagctggcctccgtagttcgctacgtttcggccgtaggggtaccaaggtcgtaggagaactacgaaacgactggtggcgtacg

SEQ ID NO: 241826 - DNA, 504 bp, Homo sapiens
  misc_feature: GYAE6OF01ESK0E.35.85.H08.1.454.CMB.1.raw
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (484)..(484): a, c, t, g, unknown or other
  misc_feature (484)..(484): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccacctctcctgcagggccagtcagagtgttagcagcaacttagcctggtaccagcagaaagttggccaggctccaggctcctcatctttggngtcgtccacgtagggcccgntggtcgtccccaggtccaggttcaggtggcagtggctcgtgggacagagttcactctcaccatcagcagcctgcagtctagaagtattttgctagtttattactgtcagctaatataatagctggcctccgagttgcctagtttcggccgtacgggtaccaaggctagganatacaaacgatggtgcgtcg

SEQ ID NO: 241827 - DNA, 536 bp, Homo sapiens
  misc_feature: GYAE6OF01B8CRT.35.85.H08.1.454.CMB.1.raw
  modified_base (306)..(306): a, c, t, g, unknown or other
  misc_feature (306)..(306): n is a, c, g, or t
  modified_base (323)..(323): a, c, t, g, unknown or other
  misc_feature (323)..(323): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggccaggctcccagctcctcattctttggngtcgtccactagggccntggtactcccagtcaggttcagtgcagtgctcgtgggacagtcgttcactctcaccatcagcacgctgcagtctagtaagtatttgacttagtttattactgtactagtactaattaataatagtcgttcggacccttcggtagttcgtacgttacgttttcgggaccgtaacggggacctaaggcgtagggaacgtaagtacgtaaaaccgg

SEQ ID NO: 241828 - DNA, 487 bp, Homo sapiens
  misc_feature: GYAE6OF01DFTLE.35.85.H08.1.454.CMB.1.raw
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (353)..(353): a, c, t, g, unknown or other
  misc_feature (353)..(353): n is a, c, g, or t
  modified_base (392)..(392): a, c, t, g, unknown or other
  misc_feature (392)..(392): n is a, c, g, or t
  modified_base (468)..(468): a, c, t, g, unknown or other
  misc_feature (468)..(468): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccactagggccnctggtntcccagtcaggttcagtggcagtggctctgggacngagttcactctcaccatcagcagcctgcagtctgaagtnttttgctagtttatactgtcagcaatataatagctgcctcgagttgctactttggccgtagggaccaagctagganatacaaacgatgtgctacg

SEQ ID NO: 241829 - DNA, 523 bp, Homo sapiens
  misc_feature: GYAE6OF01D4SVZ.35.85.H08.1.454.CMB.1.raw
  modified_base (310)..(310): a, c, t, g, unknown or other
  misc_feature (310)..(310): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccactagggccnctggtcgtcccagtcaggttcagtggcagtggctcgtgggacagagttcactctcaccatcagcagcctgcagtctgaagtatttgctagtttattactgtcagtctaatataatagcttcggcctaccgtagttcgtcgtacgttttgggaccgtaacggggtaccaaggtcgtagggagtaacgtacgaaaacgaacgtcggtggcgtacg

SEQ ID NO: 241830 - DNA, 518 bp, Homo sapiens
  misc_feature: GYAE6OF01C0C97.35.85.H08.1.454.CMB.1.raw
  modified_base (311)..(311): a, c, t, g, unknown or other
  misc_feature (311)..(311): n is a, c, g, or t
  modified_base (345)..(345): a, c, t, g, unknown or other
  misc_feature (345)..(345): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtctccaggggacagagccaccctctcctgcagggccagtcagagtgtagcagcaacttagcctggtaccagcaagaagttggccaggctcccaggcctcctcattctttggtgtgtccagtagggccnctggtctccagtcaggttcagtggcagtgctcgngggacagagttcactctcaccatcagcacgcctgcagtctagaagtagtttgactagtttattactgtacagtactaataataatagtctggtcctacgtagttgtcgtacgtttcggacgtacggggtaccaaggcgtagggaagagtacgaaacggactaggtggcgtacg

SEQ ID NO: 241831 - DNA, 492 bp, Homo sapiens
  misc_feature: GYAE6OF01ACEUS.35.85.H08.1.454.CMB.1.raw
  modified_base (489)..(489): a, c, t, g, unknown or other
  misc_feature (489)..(489): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggtcagtcagagtgttagcagcaacttagcctggtaccagcagaagttggccaggctcccaggctcctcatctttggtgtgtccactagggccgctggtgtcccagtcaggttcagtggcagtggctcgtgggacagagttcactctcaccatcagcagcctgcagtctgaagtattttgctagtttattactgtcagctaatataatagctggcctcgagttgctacgtttggccgtagggaccaaggctaggagatacaaacgactgtggntcg

SEQ ID NO: 241832 - DNA, 553 bp, Homo sapiens
  misc_feature: GYAE6OF01EBNMX.35.85.H08.1.454.CMB.1.raw
  modified_base (361)..(361): a, c, t, g, unknown or other
  misc_feature (361)..(361): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaaagttggccaggctcccaggctcctcattctttggtgtgtccacgtagggccgtctgggtcgtcccagtcaggttcaggtggcagtggctgtgggacagngttcactctacaccatcagcagcctgcagtctgaagtattttgctagtttattacttgtcagtactaataataatagtcgttacggccttaccgtagttgtccttacgttttcggacccgtaagggggtaacccaacggtccgtagggtaacgtaacgtacgtaaaacggtaacgttacggtggtcgtacgg

SEQ ID NO: 241833 - DNA, 509 bp, Homo sapiens
  misc_feature: GYAE6OF01CEEQM.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctcgtgggacagagttcactctcaccatcagcagcctgcagtctgaagtattttgctagtttattactgtacagtacaattataatagtactggtacctcgtagttgtctacgttttcggccgtacgggaccaggcgtaggagagtacaaacgtaatgtggcgtacg

SEQ ID NO: 241834 - DNA, 510 bp, Homo sapiens
  misc_feature: GYAE6OF01DDGR7.35.85.H08.1.454.CMB.1.raw
  modified_base (310)..(310): a, c, t, g, unknown or other
  misc_feature (310)..(310): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggccaggctccaggctcctcatctttggtgtgtccactagggccnctggtgtcccagtcaggttcaggtgcagtggctcgtgggacagagttcactcgtacaccatcagcagcctgcagtctgaagtattttgctagtttattactgtctagtacaatataatagtcgtgtccgtcgagttcgctacgtttggccgtaggggacctaaggcgtaggagtacgtacgaaacgagtagtgtctacgg

SEQ ID NO: 241835 - DNA, 480 bp, Homo sapiens
  misc_feature: GYAE6OF01ALT43.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccactagggccgctggtgtccagtcaggttcagtgcagtggctctgggacagagttcactctcaccatcagcagcctgcagtctgaagattttgctagtttattactgtcagcaatataatagctgcctcgagttgctactttggccgagggaccaggctagagatacaacgatgtgcgtg

SEQ ID NO: 241836 - DNA, 486 bp, Homo sapiens
  misc_feature: GYAE6OF01D7S6S.35.85.H08.1.454.CMB.1.raw
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
  modified_base (468)..(468): a, c, t, g, unknown or other
  misc_feature (468)..(468): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccactagggccgctggtntcccagtcaggttcagtggcagtggctctgggacagagttcactctcaccatcagcagcctgcagtctgaagtatttgctagtttatactgtcagtcaatataatagctggcctcgagttgctactttggccgaggggacaagcgtgganatacaaacgatgtgctcg

SEQ ID NO: 241837 - DNA, 489 bp, Homo sapiens
  misc_feature: GYAE6OF01C3X7Z.35.85.H08.1.454.CMB.1.raw
  modified_base (295)..(295): a, c, t, g, unknown or other
  misc_feature (295)..(295): n is a, c, g, or t
  modified_base (365)..(365): a, c, t, g, unknown or other
  misc_feature (365)..(365): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtntgtccactagggccgctggtacgtcccagtcaggttcagtggcagtggctctgggacagagttcactctnaccatcagcagcctgcagtctgaagattttgctagtttattactgtcagcattatgataactggcctcgtgacgttcgcgaaggaccgaaggtaggacgtcaacgactgtggactgcacgatcg

SEQ ID NO: 241838 - DNA, 498 bp, Homo sapiens
  misc_feature: GYAE6OF01ESLHP.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtgtccactagggccgctggtgtcccagtcaggttcagtggcagtggctcgtgggacagagttcactctcaccatcagcagcctgcagtctagaagtattttgctagtttattactgtcagcaatataatagctggcctccgagttgctacgtttggccgtaggggaccaaggcgtaggagatacaaacgaatgtggctcg

SEQ ID NO: 241839 - DNA, 495 bp, Homo sapiens
  misc_feature: GYAE6OF01ASCW6.35.85.H08.1.454.CMB.1.raw
  modified_base (314)..(314): a, c, t, g, unknown or other
  misc_feature (314)..(314): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagctaacttagcctggtaccagcagaaagttggccaggctcccaggctcctcgatctttggtgtgtccacttagggccnctggtgtcccagtcaggttcagtggcagtggctcgtgggacagagttcactctcaccatcagcagcctgcagtctgagattttgctagtttattactgtcagcaatagtaatagctggcctccgagttgctatttggcctaggggaccaaggctgggagactacaaacgaactgtggctgg

SEQ ID NO: 241840 - DNA, 514 bp, Homo sapiens
  misc_feature: GYAE6OF01CJQWC.35.85.H08.1.454.CMB.1.raw
  modified_base (312)..(312): a, c, t, g, unknown or other
  misc_feature (312)..(312): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccngtggtgtcccagtcaggttcagtggcagtggctcgtgggacagtagttcactctcaccatcagcagcctgcagtcgtgaagtattttgctagtttattactgtacagtacaatataaatagtctcggtcctccgtagttcgtctacgtttggccgtaggggaccaaggcgtaggagactacgaaacgaactggtggcgtacg

SEQ ID NO: 241841 - DNA, 516 bp, Homo sapiens
  misc_feature: GYAE6OF01DGQXS.35.85.H08.1.454.CMB.1.raw
  modified_base (306)..(306): a, c, t, g, unknown or other
  misc_feature (306)..(306): n is a, c, g, or t
  modified_base (367)..(367): a, c, t, g, unknown or other
  misc_feature (367)..(367): n is a, c, g, or t
  modified_base (404)..(404): a, c, t, g, unknown or other
  misc_feature (404)..(404): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggngtgtccactagggccgctggtgtcccagtcaggttcagtggcagtggctcgtgggacaggngttcactctcaccatcagcagcctgcagtctgaagtntttgctagtttattactgtacagtctattatgtataactggccttcggtggtaccgttcgggaccaaggggaccaagggtacggtaacgtaccgaagtaacgtggtggtacg

SEQ ID NO: 241842 - DNA, 495 bp, Homo sapiens
  misc_feature: GYAE6OF01A1D7B.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccactagggccgctgggtgtcccagtcaggttcagtggcagtggctctgggacagagttcactctcacatcagcagcctgcagtctgaagtattttgctagtttattactgtcagcaatataatagctggcctccgagttgctacgtttggccgtaggggaccaaggcgtaggagactacgaaacgatggtggctcg

SEQ ID NO: 241843 - DNA, 555 bp, Homo sapiens
  misc_feature: GYAE6OF01DCJJ8.35.85.H08.1.454.CMB.1.raw
  modified_base (446)..(446): a, c, t, g, unknown or other
  misc_feature (446)..(446): n is a, c, g, or t
tcagtacagatcgtcacgaccggtgctcgatttagtatcactcagtcgcgggggaggaactgactcagttaggacccagacggaaccatcggaaggccccagcgcagctctcttcctcctgctattctggctcccagtatatcactggagaaatagtgatgacgcagtctccaaccactctgtctgtgtctccaggggacagagcccaccgtctcctgcgagggccagtcagagtgttagcagcaacttagcctggtaccagcaagaaagttggccaggctcccgggctcctcattctttggtgtgtccgacgtagggcccgctggtcgtcccagtccaggttccagtggcagtggctcgtgggacagagttcactctcaccatacagcagcctgcagtctagaagtatttgctagtttattactgtcagactaattataatagtntcggcctaccggtagttgtcttactttcggccgtacggggtaaccctaagtccgtacgggaacgtacgtaaccgtaaacggtaacgttggtacggtccgtcggtacccg

SEQ ID NO: 241844 - DNA, 500 bp, Homo sapiens
  misc_feature: GYAE6OF01DGA6E.35.85.H08.1.454.CMB.1.raw
  modified_base (392)..(392): a, c, t, g, unknown or other
  misc_feature (392)..(392): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccactacgggccgctgggtcgtccccagtcaggttcagtggcagtgctcgtggacagagttcactctcacatcagcagcctgcagtctgaagtntttgctagtttattactgtcagcaatataatagctgccttcgagttcgtctacgtttggaccgtacggggaccaaggcgtaggagacgtacaaacgactgtggctacg

SEQ ID NO: 241845 - DNA, 513 bp, Homo sapiens
  misc_feature: GYAE6OF01B5ZVL.35.85.H08.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (510)..(510): a, c, t, g, unknown or other
  misc_feature (510)..(510): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctactctggctccgaggaaccactggagaaacagtgatgacgcagtctccagccatcctgtctgtgtctccagggganagagccaccctntcctgcagggccagtcagactattagtaccaattagcctggtatcagcagaaacctggtcaggctcccaggctcctcatctatggtgcatcccacagggccactggtatccccagccaggttcagtggcagtgggtctggggacaggagttcactctcaccatcagcagcctgcagtctgatgtattttgctagtttattactgtcagtctaattatgtaataactggtcctcggtggacgttcggaccgaaagggaccgaaggtaggaacgtaccgaacgaactggtcggctgcaccgtntcg

SEQ ID NO: 241846 - DNA, 498 bp, Homo sapiens
  misc_feature: GYAE6OF01DFG6G.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccactagggccgctggtgtcccagtcaggttcagtgcagtgctctgggacagagttcattctcaccatcagcagcctgcagtctgaatattttgctagtttattactgtcagtacaatataatagctaggtcctcgagttgtctacgttttggaccgtaggggaccaaggtctaggagatacgaaacgatgtgcgtacg

SEQ ID NO: 241847 - DNA, 535 bp, Homo sapiens
  misc_feature: GYAE6OF01A77AV.35.85.H08.1.454.CMB.1.raw
  modified_base (356)..(356): a, c, t, g, unknown or other
  misc_feature (356)..(356): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtcgtcccagtccaggttcagtggcagtggctctgggacagngttcactctcaccatcagcagcctgcagtctgaagtattttgctagtttattacttgtctagtacaattataagtagtctcggtcctaccggtagttgtaccgtacgtttcggaccgtacggggtaccaacggtcgtagggaacgtacgtaccgtaaacgaacgtcggtggtcgtacgg

SEQ ID NO: 241848 - DNA, 595 bp, Homo sapiens
  misc_feature: GYAE6OF01C6XJS.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgttagcagcaacttagcctggtaccagcagtaagttgccaggcctccaggcctcctctattcgtttggtgttcgtccacgtacgggccgtcgtggtcgtcccctaggtccagggttcaggtggcaggtggctcgtagggactaggacgtttcacttcctacacctactcgacgcacgccctgacctagtcgtagtaagtattttgcttagttttacttacgttcgtctagactaattaataagtacgtcgttcggtcccgtcggtagttcgtacgttacggtttacgggacccggtaacgggaccgtaacggcgttacgggaacgtaacgtaaccgaaacggtacggtcggtcgggtctacgg

SEQ ID NO: 241849 - DNA, 546 bp, Homo sapiens
  misc_feature: GYAE6OF01CRYFL.35.85.H08.1.454.CMB.1.raw
  modified_base (316)..(316): a, c, t, g, unknown or other
  misc_feature (316)..(316): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaacttagcctggtaccagcaagaaagttggccaggctccaggctcctcatctttggtgtcgtccacgtacgggccncgtggtcgtccccagtcgtaggttcagtgggcaggtggctcgtggggactaggacgttcactctcaccatcagcacgcctgcagtctagtagtatttgactagtttattactgtctagactaatataatagcgtggtcctcgtagttcgtctacgtttcggaccgtaacggggtaccaaggtcgttacgggaagtaacgtaaccgaaacgtaacgtaggtcggtcgtacg

SEQ ID NO: 241850 - DNA, 584 bp, Homo sapiens
  misc_feature: GYAE6OF01EFQOS.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggcctcccgaggcctcctcattcgttttgggtgtcgtcccacgtacgggcccgtcgtgggtcgtccccagttcgaggttcagtggcaggtggctcgtgggacagtagttcactctcaccatacagcgacgcctgcgagtcgtagtaagtagttttcgacgttagtttattacttgtactagtaactaattaattaagtacgtacgttcggtacctacggtagttcgtactacgttttacgggaccgtaacggggtaccgtaaggtccgtagggaacgtaacgtaacgtaaacggtaacgttggtggtcgtacgg

SEQ ID NO: 241851 - DNA, 545 bp, Homo sapiens
  misc_feature: GYAE6OF01EQGTJ.35.85.H08.1.454.CMB.1.raw
  modified_base (196)..(196): a, c, t, g, unknown or other
  misc_feature (196)..(196): n is a, c, g, or t
tcagtacagatcgtcacgaccggtgctcgatttagtatcactcagtcgcggggaggaactgctcagttaggacccagacggaaccatggaagccccagcgcagcttctcttcctcctgctactctggctccgaggaaccactggagaaacagtgatgacgcagtctccagccatcctgtctgtgtctccagggganagagccaccctctcctgcagggccagtcagactattagtaccaacttagcctggtatcagcagaacctggtcaggctccaggctcctcatctatggtgcatccaccgagggccacgtggtactccccagcccaggttcagtggcaggtgggtctgggacaggtagttcactctcaccatcagcagcctgcagtctgatgtatttgtctagtttattacttgtcagtactaatataatagtacgttcggtccctaccgtagttcgtccgttacgttttacgggaccgtaacggggaaccaaggtccgttagggaagtaacgtaaccgaaacgtaacgtcggtggcgtacg

SEQ ID NO: 241852 - DNA, 528 bp, Homo sapiens
  misc_feature: GYAE6OF01CNC9T.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggcctcctcattctttggtgtgtcccgacgtacgggcccgcgttgggtcgtcccagtcgaggttcaggtggcaggtggctcgtgggacagagttcactctcaccatcagcagcctgcagtctagaagtatttgctagtttattactgtcagctaattataatagctgccttcgtacgttgtacgtacgtttggaccggtagggaccaaggtcgtaggacgtagtaacgaaacgaacttcggtcgtgtcgg

SEQ ID NO: 241853 - DNA, 503 bp, Homo sapiens
  misc_feature: GYAE6OF01AJ5SQ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggccaggctccaggctcctcatctttggtgtgtccacgtagggccgctggtcgtcccagtcaggttcagtgcagtgctgtgggacagagttcactctcaccatcagcagcctgcagtctagaagtatttgactagtttattactgtcagtctaatataagtagtctggtcctccgtagttcgctacgtttcggccgtagggaccaagcgtaggagactacgaaacgactgtggctacg

SEQ ID NO: 241854 - DNA, 518 bp, Homo sapiens
  misc_feature: GYAE6OF01DNYI3.35.85.H08.1.454.CMB.1.raw
  modified_base (316)..(316): a, c, t, g, unknown or other
  misc_feature (316)..(316): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaaagttggccaggctcccaggctcctcattctttggtgtgtccacgtagggccgntggtcgtcccagtcaggttcagtggcagtggctcgtgggacagagttcactctcaccatcagcagcctgcagtctagaagtatttgactagttttattactgtcagactaataataatagtctcggcctacgtagttgtctacgtttggaccgtacggggtaccaaggtcgtaggagacgtacgaaacgagtggtggctacg

SEQ ID NO: 241855 - DNA, 524 bp, Homo sapiens
  misc_feature: GYAE6OF01A8G8G.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatcgtttggtgtcgtccacgtaggggcccgtctgggtcgtccccagtccagggttcaggtggcaggtggctcgtgggacaggagttcacgtctcaccatcagcagcctgcagtctgaagtatttgctagtttattactgtcagcaatataatagtctggtcctcgtagttcgctacgtttggaccgtaggggtacccaaggtcgtaggagtacgtacgaaacgtaatggtggctacg

SEQ ID NO: 241856 - DNA, 562 bp, Homo sapiens
  misc_feature: GYAE6OF01BM6AI.35.85.H08.1.454.CMB.1.raw
  modified_base (369)..(369): a, c, t, g, unknown or other
  misc_feature (369)..(369): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggcctccaggcctcctcattctttggtgtgtccacgtaggggcccgcttgggtcgtccccagtccagggttcaggtggcaggtggctcgtgggacagngttcactctcaccatcagcagcctgcagtctagaagtattttgctagtttattactgtacagactaattataagttacgtcgttcggcccttccgtaagttcgtaccttacgttttcgggacccgtaagggggtacccaaggtccgtagggaacgtaacgtaccgaaaacgtaaccgttggtcggtcgtacgg

SEQ ID NO: 241857 - DNA, 487 bp, Homo sapiens
  misc_feature: GYAE6OF01EK1TB.35.85.H08.1.454.CMB.1.raw
  modified_base (311)..(311): a, c, t, g, unknown or other
  misc_feature (311)..(311): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccnctggtgtcccagtcaggttcagtggcagtggctctgggacagagttcactctcaccatcagcagcctgcagtctgaagtattttgctagtttattactgtcagcaatataatagctggcctcgagttgctactttggccgtagggaccaagctaggagatacaaacgatgtgctcg

SEQ ID NO: 241858 - DNA, 521 bp, Homo sapiens
  misc_feature: GYAE6OF01BWC2Z.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaagttggccaggctcccaggcctcctcatctttggtgtgtccactagggccgctggtcgtccccagtcaggttcaggtggcagtggctcgtgggacagagttcactctcaccatcagcagcctgcagtctgaagtattttgctagtttattactgtctagactaatataatagcttggccctccgtagttcgtcttacgttttcggaccgtacggggacctaaggtcgtaggacgtagtacgtaaacgg

SEQ ID NO: 241859 - DNA, 503 bp, Homo sapiens
  misc_feature: GYAE6OF01CX7OS.35.85.H08.1.454.CMB.1.raw
  modified_base (356)..(356): a, c, t, g, unknown or other
  misc_feature (356)..(356): n is a, c, g, or t
  modified_base (498)..(498): a, c, t, g, unknown or other
  misc_feature (498)..(498): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccgaggctcctcatctttggtgtgtccacgtagggcccgcgtggtcgtcccagtcaggttcagtgcagtggctcgtggacngagtcactctcacatcagcagcctgcagtctgaagtatttgctagtttattactgtacagtcaatataatagtctggccctcgtagttgtctacgtttggccgtaggggaccaaggctaggagatacgaaacgtactggtgngtacg

SEQ ID NO: 241860 - DNA, 510 bp, Homo sapiens
  misc_feature: GYAE6OF01D756P.35.85.H08.1.454.CMB.1.raw
  modified_base (314)..(314): a, c, t, g, unknown or other
  misc_feature (314)..(314): n is a, c, g, or t
  modified_base (397)..(397): a, c, t, g, unknown or other
  misc_feature (397)..(397): n is a, c, g, or t
  modified_base (486)..(486): a, c, t, g, unknown or other
  misc_feature (486)..(486): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctccaggctcctcatctttggtgtcgtccacgtagggccncgtggtcgtcccagtcaggttcagtggcagtgctcgtggacagtgttcactctcaccatcagcacgcctgcagtctagaagtntttgcttagtttattactgtcagtctaatataatgtcgtcgcctacgtagttgcttacgtttggcgacgggtacaaggtcgtagggaanacttacgaaacgtatggtgctacg

SEQ ID NO: 241861 - DNA, 560 bp, Homo sapiens
  misc_feature: GYAE6OF01D8NTF.35.85.H08.1.454.CMB.1.raw
  modified_base (366)..(366): a, c, t, g, unknown or other
  misc_feature (366)..(366): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcattctttgggtgtcgtcccacgtacggggccgcttgggtcgtccccaggtcaggttcaggtggcagtggctcgtgggacnggagttcactctacaccatcagcagtcctgcagtctgaagtatttgcttagttttattacgtgtcagtctattagtagtaattaacgtcggccttcggtggtaccggttcggaccgtaacggggaaccgaagggttagggaacggtacccgaaacggtaacgttggtacgggactaggacccaccgtagttccg

SEQ ID NO: 241862 - DNA, 508 bp, Homo sapiens
  misc_feature: GYAE6OF01DDDR7.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttgccaggctccaggctcctcatctttggtgtcgtccacgtaggggccctcgtggtcgtcccagtcaggttcagtggcagtggctcgtgggacagagtcactctacacatcagcagctgcagtctagtagtatttgctagtttattactgtctagactaatataatagctcggtcctcgagttcgtctacgtttggaccgtagggaccaggtcgtaggagacgtacaaacgtatagtgtcgtacg

SEQ ID NO: 241863 - DNA, 571 bp, Homo sapiens
  misc_feature: GYAE6OF01C5BQG.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcacgggccagtcagagtgttagcagcaacttagcctggtaccagcagaaagttggccaggctccaggctcctcatctttggtcgtcgtccacgtacgggccgtcgttgggtcgtcccagttccgaaggtttcaggtggcaggttcggcttcgtggggacaggtacgttcactctcaccatcagcagctgcagtctagaagtattttgtagtttattacttgtacagtcaaattataatgtcgtcggtccctacggtagttgacctttacgtttcgggccgtaagggggaccctaaggtccggtaggaacgtacgttaacgaaaaccggtacgttggtacggtcgttcgaacccg

SEQ ID NO: 241864 - DNA, 598 bp, Homo sapiens
  misc_feature: GYAE6OF01C694Q.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaaagttggccaggcctcccgaggtctcctcattcgtttgggtgtgtcccacgttacggggcccgtctgggtcgtcccccgaggttccaagggtttcaggttcgggcctaggtcggcttcggtggggacaggagtttccacttcctaccgacctatccacgaccacgccgtgcgagtctaggtaagtattttgcgttagtttattacttgtacagtactaattaattaagtagtctcggtacccttacgtaattcgtactacgtttcgggacccgtaacggggtaaccaaggtccgtagggtagaacgtaaccgaaacgtaacgttggtcggtcgtacg

SEQ ID NO: 241865 - DNA, 524 bp, Homo sapiens
  misc_feature: GYAE6OF01CLLB2.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccactagggccgctggtgtcccagtcaggttcagtgcagtggctcgtgggacaggtagttcactcgtcaccatcagcagcctgcagtctgaagtattttgctagtttattactgtcagacaatataatagctggcctcgagttgctacgttttggacccgtaggggacccaaacggtcgttagggaacgtacgtaaccgaaacggaaccttggtggtcgtaccgg

SEQ ID NO: 241866 - DNA, 536 bp, Homo sapiens
  misc_feature: GYAE6OF01ARPMU.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttagcctggtaccagcagaagttggccaggctccaggctcctcattctttggtgtgtccacgtacgggccgcgtgggtcgtccccgagtcaggttcaggtggcaggtggctcgtgggacaggtacgttcactctacaccatcacgcacgcctgcgtagtctagaagtagtttgacttagtttatacgtgtacagactaatataagtagtcgtcgtcctacgtagttcgtcgttacgtttcggaccgtacgggaccaggtcgtaggagtacgtacgaaacgtactggtggtcgtacg

SEQ ID NO: 241867 - DNA, 503 bp, Homo sapiens
  misc_feature: GYAE6OF01DU30D.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcattctttggtgtcgtccacgtacgggccgcgtgggtcgtccccagtcaggttcaggtggcaggtggctcgtgggacagagttcactctcaccatcagcagcctgcagtctgaagtatttgctagtttattactgtcagctaatataatagctgcctcgagttgctacgtttggccgtagggaccaaggcgtaggagactacaaacgacgtgtgctcg

SEQ ID NO: 241868 - DNA, 509 bp, Homo sapiens
  misc_feature: GYAE6OF01DCRDW.35.85.H08.1.454.CMB.1.raw
  modified_base (353)..(353): a, c, t, g, unknown or other
  misc_feature (353)..(353): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaattagcctggtaccagcaagaaagttggccaggctccaggctccgtcatctttggtgtgtccacgtagggccgctggtgtccccagtcaggttcagtgcagtggctcgtggacngtagtcactctcacatcagcagcctgcagtctagaagtagtttgactagtttattactgtcagacaatataatagctcgcctcgtagttcgtcgtacgtttggaccgtacgggacgtaagcgtaggagaacgtacgaaacgtaagtgtggcgtacg

SEQ ID NO: 241869 - DNA, 560 bp, Homo sapiens
  misc_feature: GYAE6OF01EUU7L.35.85.H08.1.454.CMB.1.raw
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgccagggccagtcagagtgttagcagcaacttagcctggtaccagcagaaagttggccaggctcccaggcctcctcattcgtttggngttcgtcccacgtaggggccncgttggtcgtcccagtcaggttcaggtggcaggtgctcgtgggacaggtgttccactctaccaccatcagcacgcctgctagtctagatgtattttcgcttagttttattacgtgttcagtctagttatagtacgttaacgtcggtaccttcggtcggtaccgttccgggaccgtaacgggaccgtaagggtacggtaacgtaccgaaacgacgtggtacggactcgcgtaccgtacg

SEQ ID NO: 241870 - DNA, 541 bp, Homo sapiens
  misc_feature: GYAE6OF01DQQOQ.35.85.H08.1.454.CMB.1.raw
  modified_base (295)..(295): a, c, t, g, unknown or other
  misc_feature (295)..(295): n is a, c, g, or t
  modified_base (355)..(355): a, c, t, g, unknown or other
  misc_feature (355)..(355): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggngtgtccacgtagggccgctggtctcccagtcaggttcagtggcagtggctcgtggacagngttcactctcacatcagcagcctgcagtctagtagtatttgctagtttattactgtacagtactaattaattaagtacgtcgttcggtccgttccgtagttcgtcgttaccgttttcgggaccggtaacggggaacctaaggtcgtagggaacgtacgtaacgaaacgtaacgtggtggtcgtacg

SEQ ID NO: 241871 - DNA, 523 bp, Homo sapiens
  misc_feature: GYAE6OF01CLGZU.35.85.H08.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccagccatcctgtctgtgtctccagggganagagccaccctctcctgcagggccagtcagactattagaccaacttagcctggtatcagcagaaacctggtcaggctcccaggctcctcatctatggtncatccacagggccactggtatcccagccaggttcagtggcaggtgggtctgggacagagttcactctcaccatcagcagcctgcagtctgatgtatttgctagtttattactgtcagtctattatgtataacgtggccttcgtcggtacgttcggaccgtaagggaccctaagggtcggaaacgtaccgaaacggtaacgttacggtaggaccgttggcctaacccg

SEQ ID NO: 241872 - DNA, 542 bp, Homo sapiens
  misc_feature: GYAE6OF01B1VLU.35.85.H08.1.454.CMB.1.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctactctggctccgaggaaccactggagaaacagtgatgacgcagtctccagccatcctgtctgtgtctccaggggganagagcccaccctctcctgcagggccagtcagactattagtaccaacttgcctggtatcagcagaaacctggtcaggctcccaggctcctcatctatggtncatccaccagggccagtggtactcccagccaggttcagtggcagtgggtctgggacagagttcactctcacctatcagcagcctgcagtctgatgtattttgctagtttattactgtcagtctaattatgtatacgtcgtccgtccgtcggtacggttccggtaccggtaacgggaccggtaacgggtacggaacggtaccgaaccgtaacgtacggtcggtacgtacgaccacctacgtaccg

SEQ ID NO: 241873 - DNA, 512 bp, Homo sapiens
  misc_feature: GYAE6OF01C9J0U.35.85.H08.1.454.CMB.1.raw
  modified_base (290)..(290): a, c, t, g, unknown or other
  misc_feature (290)..(290): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaacttagcctggtaccagcagaagtgcagctccagctcncatcttggtgtgtccacgtacgggccgctggtcgtcccagtcaggttcaggtggcaggtcgctcgtgggacagagttcactctcaccatcagcagcctgcagtctgaagtatttgctagtttacttatcgtctacgactaatatagtagtctcggtcctcgtacgttcgtacttacgtttcggaccgtacgggaccaaggtcgtaggacgtagtcgtaaacg

SEQ ID NO: 241874 - DNA, 510 bp, Homo sapiens
  misc_feature: GYAE6OF01BBSSD.35.85.H08.1.454.CMB.1.raw
  modified_base (312)..(312): a, c, t, g, unknown or other
  misc_feature (312)..(312): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacgtagggccnctgggtcgtcccagtcaggttcagtggcagtggctctgggacaggagttcactctcaccatcagcacgcctgcagtctagtaagtatttgctagtttattacttgtcagactaatataatagtctcggcctcgtagttgctacgtttggccgtacgggaccaaggctaggagacgtacgaaacgaagtgtggcgtacg

SEQ ID NO: 241875 - DNA, 559 bp, Homo sapiens
  misc_feature: GYAE6OF01CZ2RM.35.85.H08.1.454.CMB.1.raw
  modified_base (295)..(295): a, c, t, g, unknown or other
  misc_feature (295)..(295): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggngtcgtccacgtagggccgctgggtcgtcccagtcaggttcagtggcagtgctcgtgggacaggtagttcactctcaccatcagcagcctgcagtctgaagtattttgactagtttattactgtcagtactaataataatagcgttggtacccttccggtagttcgtaccgttacgttttcgggacccgtaacgggggtaaccctaacgggtcgtacgggtaacgtaacgtaaccgaaaacggtaacgtagggtgggtcgtacgg

SEQ ID NO: 241876 - DNA, 516 bp, Homo sapiens
  misc_feature: GYAE6OF01AJJ8R.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacgtagggcctctggtcgtcccagtcaggttcagtggcagtgctcgtgggacagagttcactctcaccatcagcagcctgctagtctagagtatttgactagtttattactgtacagtactaatataatagtactggcctcgtagttgctacgtttcggaccgtaggggaccaaggtcgtaggagtacgtacgtaaacgaatggtggtcgtacg

SEQ ID NO: 241877 - DNA, 505 bp, Homo sapiens
  misc_feature: GYAE6OF01ETC2G.35.85.H08.1.454.CMB.1.raw
  modified_base (314)..(314): a, c, t, g, unknown or other
  misc_feature (314)..(314): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcattctttggtgtgtccacgtagggccnctggtgtcccagtcaggttcagtggcagtggctctgggacagagttcactctcaccatcagcagcctgcagtctgaagtattttgctagtttattactgtcagactaatataatagctcggcctccgagttcgctacgtttggccgtaggggaccaaggtctaggagatacgaaacgacgtggtgcgtacg

SEQ ID NO: 241878 - DNA, 557 bp, Homo sapiens
  misc_feature: GYAE6OF01A787B.35.85.H08.1.454.CMB.1.raw
  modified_base (515)..(515): a, c, t, g, unknown or other
  misc_feature (515)..(515): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcggccagaggtgcccctgaacctgaaggccaatgagacccaagacaggccaagtggttgtgagacccctgaggagctgggccctggtcccaggcagcgctggccctgctgctgctggtctggccagtggtcgcccagtcggcctgctcgcgcccaagtggttcgcacccgccgaaacggccggggaacccacggaccctgggacgccgtcgagttggaacgcgagcccgatcccagcccgtggccggaggcccgtggnggggccagggtaccaggcccctaaaggcccctaaacccccgg

SEQ ID NO: 241879 - DNA, 515 bp, Homo sapiens
  misc_feature: GYAE6OF01D4NBJ.35.85.H08.1.454.CMB.1.raw
  modified_base (449)..(449): a, c, t, g, unknown or other
  misc_feature (449)..(449): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttagcctggtaccagcagaaagttggccaggctcccaggctcctcatctttggtgtgtccactacgggccgctggtcgtcccagtcaggttcagtggcagtggctcgtgggactagagttcactctcaccatcagcagcctgcagtctgaacgtatttgctagtttattactgtcagctaaatataagtgtctggcctcgtagttcgnttaccgtttggccgtaggggtaacaaggcctagggagacgtaccgaaacgtaagtcggtggctacg

SEQ ID NO: 241880 - DNA, 502 bp, Homo sapiens
  misc_feature: GYAE6OF01A36XC.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacgtagggccgctgggtgtcccagtcaggttcaggtggcagtggctcgtgggacagagttcactctcaccatcagcagcctgcagtctgaagtattttgctagtttattactgtcagctaatataatagtctcggtcctccgagttcgctacgtttggccgtagggaccaaggctaggagagtacaaacgaatgtggctcg

SEQ ID NO: 241881 - DNA, 804 bp, Homo sapiens
  misc_feature: GYAE6OF01CJR26.35.85.H08.1.454.CMB.1.raw
  modified_base (288)..(288): a, c, t, g, unknown or other
  misc_feature (288)..(288): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttgcctggtaccagcaagaaagttggccaggcctccgaggcctccncattctttggtgtcgtccacgtagggcccgtcgttgggtcgtccccgaggttccgtaaggggtttccaggttcgggaccgtagggttcggccttcggtaggggaacctaggtacgtttcaccgttcttccaacctactccacgtaccgacggtccctacggtacgtacggttaccgttaggtaaacggtttaacgttttttcggaccttttaacgggttttttaacttttaaccgtttacggtttaaccgaacggttacttaaaacgtttaaacgtttaaagttaacggttaccgtttacccggggtaccccgttttacccggggttaacggttttaccgggttacccgttttaacccgggtttttttaccggggaccccggggttaaaaccgggggggttaaaccccctaaaacggggttacccggttaacggggtaaacgttaaaccggttaaacccggtaaaaacccgggttaaacgggttaccgggttacggggtacccggttaaccccggg

SEQ ID NO: 241882 - DNA, 509 bp, Homo sapiens
  misc_feature: GYAE6OF01C2YC6.35.85.H08.1.454.CMB.1.raw
  modified_base (313)..(313): a, c, t, g, unknown or other
  misc_feature (313)..(313): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccccaggctcctcatctttggtgtgtccactagggccnctggtgtcccagtcaggttcagtggcagtggctctgggacagagttcactctcaccatcagcagcctgcagtctgagtattttgctagtttattactgtcagacaatataatagcttggcctccgtagttcgtctacgttttggccgtacggggaccaaggtcgtaggagagtacaaacgactaggtggtcgtacg

SEQ ID NO: 241883 - DNA, 809 bp, Homo sapiens
  misc_feature: GYAE6OF01BNFQ6.35.85.H08.1.454.CMB.1.raw
  modified_base (178)..(178): a, c, t, g, unknown or other
  misc_feature (178)..(178): n is a, c, g, or t
tcagtacagatcgtcacgaccggtgctcgatttagtatcactcagtcggcgggggaggaactgctcagttaggacccagacggaaccatggaagccccagcgcagcttctctcctcctgcctatctggcctcccagatatcacgtggaacaaatgtgatgacgcagtcctccgaaccnctctgtctgtgtcctccgaggggccaggcgccacctctctgccagggtccagtccacgtagtcgttacgcagacctaacgttcgccgttaggtaccagccgtaaaggtaaacgttcggaccctaagggcctaccccgaggtcccttccgtactacgtttcgtttcggcgttccgtaccgaacggttacgggccccttcggttcgggtaccgtacccccgaggttcccgtagggttttaccaagggtttcggaccgtaagggttccgggactttccggggtacggaaacgtaacggggttcgttttaccccacggttacccttacccggaactacgttaccgtacgaccggacgtccccgttaggaccgtacggttaccgtaacggtaaaggttttcttttacgggaccctttaagggtttttaaacttccggttacgttaacccgtaggttaacctaaacgtttaaacgttaaggtaaccgttcgggttaaccggtccccgttaacggttacggttcgtaccggttttaaaccggtttccggggtaacccgggaacgggtaacctaacgggtcgttaacggggaacttaacggttaaccgaaaccggtacgtttcggacggtaccgtaccg

SEQ ID NO: 241884 - DNA, 504 bp, Homo sapiens
  misc_feature: GYAE6OF01BTRSE.35.85.H08.1.454.CMB.1.raw
  modified_base (289)..(289): a, c, t, g, unknown or other
  misc_feature (289)..(289): n is a, c, g, or t
  modified_base (339)..(339): a, c, t, g, unknown or other
  misc_feature (339)..(339): n is a, c, g, or t
tcagtacagatcgtcacgaccggtgctcgatttagtatcactcagtcgcgggggaggaactgctcagttaggacccagacggaaccatggaagcccagcgcagcttctcttcctcctgctattctggctccagatatcactggagaaatagtgatgacgcagtctccaaccactctgtctgtgtctccgaggggacagagccaccctctcctgcagggccagtcagagtgtagcagcaacttagcctggtaccagcagaagttggccaggctccagctctcatctttgntgtccacgtaggccgctggtctccagtctagttcagtggcaggtggctcngggacagagttcactctcacatcagcagcctagcagtctagaagtattttgcgtagtttattaacttgtactagtactaatataaagtagcttaggccctaccgagttcgctacgttttggaccgtagggacaaggctaggagatacgaaacgaactgtgctacg

SEQ ID NO: 241885 - DNA, 615 bp, Homo sapiens
  misc_feature: GYAE6OF01D27PC.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggcctcccgaggctcctcacttcgtttgggtgtcgtccgacgttaggggcccgcgttgggtcgtcccccgaggttcgaacgggtttccaggttggcctaggttgggccttcgtggggaaccagggtacgtttccacgttcctacacccatcagcacgcctgcagtcgtagagtagttttgtctagtttattacttgtctagtactaattataaagtagtacttcggtaccgttccggtacttcggggggtacttaccgttttcgggtaccggtaacggggtaaccgaacggtacggtacggaacgtaacgtaccgaaaacgtaacgtacggttggtcgtaccgg

SEQ ID NO: 241886 - DNA, 545 bp, Homo sapiens
  misc_feature: GYAE6OF01DNPOM.35.85.H08.1.454.CMB.1.raw
  modified_base (302)..(302): a, c, t, g, unknown or other
  misc_feature (302)..(302): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctggtaccagcaagaaagttggccaggctcccaggcctcctcacttctttggngttgtccacgtacgggccgctggtcgtccagtcaggttcagtggcaggtggctcgtgggacagtacgttcacttctacaccatcagcagcctgctagtctagaagtatttgactagtttattactgtacagtactaaatataagtagtacgtggtccctcgtagttcgtcttaccgtttcggaccggtacgggacccaaggtcgtagggaagacgtaacgaaacgtaagttcggtggtcgtcg

SEQ ID NO: 241887 - DNA, 501 bp, Homo sapiens
  misc_feature: GYAE6OF01AMPRO.35.85.H08.1.454.CMB.1.raw
  modified_base (311)..(311): a, c, t, g, unknown or other
  misc_feature (311)..(311): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccactagggccnctggtgtcccagtcaggttcagtgcagtgctctggacagagttcactctcaccatcagcagcctgcagtctagaagtattttgctagtttattactgtcagcaatataatagctgcctcgagttcgctactttcggccgtaggggaccaaggtcgtaggagtacgtacgaaacgtaactggtggtctacg

SEQ ID NO: 241888 - DNA, 556 bp, Homo sapiens
  misc_feature: GYAE6OF01DQHVV.35.85.H08.1.454.CMB.1.raw
  modified_base (302)..(302): a, c, t, g, unknown or other
  misc_feature (302)..(302): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctaggtaccagcaagaaagttggccaggctcccgaggctcctcattcgtttggngtcgtccacgtaggggcccgtctgggtcgtccccagtccgaggtttcaggtggcaggtggctcgtgggacagtagttcactctacacatcagcagcctgcagtctgatgtattttgacttagttttattacgtgtacagtctaatttatgtaacttacgtcggtcccttcggtggtaccggttccggaccgaacgggtaccgaagggttcggaaacgtaccgaacgtaacgtggtacggcgtacgccacgtacg

SEQ ID NO: 241889 - DNA, 528 bp, Homo sapiens
  misc_feature: GYAE6OF01DAQXK.35.85.H08.1.454.CMB.1.raw
  modified_base (295)..(295): a, c, t, g, unknown or other
  misc_feature (295)..(295): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaattagcctggtaccagcagaagttggccaggctcccaggctcctcatcttttggngtgtccacgtagggccgctcggtgtccccagtcaggttcagtggcaggtggctcgtgggacagacgttcactctcaccactcagcacgcctgcagtactgaagtatttgtctagtttatttacttgtctagtactaatataatagtctggtaccttcgtagttcgtctacgtttggaccgtaggggtaccaaggtcgtaggtagacgtacgaaacgaactcggtgtcgtacgg

SEQ ID NO: 241890 - DNA, 575 bp, Homo sapiens
  misc_feature: GYAE6OF01BQYV7.35.85.H08.1.454.CMB.1.raw
  modified_base (318)..(318): a, c, t, g, unknown or other
  misc_feature (318)..(318): n is a, c, g, or t
  modified_base (407)..(407): a, c, t, g, unknown or other
  misc_feature (407)..(407): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgtagcagcaacttagcctggtaccagcaagaaagttggccaggctccgaggcctcctcattctttggtgtgtccacgtacgggccncgtggtctcccgagtcaggttcaggtggcagtggctcgtgggacagtagttcactctcacatcagtcagcctgctagtctagaacgttntttgacttagtttatacgttgtacagtaactaagttaataagtacgtcgttcggtacccgttacgtacgttcgtaccgttacgtttacgggaccggtacgggtaaccgaggtcgtagggaaacgttacgtaaaccggtaaacgtacgttacggtccggtacgtaccgg

SEQ ID NO: 241891 - DNA, 518 bp, Homo sapiens
  misc_feature: GYAE6OF01DK86U.35.85.H08.1.454.CMB.1.raw
  modified_base (371)..(371): a, c, t, g, unknown or other
  misc_feature (371)..(371): n is a, c, g, or t
  modified_base (398)..(398): a, c, t, g, unknown or other
  misc_feature (398)..(398): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggcctcccgaggcctcctcattctttggtgtcgtccacgtagggcctcgtggtcgtcccagtcaggttcagtggcagtgctcgtggacagcgttcactcncacatcagcagctgctagtctagagtntttgctagtttatactgtcagtctaatataatacgcgtcgtcctcgagttcgcgttacgtttcggacggtacgggtacaaggtcgtaggacgtacgtacgaaacgtagtcggtgcgtacg

SEQ ID NO: 241892 - DNA, 617 bp, Homo sapiens
  misc_feature: GYAE6OF01BX1VR.35.85.H08.1.454.CMB.1.raw
  modified_base (292)..(292): a, c, t, g, unknown or other
  misc_feature (292)..(292): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctggtaccagcaaggaagttggccaggcctcccaggcctcctnacgttctttgggtgtcgtaccacgtacggggcccgtcgttcgggtcgtccccgtaggtccgtaggtttcaggttggcctaggtcggcttcggtgggacaggtacgttcaccgttctcaacctatcagccacgccgtcgacgtacgtcgtagtaagttattttgacttagttttattacgttgtacaagtactaaattataagttacgtcgtacggtcccttacggtagttcgtcgttaccggtttcgggacccggtaacggggtaaccgtaaggcgttagggaagtaacgtaaaccgaaacggtaaggttacggtggtcgtacgg

SEQ ID NO: 241893 - DNA, 518 bp, Homo sapiens
  misc_feature: GYAE6OF01CMY4O.35.85.H08.1.454.CMB.1.raw
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggcaggctccaggctcctcatctttggtgtcgtccacgtagggccncgtggtcgtcccagtcaggttcagtgcaggtgctcnggacngagttcactctcacatcagcagcctgcagtctagtaagtattttgctagtttattactgtacagtacaattagtaataggctacggcctacggtagttcgctacgtttggaccgtaggggaaccaaggcgtacgggagtacgtacgaaacgtagtggtggcgtacg

SEQ ID NO: 241894 - DNA, 566 bp, Homo sapiens
  misc_feature: GYAE6OF01DNR0T.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcaagaaagttggccaggctcccaggctcctcattcgttttgggtgtcgtcccacgtacggggcccgtcgtgggtcgtccccgaggtccagggtttcaggtggcaggtggctcgtggggacaggtagttcacttctacacctatcagcacgcctgcagtctagtaagtattttgcgttagtttacttactgtacagtactaattaataagtagctcggtccgtcgtagttcgtcttacgttttcgggaccggtaacggggtaccgaaggtcgtagggagaacgtacgaaacgtaagtggtggtcgtcgg

SEQ ID NO: 241895 - DNA, 654 bp, Homo sapiens
  misc_feature: GYAE6OF01BCXFM.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgtagcagcaacttagcctggtaccagcaagtaaagttggccaggcctccgaggctcctcattcgtttggtcgtgtccacgtacgggccgtcgtcgggtcgtaccccgtagttccgtaggtttaccaggttgggaccgaggttcggcgttcgtaggggaactaggtacgttccaaccttcgtaccaacctactacacgctacgtcctcgacgtagtcgtagaagttaagttttcgtacgttaacgttttattacgttcgttacgtacgtaactaattaacttaaagttacgtacgttacggtacccgttcgtacgttacggtacttaccggttttacgggacccggtaacggggtaaccgtaacggtcgtacgggtaaggaacgttaaacgtaaaccggtaacgttacggtcggtacgtaccgg

SEQ ID NO: 241896 - DNA, 623 bp, Homo sapiens
  misc_feature: GYAE6OF01CFWPF.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcgagggccagtcagagtgtagcagcaacttgccgtaggtaccagacaaggaaagttcggccaagggccctaccccgagggtccctccgtctagttcgttttgggtcgttcgtacccgtaacgtacggggcccgtcgtgggtcgtcccgaaggtcgtaggttcaggtcggctaggtggctcggtgggacagtcgttcacgttcacgaccatacagacacgcctgcgtagtcgtagtaagttactttgtactagtttattacgttgtacgtagtactaattaactaagtacgtcgttacggtacccttaccggtagttcgtacgttacggtttacggaccggtaacggggtaccaacggtccggtaggtaacgaacgtaaccgaaacgtaacgtcggtcggtcgtacgg

SEQ ID NO: 241897 - DNA, 558 bp, Homo sapiens
  misc_feature: GYAE6OF01DLBR2.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggccaggctcccaggctcctctatctttggtgtgtccacgtacgggccgtcgtgggtcgtccccgagtccgaggttcagtggcaggtggctcgtgggacaggagttcacgtcctcaccatcacggcacgcctgacagtctagaagtattttgacttagttttacttacttggtcagtaactaattaataatagcgttcggacccgttacggtagttcgacgttacgtttacgggaccgtaacggggaacctaaggccgtaggacgtaactacgaaaacgtagtggtagcgtacg

SEQ ID NO: 241898 - DNA, 495 bp, Homo sapiens
  misc_feature: GYAE6OF01DT2AV.35.85.H08.1.454.CMB.1.raw
  modified_base (295)..(295): a, c, t, g, unknown or other
  misc_feature (295)..(295): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggngtgtccatagggccgtctggtcgtcccagtcaggttcagtggcagtggctcgtgggacagagttcactctcacatcagcagcctgcagtctgaagtatttgctagtttatactgtcagcaatataatgactggcctcgagttgcgtactttggaccgtaggggaccaaggcgtaggagatacgaaacgatggtggctacg

SEQ ID NO: 241899 - DNA, 859 bp, Homo sapiens
  misc_feature: GYAE6OF01CY0SP.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccaccctctcctgcagggccagtcagagtgttagcagcaacttagcctaggtaccagcaaggaaagttggccaggcctccgaggcctccgtcattcgttttgggtgttcgtcccaacgtacgggcccgtcgtgggtcgtccccgtaggttccgtaaggtttccgaagggttcgggacgtaacgggtttcggggcctttccgggtacggggggtaaccacggggttaacggtttcccaaaccctttcccgtacctaacccgtaacttacccgtaacggacccgtaacggtccccgttacggtaccgtaacggtttaccgttagggtaaacgtttacgttttttacggtaccgtttaaacgggttttttaacttttaaccgtttacggttaccgtaaacggttaacctaaaagtttaaagttttaaaacgttaacgggtacccgtttacggggttacccccgtttacccggggttaacggttttaccgggttacccgtttaaacccgggtttttttacggggaaaccccggggttaaaccgggggggtaaaccccgtaaaacgggttacccgggttacggggtaaacggtaacggttaaaacccgtaaaaaccgggtaaacccggtttacgggttaccggggtaccgttaaccccgggg

SEQ ID NO: 241900 - DNA, 530 bp, Homo sapiens
  misc_feature: GYAE6OF01BZYEN.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttagcctggtaccagcagaagttggccaggctcccaggctcctcatctttggtgtgtccacgtagggccgtctggtcgtcccagtcgaggttcagtggcagtggctgtgggacaggagttcactctcaccatcagcagcctgcagtctagaagtattttgctagtttattacgtgtcagtactaattaataatagcgtaggcccgtcggtagttcgtcttacgtttcggaccgtaaggggtaccctaaggtcgtaggagtagtacgtaaaaccgg

SEQ ID NO: 241901 - DNA, 508 bp, Homo sapiens
  misc_feature: GYAE6OF01D6DID.35.85.H08.1.454.CMB.1.raw
  modified_base (355)..(355): a, c, t, g, unknown or other
  misc_feature (355)..(355): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcattctttggtgtgtccacgtagggccgctggtgtccccagtcaggttcagtggcagtgctcgtgggacngagttcactctcaccatcagcagcctgcagtctgaagtattttgctagtttattactgtcagacaatataatagctggtcctcgagttgctacgtttggccgtacggggaccaaggtcgtagggagaacgtacaaacgaactggtggtcgtcg

SEQ ID NO: 241902 - DNA, 510 bp, Homo sapiens
  misc_feature: GYAE6OF01CSSO5.35.85.H08.1.454.CMB.1.raw
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtgctcgngggacngagttcactctcaccatcagcagcctgcagtctgaagtattttgactagtttattactgtacagctaatataatagcgtggccctcgagttcgctacgtttggacccgaggggacccaaggtccgtagggagacgtacgaaacgattggtggctacg

SEQ ID NO: 241903 - DNA, 533 bp, Homo sapiens
  misc_feature: GYAE6OF01A80KL.35.85.H08.1.454.CMB.1.raw
  modified_base (420)..(420): a, c, t, g, unknown or other
  misc_feature (420)..(420): n is a, c, g, or t
  modified_base (521)..(521): a, c, t, g, unknown or other
  misc_feature (521)..(521): n is a, c, g, or t
tcagtacagatcgtcacgaccggtgctcgattttagtatcactcagtcggcgggagaggctctggggaggtaactgctcagttaagggaacccgagacggaaccatggaagccccacgccgccagccttctcttcctcctgctagttctgggcctaccgagatatcactggagaaatagtgatgacgcagtctccaaccactctgtctgtgtctccgaggggacagagccaccctctcctgcagggccagtcagagtgttagcagcaacttagcctggtaccagcagaagttggccaggctcccaggcctcctcattctttggtgtgttccacgttagggccgcgtggtcgtcccgagtccaggtttcaggtggctagtggctgtgggacagagttcactctcacatcagcacgcctgcngtctgaagtattttgattagtttattactgtctagactataagtatagctggcctcggtagttcgtcttacgtttcggacgtacgggacctagcgtagganagtacgaaacgg

SEQ ID NO: 241904 - DNA, 516 bp, Homo sapiens
  misc_feature: GYAE6OF01ELGH1.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagtggccaggctcccaggctcctcatctttggtgtgtccacgtagggccgctgggtcgtcccagtcaggttcaggtggcaggtggctcgtggggactaggagttcacttctcaccatcagcacgcctgcagtctagaagtattttgctagtttattactgtcagactaatataatagctgcctcgtagttgcttacgtttggccgtaggggaccaaggcgtaggaagacgtacgaaacgaattggtggcgtacg

SEQ ID NO: 241905 - DNA, 531 bp, Homo sapiens
  misc_feature: GYAE6OF01AIXPJ.35.85.H08.1.454.CMB.1.raw
  modified_base (311)..(311): a, c, t, g, unknown or other
  misc_feature (311)..(311): n is a, c, g, or t
  modified_base (355)..(355): a, c, t, g, unknown or other
  misc_feature (355)..(355): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggccaggctcccaggctcctcatctttggtgtgtccactagggccnctggtcgtcccagtcaggttcaggtggcagtggctcgtgggacngagttcactctcaccatcagcagcctgctagtctagaagtattttgctagttttattactgtacagactaatataatagcttaggcccttcgtagttcggcttacgtttcgggaccgtacggggtaccaacggtcgtacggagtacgtaccgaaacggaagtcggtcggcgtaccg

SEQ ID NO: 241906 - DNA, 575 bp, Homo sapiens
  misc_feature: GYAE6OF01B9UGI.35.85.H08.1.454.CMB.1.raw
  modified_base (408)..(408): a, c, t, g, unknown or other
  misc_feature (408)..(408): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggcagtcagagtgtagcagcaacttagcctaggtaccagacaagaaagttggccaggcctccaggcctcctcattctttggtgtcgtccacgtacgggccgcgtggtcgtcccagtcaggttcaggtggcaggtggctcgtgggacagtagttcactctcaccatcagcacgtcctgcagtctgaagtnttttgcttagtttattacgtgtaccgagtactaaattactaaatacgtacgttcggtaccgttaccggtagtttcgacgtttaccgttttgggaacccgtaacggggaccctaaggccgttaagggaacgtaacgtacgaaaaccggtaatcgggtcggcgtaacgg

SEQ ID NO: 241907 - DNA, 563 bp, Homo sapiens
  misc_feature: GYAE6OF01BS2T0.35.85.H08.1.454.CMB.1.raw
  modified_base (541)..(541): a, c, t, g, unknown or other
  misc_feature (541)..(541): n is a, c, g, or t
  modified_base (556)..(556): a, c, t, g, unknown or other
  misc_feature (556)..(556): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctggtaccagcaagaaagttgccaggctccgaggcctcctcattcgtttggtgtcgtccacgtacgggcccgcgttgggttcgtccccgaggtccgtaagggtttcaggtggcctaggtcggctacgtggggaacaggtagttccacgttctcaaccctatcaagcgacgtcctgcgtacgttcgaaggtaagtttgttttgacgtttaagtttactacgtgtacagtactaaatataagtcgcgtacgcctacgtgtcgtcttacgttcggaccgtaggtacagtcgaganactacaacgagtcgngtctacg

SEQ ID NO: 241908 - DNA, 530 bp, Homo sapiens
  misc_feature: GYAE6OF01CV635.35.85.H08.1.454.CMB.1.raw
  modified_base (319)..(319): a, c, t, g, unknown or other
  misc_feature (319)..(319): n is a, c, g, or t
  modified_base (356)..(356): a, c, t, g, unknown or other
  misc_feature (356)..(356): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctgggtntccccagtcaggttcagtggcagtggctcgtgggacngagttcactctcaccatcagcagcctgcagtctgaagtatttgctagttttattactgttcagtactaatattaaatagcttcggtcctccggtagttcgcttacgttttggcccgtaacggggtaccaaggtcgtaggagaacgtacgaaacgaacgttcggtgggtcgtacg

SEQ ID NO: 241909 - DNA, 610 bp, Homo sapiens
  misc_feature: GYAE6OF01CPNMC.35.85.H08.1.454.CMB.1.raw
  modified_base (216)..(216): a, c, t, g, unknown or other
  misc_feature (216)..(216): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagngggaccagggcaccgtcctccagggagcccatgctgcaagtcggccagaggtgccctgaacctgaaggccaatgagaccaagacaggccaagtcgggttgtgagaccctgaggagctgggcctggtccaggcagcgctcggccctgctgctgctggtctggccatcggtcgcccagtcggcctcgctcgccgccgaagtcggttcgccgaccgacgaaacggccggggaaccccacggaccccgtagggaccgtacccgtcgaacggttacgggaacgtccgaacggtcccggacgtcccggacgtcccggtacgggacccgggacggtccggtacgggtccgggacgtccgggtaccgaccggaccccgaaccgggtacccccgaaaccccgg

SEQ ID NO: 241910 - DNA, 506 bp, Homo sapiens
  misc_feature: GYAE6OF01A9D9G.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcattctttggtgtgtccacgtagggccgcgtggtcgtccccagtcaggttcaggtggcaggtggctcgtgggacaggagttcactctcaccatcagcagcctgcagtctgaagtattttgctagtttattactgtcagctaatataatagctggcctcgagttgctacgtttggccgtaggggaccaaggcgtaggagatacgaaacgatgtggcgtcg

SEQ ID NO: 241911 - DNA, 493 bp, Homo sapiens
  misc_feature: GYAE6OF01AKMO7.35.85.H08.1.454.CMB.1.raw
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (392)..(392): a, c, t, g, unknown or other
  misc_feature (392)..(392): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgntggtntcccagtcaggttcagtggcagtggctctgggacagagttcactctcaccatcagcagcctgcagtctagaagtntttgctagtttattactgtcagcaatataatagctgcctcgagttgctacgtttggccgtacggggaccaaggctggagatacaaacgaactgtggctacg

SEQ ID NO: 241912 - DNA, 495 bp, Homo sapiens
  misc_feature: GYAE6OF01CDJWA.35.85.H08.1.454.CMB.1.raw
  modified_base (312)..(312): a, c, t, g, unknown or other
  misc_feature (312)..(312): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccnctggtgtcccagtcaggttcagtggcagtggctctgggacagagttcactctcaccatcagcagcctgcagtctgaagtattttgctagtttattactgtcagcaatataatagctgcctcgtagttcgtctacgtttggccgtagggaccaaggcgtgagatacaaacgaactgtggctacg

SEQ ID NO: 241913 - DNA, 527 bp, Homo sapiens
  misc_feature: GYAE6OF01B4Z1Y.35.85.H08.1.454.CMB.1.raw
  modified_base (364)..(364): a, c, t, g, unknown or other
  misc_feature (364)..(364): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacgtaggggcccgtctgggtcgtccccagtccaggttcaggtggcagtggctcgtgggacagngttcactctcaccatcagcacgcctgcagtctagaagtattttgcttagtttattacttgtcagctaatataatgtctggcctcgtagttgtcttacgtttcggaccgtacggggtacccaaggtcgtagggaagacgtacgaaacgtactggtggtctacgg

SEQ ID NO: 241914 - DNA, 685 bp, Homo sapiens
  misc_feature: GYAE6OF01A0OQE.35.85.H08.1.454.CMB.1.raw
  modified_base (366)..(366): a, c, t, g, unknown or other
  misc_feature (366)..(366): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcaagaaagttggccaggcctcccgaggcctcctcattcgtttggtgtcgtccacgtacgggcctcgtggtcgtccccaggtcaggttcaggtggcaggtcggcttcgngggacaggtagtttccacgttctaccgacctatccgagccacggcccttagccgtagttcctaggtattacggttatttttcgacgtttaacgttttacttacgttacgttacgtaaggtaccttaagtttacgttagtaacgtttaaccgttcgggtaccccgttccggttacgggtacccgggtttaccgggaacccggttaaaccggggtaacccggtaaagggggttaaccgggtaaaccgggttaaccccgtaaaaccgggtaaccgttcggggttacgggtacggttaccggtacccgtaacccggttaaccg

SEQ ID NO: 241915 - DNA, 523 bp, Homo sapiens
  misc_feature: GYAE6OF01C4T2V.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccaggggacagagccaccctctcctgcagggccagtcagagtgttagcagcaacttagcctggtaccagcaagaagttggccaggcctcccaggcctcctcattcgtttggtgtcgtccacgtacggggccgtcgtgggtcgtcccgagtcgagggtttcaggtggcaggtggctcgtggacagtagttcactctcacatcagcagcctgcagtctagtaagtatttgctagtttattactgtcagactaatataatagtctcggtcctcgagttgtctacgtttggaccgtacgggacaggcgtaggagactacaaacgtacgtgtggtcgtacg

SEQ ID NO: 241916 - DNA, 497 bp, Homo sapiens
  misc_feature: GYAE6OF01AHJ9L.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtcgtccacgtagggccgctggtcgtcccagtcaggttcagtggcagtggctcgtgggacagagttcactctcaccatcagcagcctgcagtctagaagtattttgactagtttattactgtcagcaatataatagctgcctcgagttgctacgtttggccgagggaccagctggagacgtacaaacgaactggtgtgtcg

SEQ ID NO: 241917 - DNA, 502 bp, Homo sapiens
  misc_feature: GYAE6OF01ALEXB.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggccaggctccaggctcctcatcttggtgtgtccactagggcccgctggtcgtcccaggtcaggttcaggtggcaggtggctcgtgggacagagtttcactctcaccatcagcagcctgcagtctagagtattttgctagtttattactgtcagtcaatataatagctggcctcgagttgcttacgtttggccgtaggggaccaggcgtggacgatacgaaacgaactggtggctcg

SEQ ID NO: 241918 - DNA, 585 bp, Homo sapiens
  misc_feature: GYAE6OF01EV1YE.35.85.H08.1.454.CMB.1.raw
  modified_base (305)..(305): a, c, t, g, unknown or other
  misc_feature (305)..(305): n is a, c, g, or t
tcagtacagatcgtcacgaccggtgctcgatttagtatcactcagtcgcgggggaggaactgcgtcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcaagaaagttggccaggcctcccgaggcctcctcattcgttttggngttcgtcccacgttacggggccctgttgggtcgtccccaggtccgagggtttcaaggttcggctaggtgggtctcgtggggactaggtacgtttcacttctacacctatcagcagcctgcagtctagaagttattttgacttagttttacttacgtgttcagtactaaattattaagtagtcgttacggcccttacggtagtttcgacttacgtttcgggacccgtaaggggtaccctaaggtcgtagggaatacgtacgaaacgagttggtgctaccgg

SEQ ID NO: 241919 - DNA, 604 bp, Homo sapiens
  misc_feature: GYAE6OF01B8YY8.35.85.H08.1.454.CMB.1.raw
  modified_base (199)..(199): a, c, t, g, unknown or other
  misc_feature (199)..(199): n is a, c, g, or t
  modified_base (290)..(290): a, c, t, g, unknown or other
  misc_feature (290)..(290): n is a, c, g, or t
  modified_base (365)..(365): a, c, t, g, unknown or other
  misc_feature (365)..(365): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctactctggctccgaggaaccactggagaaacagtgatgacgcagtctccagccatcctgtctgtgtctccgaggggganagagccaccctctcctgcagggccagtcagactattacgaccaattagcctgtatcagcaagaaacctggtcaggcctccgaggcctcctntatttctttggtctcgtcccagtacggggcctcgttggtcgcccagtcgaggttcaggtggctaggtggcttcgngggacaggtacgttcactctacaccgtatccagcacgcctgactagtacgtagtaacgttagtttacgtacgttagtttatttacgtacgttacagtaactaaattaattaagtacgtacgttacggtaccttacgtacgttacgacgttacgttttacggaccggtaacgggaccgtaaggtcgtaggaacgtacgttaaccgaaacgtaacgttaggtaggtacgtcgacgtaaccg

SEQ ID NO: 241920 - DNA, 598 bp, Homo sapiens
  misc_feature: GYAE6OF01BYPKI.35.85.H08.1.454.CMB.1.raw
  modified_base (326)..(326): a, c, t, g, unknown or other
  misc_feature (326)..(326): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccacctctcctgcagggccagtcagagtgttagcagcaattagcctggtaccagcaagtaaagttggccaggctaccccaggcctccgtcattccgtttggtcgtcgtccacgtagggccgtntggtcgtccagtcgacggttcagtcggcaggtggctcgtggggactaggtagttcactcgtacaccgtatcagcacgtccgtgcgacgtacgtacggtaagttattttagtcgttaagtttacttacgttgtacgtagtactaagttaacttaaatagtaccttacggtccttaccgtacgttcgacgtttccggttttacggaccggtacggggtaaccaaggtccgtagggaagtaacgtaaccggaaacgtaacgttggtcgtcgtacg

SEQ ID NO: 241921 - DNA, 735 bp, Homo sapiens
  misc_feature: GYAE6OF01B19AO.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttgcctggtaccagcagaaagttgccaggctcccgaggctcctcattcgtttggtgtcgtccacgtacggggcccgtcgtgggttcgtccccctaaggttccgtaagggtttccaagggttcgggaccgtaaggttcgggccttacggttagggggaacccagggtacggtttccaaccgttccctaccaaccctactccgtaacggccgaacggccccttggcctaaggttccgtaggtactttggttaagtttttcgacgtttaaggtttttaactttacgttaggttccaaggtaccttaagttttaacgtagttaacctttaaaccgtcgggttaccccgttacccgggttacggggttaacccggtttccgggaacccggtaaaacgggggtaaccccgtaaaggggttaccgggtaaaacggttaccccgtaaaaccggtaaccgttcgggttacgggaccttcgggtacccgtaacccgttaaccg

SEQ ID NO: 241922 - DNA, 608 bp, Homo sapiens
  misc_feature: GYAE6OF01EA4FB.35.85.H08.1.454.CMB.1.raw
tcagtacagatcgtcacgaccggtgctcgatttagtatcactcagtcggtcgggggaggaactgctcagttaggacccagacggaaccatggaagccccagcgcagcttctcttcctcctgctattctggctcccagatatcacttggagaaatagtgtatgacgctagttctccaaccactctgtctgtgtctccaggggcaggagcccaccctcgtcctgcgacgggccagtcgagagtgttagcagctaacttagcctggtaccagcagaaagttgaccaggctccaggctcctcgacttcgtttgggtcgtcgtccgacggtacgggcctcgttgggtcgtccccgagtcctaagggttcaggttcgctaggtcggcgttacgtagggaactaggtacgttcaaccttctaccgaacctatcacgccagtcctagctagtctagtaagtatttcgacttacgtttacttacttgtctaagactaatataagtcgtacgtcgtaccgtcggtacgttaggtacttacgtttcgggaccgtacggggtaaccaaggtcgtacggaacgtacgtaaccgaaaccgtaagttcgggtcggtcgtacgg

SEQ ID NO: 241923 - DNA, 729 bp, Homo sapiens
  misc_feature: GYAE6OF01CY4SH.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagagccaccctctctgcagggccagtcagagtgtagcagcaacttagcctggtaccagacagaaagtcggccaggcctaccgaggcctcctcattcgtttggcgtgtccgacgtacggggccgtcgtcgggtcgtccccgtaaggtccgtaggtttccgaaggtcggccgtaggttcgggcttacggtggggaacctaaggtacggtttccaacgttccttaccaaccgtaactccgaacgcctaacggcccgtgaccgtagtaccgtagtaaaggttatttttacgacgtttaagtttttaacgtttaccgtagtttaccgaaggtacctaaaagtttaacgttaaacgtacggtacccgttacgggtaccccttaccgggttaagtttccggtaaccgtttaccgggttttaccgggaacccgggtaaacggggggtaacccctaaacggttccgggtaaacgggtaacgttaaacgttaaacccggaaaaacgggttaacccgtttggggtaacgggtccgttaacccgg

SEQ ID NO: 241924 - DNA, 653 bp, Homo sapiens
  misc_feature: GYAE6OF01DHTYT.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccaccctctcctgcagggccagtcagagtgttagcagcaacttgcctaggtaccagcaaggaaagttggccaggcctcccgaggcctcctcattcgtttggtgtcgtccacgtacgggccgtcgtggtcgtcccgagtcgaggttcaggtggcaggtggctcgtgggactagtagttcacttctacaccatacagcacgccgtgctacgtactagaagttagtttgacgttagttttattacgttagtacgtacgtacgtaaacttaagttaacgttaagtaccgttacgggtacccgttaccggtaacggtttacggtaccgttaaccggtttttaccgggacccggtaaacgggggtaacccgtaaacggtaccggttaggggaaacggttaaaccgttaaaccgaaaacggttaaaccggttacgggttacgggtaccgttaacccgg

SEQ ID NO: 241925 - DNA, 237 bp, Homo sapiens
  misc_feature: GYAE6OF01B971Q.35.85.H08.1.454.CMB.1.raw
  modified_base (215)..(237): a, c, t, g, unknown or other
  misc_feature (215)..(237): n is a, c, g, or t
tcagtacagatcgtcacgaccggtgctcgatttagtatcactcagtcgcggggggaggaactgctcagttaggacccagacggaaccatggaagccccagcgcagcttctcttcctcctgctattctggctcccaggaactgtggctgcaccatctgtcttcatcttcccgccatctgaacgatctgtactgagcgggctggcaaggcgcatagnnnnnnnnnnnnnnnnnnnnnnn

SEQ ID NO: 241926 - DNA, 579 bp, Homo sapiens
  misc_feature: GYAE6OF01CFMZQ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagagccaccctctcctgcagggccagtcagagtgtagcagcaacttagcctaggtaccagacaagaaagttggccaaggcctccccgaaggccttaccgtctattccgtttggtgtcgtccaacgtaggggcccgtgtgggttcgtcccaggtcaggttcaggtggcaggtggctcgtgggaactagacgtttcacgtctacacctatcagcagcctgcagtctgatgtatttgctagtttattactgtacgagtacgtatttatagtaactaacgttcggtacccttccggtggtaccgttccggtaccgaacgggtaccgaagggtaggtaacgtacccgtaaacggtaacgtcggtagggtcctacgtccgaccgtacg

SEQ ID NO: 241927 - DNA, 513 bp, Homo sapiens
  misc_feature: GYAE6OF01DJ5RX.35.85.H08.1.454.CMB.1.raw
  modified_base (312)..(312): a, c, t, g, unknown or other
  misc_feature (312)..(312): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacgtagggccncgtggtcgtcccagtcaggttcagtggcagtggctcgtgggacaggagttcactctcaccatcagcacgcctgcagtctgaagtatttgctagtttattactgtcagacaatataatagctggtcctacgagttcgtctacgttttggcccgtacggggaccgaaggcgtaggagtagtacaaacgaacgtgtggcgtacg

SEQ ID NO: 241928 - DNA, 537 bp, Homo sapiens
  misc_feature: GYAE6OF01E35LH.35.85.H08.1.454.CMB.1.raw
  modified_base (312)..(312): a, c, t, g, unknown or other
  misc_feature (312)..(312): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttagcctggtaccagcagaagttggccaggcctccaggctcctcatctttggtgtcgtccacgtagggccnctggtcgtcccagtcaggttcaggtggcagtggctcgtgggacagagttcactctcaccatcagcacgcctgcagtctagaagtattttgctagtttattacttgtcagactaatataatagtctcggtcctccggtagttgcttacgtttcgggacccgtacgggggacccaaggtcgttagggaacgtaacgtaaccgaaaacggtaacgttggtggcgtacg

SEQ ID NO: 241929 - DNA, 613 bp, Homo sapiens
  misc_feature: GYAE6OF01C2XWQ.35.85.H08.1.454.CMB.1.raw
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaaggtcggccagaggtcgcccctgaacctgaaggccaatgagacccaagacaggccaagtgggttgtgacgacccgtgaggagcgtcgggcccgtggtcccaggcagcgcgtcggccctgcctgcgtcgcgtgggtctggccagtcggtcgcccgagtcggcctgccgtgccgcccaagtcggttcgccgaccgcgaacggcccggggacccacggacccgtcggacgccctcgacggttggaacgcgacgcccgactcccgacggcccgtcgggaccggacggtcccgttacgggtcgggggaccgtacggggttccgaaccggtaccccggaaccgggtccccgtaaaaccccccgg

SEQ ID NO: 241930 - DNA, 546 bp, Homo sapiens
  misc_feature: GYAE6OF01BESEK.35.85.H08.1.454.CMB.1.raw
  modified_base (326)..(326): a, c, t, g, unknown or other
  misc_feature (326)..(326): n is a, c, g, or t
  modified_base (387)..(387): a, c, t, g, unknown or other
  misc_feature (387)..(387): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcaagaaagttggccaggcctcccgaggcctcctctattcgtttggtgtcgtcccacgtagggcccgtntgggtcgtcccagtcgaggttcaggtggctagtcggctcgtgggacaggtagttcacttcncacatcagcagcctgcagtctagagtatttgacttagtttattactgtacagtacaataatatagtctcggtcctcgtagttcgtacttacgtttcggaccgtagggacctaaggtcgtaggacgtacgtaaccgaaacgtacgtcggtcggtcgtacg

SEQ ID NO: 241931 - DNA, 490 bp, Homo sapiens
  misc_feature: GYAE6OF01DJ2UT.35.85.H08.1.454.CMB.1.raw
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtgctcgnggacngagttcactctcaccatcagcagcctgcagtctgaagtatttgctagtttattactgtcagcaatataatagctggtcctcgtagttgtctacgtttggccgagggaccaggctaggagatacaaatgaactgtggtcg

SEQ ID NO: 241932 - DNA, 551 bp, Homo sapiens
  misc_feature: GYAE6OF01CODGJ.35.85.H08.1.454.CMB.1.raw
  modified_base (358)..(358): a, c, t, g, unknown or other
  misc_feature (358)..(358): n is a, c, g, or t
tcagtacagatcgtcacgaccggtgctcgatttagtatcactcaggtacggccgggggaggaacgtgctacagttaggtacccaggaccggaaccgaactggaagcccccagccgcagccttcctccttaccgtccctgcctattccctggcctccccagatactcgactggacgaaactagtgatgacgccgacgtcgtccaaccactcgtgtactgttgtcctccggggacagacgcccacccgtctcccgtgcgacgggaccagtcaagtagtgttagcagcaacttagcctggtaccagcagaaagttggccaggctcccaggctcctcattctttggtgtgtccactgggccnctggtgtcccagtcagttcagtggcagtgctctgggacagagttcactctcaccatcagcagctgcagtctagagtatttgctagtttattactgtcagctaatataatagtctggcctccgtgttacgctacgttttcggccgtaggggacctaagccgtaggagaatacgaaacgactgtaggctgaaccc

SEQ ID NO: 241933 - DNA, 515 bp, Homo sapiens
  misc_feature: GYAE6OF01EEO7K.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatcgtttggtgtcgtccacgtagggccgctggtcgtcccagtcaggttcagtggcagtggctcgtgggacaggacgttcactctcaccatcagcagcctgcagtctagaagtattttgctagtttattacttgtcagctaatataatagctggcctcgtagttgtctacgtttcggaccgtaggggtaccaaggcgtaggagacgtacgaaacgagtggtggcgtacg

SEQ ID NO: 241934 - DNA, 554 bp, Homo sapiens
  misc_feature: GYAE6OF01E2X25.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggcctccaggctcctcatcgtttggtgtcgtccacgtacgggcccgtctgggtcgtccccgagtcaggttcaggtggcaggtggctcgtggggactaggagtttcacttctccacctatcagcagcctgcagtctagaagtattttgactagttttatactgtcagactaaatataatagtcgtcggtcctacggtagttgaccttacgttttcgggacccgtacggggaccaagggtcgttagggaagaacgtacgaaaacggtaacgtcggtcggctacgg

SEQ ID NO: 241935 - DNA, 525 bp, Homo sapiens
  misc_feature: GYAE6OF01BAXSL.35.85.H08.1.454.CMB.1.raw
  modified_base (407)..(407): a, c, t, g, unknown or other
  misc_feature (407)..(407): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggcctcctcatctttggtgtgtccacgtagggccgctggtcgtcccagtcaggttcaggtgcagtgctcgtgggacagagttcactctcaccatcagcagcctgctagtctagaagtnttttgacttagtttattactgtactagtactaaatataatagtctcggtcctcgtagttcgtcttacgtttggacccgaggggtacctaaggtcgtaggaacgtacgtacgaaaccgg

SEQ ID NO: 241936 - DNA, 555 bp, Homo sapiens
  misc_feature: GYAE6OF01DKK33.35.85.H08.1.454.CMB.1.raw
  modified_base (299)..(299): a, c, t, g, unknown or other
  misc_feature (299)..(299): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaaacttagcctaggtaccagacagaaagttggccaggctccaggctcctcattctttggngtgtccacgtagggccgtctgggtctcccagtcaggttcaggtggcagtggctgtgggacagtagtcactctacacatcagcagctgctagtactgaagtatttgacgtagtttattactgtacagtactaataattaatagtctcggtacctcgtagttcgtaccgtacgttttcgggaccggtaacgggggtacccaaggtccgttagggaagtacgttaaccgaaaacggtaacgttacggtacggcgtacgg

SEQ ID NO: 241937 - DNA, 636 bp, Homo sapiens
  misc_feature: GYAE6OF01DMDMS.35.85.H08.1.454.CMB.1.raw
  modified_base (173)..(173): a, c, t, g, unknown or other
  misc_feature (173)..(173): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccnctctgtctgtgtctccgaggggacagacgccaccctctcctgcgacgggccagtcagagtgtagcagcaacttagcctaggtaccagacagaaagttcggaccaggtctcccgaggtctcctcgtagttcgtttggtcgtcgtccacggtacgggccgtcgttggtcgtcccagtccgtaggttcgagtcggctggtggcttcggtggactaggtacgtttcaccttctacacctagtacacgactacgccgtgactacgtcgtagtaagttagttttgtacgttagttttacttacgttagtacgtagaactaattaagttaacgttacgtcgttcggtaccgtcggttagttcgtccgttacggtttacgggacccgggtaacggggtaacccgtaagtaccggtacgggaacgtaaacgttaaccggtaaaaccggtagttacgggtcgggtcgtaccgg

SEQ ID NO: 241938 - DNA, 527 bp, Homo sapiens
  misc_feature: GYAE6OF01BSA20.35.85.H08.1.454.CMB.1.raw
  modified_base (318)..(318): a, c, t, g, unknown or other
  misc_feature (318)..(318): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaacttagcctggtaccagcagaaagttggccaggctcccaggcctcctcattcgtttggtgtcgtccacgtagggccngtcgtcgtccagtcaggttcaggtgcaggtgctcgtgggacagagttcactctacacatcagcacgctgcagtctagagtattttgactagtttattactgtctagactaatataatgctcggtcctcgtagttcgtactcgtttacggccgtacggggacctaacggtcgtaggagtactaaccgaaacggtaagtggtggtcgtacg

SEQ ID NO: 241939 - DNA, 720 bp, Homo sapiens
  misc_feature: GYAE6OF01BNWF8.35.85.H08.1.454.CMB.1.raw
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtctccaaccactctgtctgtgtctccgaggggacagacgccaccctntcctgcagggccagtcagngtgtagcagacaacttacgccgtaggtaccagacaaggtaaagttcggaccaagggcctcccgaaggccttacctactatttccgtttggtcgtcgtacccacggtacggggcctcgtagggtctaccccgtagtcgtacgggtttcagggtcggacgtacggtggccttcggtacggggactaggtaacggtttccaaccttccgtacaaccctagtaccgaacgtccgagtccctgtacgacgttacgtagtaagttgttttacgacgtttaagtttattaacgttgttaccaaggtaactaaagtttaaagtaacgttacgtaccggttcggtaacccgtaccggtagttttaacggtccgtttaaacccggttttggggaacccgggtaacgggggtaaacccaacgggttccgggttaaacgggaaggttaaaccgttaaccggtaaaacggttaacggttacgggtcggaaccgttaacccgg

SEQ ID NO: 241940 - DNA, 559 bp, Homo sapiens
  misc_feature: GYAE6OF01AJDQJ.35.85.H08.1.454.CMB.1.raw
  modified_base (353)..(353): a, c, t, g, unknown or other
  misc_feature (353)..(353): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcagaaagttcggccaggcctcccgaggcctcctcattcgtttggtgtcgtccacgtagggccgtcgtggtcgtccccagtccaggttcaggtggcnggtgctgtgggacagtagttcactctcaccatcagcacgccgtgcagtctagaagtattttgcttagtttattacgtgtcgaagtactaattataagtacgtcgtacggtccttacgtagttcgtccgttacggtttacggaccggtacggggtaccaacggtcgtagggtaagtacgtaacaaacggtatcggtcggtcgtaccg

SEQ ID NO: 241941 - DNA, 559 bp, Homo sapiens
  misc_feature: GYAE6OF01EMVQO.35.85.H08.1.454.CMB.1.raw
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggcctcccgaggctcctcattcgtttggngtgtccacgtagggccgctggtgtcccagtcaggttcagtggcagtggctcgtgggacagngttcactctacaccatcagcagcctgcagtctgatgtatttgcttagtttattactgtcagctagttatgtaacttaacgtcggccttccggtggtaccggtttccgggaccgtaacggggtacccgtaagggttacgggaaacgtacccgtaaaccggtaacgttcggttacggaccgtacggtcccgaaccgtacg

SEQ ID NO: 241942 - DNA, 557 bp, Homo sapiens
  misc_feature: GYAE6OF01DJUKK.35.85.H08.1.454.CMB.1.raw
  modified_base (413)..(413): a, c, t, g, unknown or other
  misc_feature (413)..(413): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccaccctctcctgcagggccagtcagagtgttagcagcaacttagcctggtaccagcaagaagttcggccaggcctccaggcctcctcattctttggtgtcgtccacgtacgggccgtcgtggtcgtcccagtcaggttcaggtgctaggtcggctcgtgggactagtcgttcacttctacaccatcagcacgctgctaagtctagaagttntttagcttagtttatacttgtacgaagtctaagtataagtacgtactcggtaccgtcgtagttcgtacgtacgtttcggaccggtacgggtaccaaggtcgtaggtacgtacgtaaccgaaacggtacgtggtcggtcgtaccg

SEQ ID NO: 241943 - DNA, 666 bp, Homo sapiens
  misc_feature: GYAE6OF01B6P6O.35.85.H08.1.454.CMB.1.raw
  modified_base (175)..(175): a, c, t, g, unknown or other
  misc_feature (175)..(175): n is a, c, g, or t
  modified_base (313)..(313): a, c, t, g, unknown or other
  misc_feature (313)..(313): n is a, c, g, or t
tcagtacagatcgtcacgaccggtgctcgatttagtatcactcagtcggcgggaggaactgctcgagttaggacccaggaccggaaccatggaagccccaggcgcagcttctcttcctcctgctatctggctccagatatcactggagaaactagtgatgacgcagtctcaaccnctctgtctgtgtctccaggggacagacgcctacccgtctcctgcagggccagtcagagttagttaagcagcaaacttagacctagggtaaccacgcgaagtaaagttcggccaagggtccttcccgaggccttccctntacgttcgttttggcgttggtacccagttacgggccgtctagggttcgtccccaaggttcctaagggtttcagggttggacgtaaggttcggaccttcgtgggaacctagtacgttcgacttcgtacacctagtcaggctaacgtcctagtactacgttcttagaagtattttgacgttagtttacgttacctgtactagtacctaataacgttaagtacggtcgttacggtacccgttacgtaaggttcgtaccgttacgttttacggaccggtaacggggtaacctaaggttcgttagggtaacgttactaaaccggttaaaccgtaaccgttacggtcgggttcgtacgg

SEQ ID NO: 241944 - DNA, 519 bp, Homo sapiens
  misc_feature: GYAE6OF01BT3VL.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtgtccacgtacgggccgtctgggtcgtccccaggtcaggttcaggtggcaggtggctcgtgggacagagttcactctcaccatcagcagcctgcagtctagaagtattttgactagtttattactgtcagacaattataatagctggcctcgagttgctacgtttggaccgtacggggtaccaaggtcgtaggagagtacaaacggaagtcgtggctacgg

SEQ ID NO: 241945 - DNA, 565 bp, Homo sapiens
  misc_feature: GYAE6OF01CDK1C.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtcgtccacgtacggggcccgtcgtgggtcgtccccagtcaggttcaggtggcagtggctcgtgggacaggtacgttcacttctacaccatcagcacgcctgctacgtctagtaagtattttgacttagttttacttacgttgtacgtagtactaattaataagtagtcgttcggtccctacgtagttcgtcgttacgtttagggacccggtacggggaccgaaggtcgtagggaagtacgtaacgaaacgtaagtcggtggcgtacgg

SEQ ID NO: 241946 - DNA, 559 bp, Homo sapiens
  misc_feature: GYAE6OF01AHZDZ.35.85.H08.1.454.CMB.1.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
  modified_base (464)..(464): a, c, t, g, unknown or other
  misc_feature (464)..(464): n is a, c, g, or t
tcagtacagatcgtcacgaccggtgctcgatttagtatcactcagtcgcggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtattcggaacacgtagtctggtaccagcaagaaacctggccaggctcccaggcctccncatctagtggtgccatcccaccgagggcccacgtggtactcccagccgtaggttcaggtggcaggtcggggtctgggacaggtaccttcaccttctacacctatcagcagcctgctagtctagaaacgtattacgtggtactagtttactcgtaactgtacacgtattaagtttaancggtcgttcggtccgcgtctcgttcgttcgggacggtacgggtaccgtagggtggaagtactaaacgaaagtcgtggtacgactggcctacgtac

SEQ ID NO: 241947 - DNA, 615 bp, Homo sapiens
  misc_feature: GYAE6OF01A4H6Q.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctggtaccagcaagaaagttggccaggcctcccgaggctcctcattctttggtgtcgtcccgacgtacgggcccgcgttgggtcgtccccaggtcgtagggtttcaggttgggctaggtcggcttcggtggggactaggacgtttccacgttctacacctactcacgcacgcctgctagtcgtagtaagttatttgacgttagtttacttacgtgtactagtactaaattataatacgtcttacggtacccttaccggtacggttcgtaccgttacggttttacgggacccggtaacggggtacccgtaacgggtccgtagggtaagtacgtaaccgaaacggtaaccgtcggtacggtcgtacgg

SEQ ID NO: 241948 - DNA, 535 bp, Homo sapiens
  misc_feature: GYAE6OF01A5QXX.35.85.H08.1.454.CMB.1.raw
  modified_base (415)..(415): a, c, t, g, unknown or other
  misc_feature (415)..(415): n is a, c, g, or t
  modified_base (528)..(528): a, c, t, g, unknown or other
  misc_feature (528)..(528): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcaagaaagttggccaggctcccaggcctcctcattcgtttggtcgtgtccacgtacgggccgtcgtgggtcgtccccagtcagggttcaggtggcaggtggctcgtgggacaggacgttcactctacaccatcagcagcctgcctagtctagaagtnttttgacttagtttattactgtacagtacaattataatagtctcggcctacgtagttcgtcttacgtttcggaccgtaggggaccaggtcgtggagactacgaaacgtagtgnggctacg

SEQ ID NO: 241949 - DNA, 620 bp, Homo sapiens
  misc_feature: GYAE6OF01BLLW9.35.85.H08.1.454.CMB.1.raw
  modified_base (318)..(318): a, c, t, g, unknown or other
  misc_feature (318)..(318): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtcgtccgggggacagagccaccctctcctgcagggccagtcagagtgttagcagcaacttagcctggtaccagcagaaagttggccaggctcccgaggcctctcattcgtttggtcgtcgtccacgtacgggccncgtgggtcgtcccagtcgtaggttcaggtggctaggtggctcgtgggacagtagttccacgtccacacctatcgacgcacgccgtgctacgtctaggtaagttagtttcgacttacgttttacttacgtgttacagtaactaattaattaacgtacgtacgttacggtacccttaccggtaggtttcggtaccttacgttttccgggaccggtaacggggtaaccgtaaggtcggttacgggaacggttaaacgtaacccggtaaaacggtacgttagggtacggtaccgttcggtaacccg

SEQ ID NO: 241950 - DNA, 535 bp, Homo sapiens
  misc_feature: GYAE6OF01CWCT8.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtcgtccactagggcctcgtggtcgtcccagtcaggttcagtcggcagtggctcgtgggacagtagtcactctcacatcagcagcctgcagtctgagtattttgctagtttattactgtctagactaatataagtacgcttcggacccttcgtagttcgtctaccgttttgggacccgtaaggggtacctaaggtcgtagggacgtaactaccgaaaacgtacgttggtcggtcgtacgg

SEQ ID NO: 241951 - DNA, 596 bp, Homo sapiens
  misc_feature: GYAE6OF01BR57O.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtgtcccacgtacggggccgcgtggtcgtccccagtcaggttcagtggctaggtggctcgtggggacaggtacgttcactctcaccatcagcacgcctgctagtctagaagtattttgacttagtttattacgtgtcaaggtacctaaataattaaagtacgtcgttacggtcccttaccggtaagtttccggtacgttaccgttttacggggacccggtaacgggggaaccctaacgggtccgtagggtaacgaacgttaaccgaaaaccggtaaccgttgggttacggtccgtaccgg

SEQ ID NO: 241952 - DNA, 544 bp, Homo sapiens
  misc_feature: GYAE6OF01B1YE3.35.85.H08.1.454.CMB.1.raw
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcagaaagttggccaggcctcccaggcctcctcattcgtttggtgtgtcccacgtagggccgtctgggtcgtccccagtcacggttcaggtggctaggtcggctcgtgggacaggtacgttccacgtctaccacctacgtcagcacgcctgcagtctagaagtntttcgntagtttatacgtntacagtaacaattataagtacgctcggcctcgtagttcgacttcgtttcggccgtacgggtaccaggcgtaggacgaataccgaaacgtagtggtcggtgtacg

SEQ ID NO: 241953 - DNA, 566 bp, Homo sapiens
  misc_feature: GYAE6OF01CV5B9.35.85.H08.1.454.CMB.1.raw
  modified_base (421)..(421): a, c, t, g, unknown or other
  misc_feature (421)..(421): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgtagcagcaacttagcctggtaccagacagaaagttggccaggcctcccgaggtcctccgtcattccgtttgggtcgtcggtcctacgtacggggccgtcgtgggtcgtcccgagtcaggtttcaggtggctagtggctcgtggactagagttcacgtctacaccatcagcagcctgcgagtctagaagtntttgacttagtttacttactgtacgtagtactaaatattaagtacgtctcggtaccctacggtagttcgtcgtaccgtttcggaccggacggggtaccaaggtcgtagggacgtactaacggaaacgtaacgtggtggccgtacg

SEQ ID NO: 241954 - DNA, 719 bp, Homo sapiens
  misc_feature: GYAE6OF01AEUAH.35.85.H08.1.454.CMB.1.raw
  modified_base (702)..(702): a, c, t, g, unknown or other
  misc_feature (702)..(702): n is a, c, g, or t
tcagtacagatcgtcacgaccggtgctcgatttagtatcactcagtcggcgggggaggaactgctcagttaggacccagacggaaccatggaagccccagcgcagcttctcttcctcctgctattctggctccagatatcactggagaaatagtgatgacgcagtcctccaaccactctgtctgtgtctccgaggggacagacgcccaccctctcctgcgacgggccagtcagacgttgtagcagactaacttcgccgtaggtaacccaggacgaaggtaacggttcggacccgtacggtccctccccgtaggtcccttccgttactagtttccggtttggtcgttcggtacccgtaacggtccggggtcccgtcgttcgggtcccgtaccccgtaggttcgtacggttcgagggtcgccgtagggtcggtcgttacggacgggtaacctaggttaccgttccctaccctttccgaccctaaccgtacgtccgacggtccgaccgtccgtagacgttacgttacgtaagtaacgttttagtttacgtactttagttttaacctcgttacgtacgaactacttaaagtacgtaagtccggtcgttacggtcccgttacggtagttccgtaccggtttaccggttacgggacccggtaacgggtacctaggtcgtaagtacctaacgttaaccggtaaccggtntcggtcgtccgtacccg

SEQ ID NO: 241955 - DNA, 802 bp, Homo sapiens
  misc_feature: GYAE6OF01BJKRK.35.85.H08.1.454.CMB.1.raw
  modified_base (113)..(113): a, c, t, g, unknown or other
  misc_feature (113)..(113): n is a, c, g, or t
  modified_base (129)..(129): a, c, t, g, unknown or other
  misc_feature (129)..(129): n is a, c, g, or t
  modified_base (149)..(149): a, c, t, g, unknown or other
  misc_feature (149)..(149): n is a, c, g, or t
  modified_base (177)..(177): a, c, t, g, unknown or other
  misc_feature (177)..(177): n is a, c, g, or t
  modified_base (203)..(203): a, c, t, g, unknown or other
  misc_feature (203)..(203): n is a, c, g, or t
  modified_base (685)..(685): a, c, t, g, unknown or other
  misc_feature (685)..(685): n is a, c, g, or t
  modified_base (704)..(704): a, c, t, g, unknown or other
  misc_feature (704)..(704): n is a, c, g, or t
tcagtacagatcgtcacgaccggtgctcgattttagtatcactcagtcggtcgggggaggaactgctcagttaggacccgagacggaaccatggaagccccagcgcagcttcnctcctcctgctattcngctccagactatcactgganaatagtgatgacgcagtctaccgaactntcgtgtctgtcgtcctcgaggggacncggacgacccgtacccttcgtcccgtaggacccgacggggtccctaaggtccctaagggtaccgttagggtttaaccgccgttaaccgggtacccttaaaaccggtttcggtacccccgtttaagggtaacccctaacgacccggtaaaagggttaaacggttcccggacccggttaacggccccgttaccccggaacggtccctttacccgtaccgttaacgtttcgggtttcgggtactttacccggtaacccggtacggttaaccggggcccgttcgttaccggggtccgttacccccgaaggttcccgttagggtttacccagggttccgggaccgttagggtccgtccgtacggtacggggacctagggtactttccgaaccttcgtaaccaccgattccaaggccctacggtccgttacgaccgtaacgttcgtaacgtaacgttagtttaccgtgtttaacgtttactacggttntacgtacgtactaagttanaagttcgtacgtccggtacgtcgtagtcgtacgttcgttacggacggtaggacctaggtcgtaggactacgtacaaccgggtatccggtgtccgtacg

SEQ ID NO: 241956 - DNA, 572 bp, Homo sapiens
  misc_feature: GYAE6OF01C8WLY.35.85.H08.1.454.CMB.1.raw
  modified_base (421)..(421): a, c, t, g, unknown or other
  misc_feature (421)..(421): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcaagaaagttggccaggcctccaggcctcctcattcgtttggtgtgtccgacgtacgggccgtcgtgggtcgtcccgagtcgtaggttcagtggcaggtcggctcgtggggacaggtacgttcacttctacaccatccagccagccctgctagtctagtaagtnttttgcttagtttattacgtgtcagtactaagttaataagtagcgttcggtccttacggtagtttcgtacttaccggttttggacccggtacggggtaaccaaggtccgtaggaacgtactaaccggaaaacgtagtacggtggcgtaccg

SEQ ID NO: 241957 - DNA, 549 bp, Homo sapiens
  misc_feature: GYAE6OF01ESQSH.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcagaaagttggccaggctcccaggctcctcattcgtttggtgtcgtccacgtagggccgcgtggtcgtcccagtcaggttcagtggcagtggctcgtgggacaggagttcactctcaccatcagcagcctgcagtctagaagtatttgctagtttattacttgtactagactaattaataagtagtcgttcggccctaccggtagtttcgaccgttacgtttcgggaccggtaacgggggtaccaaggtcgtaggaagtacgtaaccgaaacgtaacgtcggtggctacgg

SEQ ID NO: 241958 - DNA, 548 bp, Homo sapiens
  misc_feature: GYAE6OF01B4U6V.35.85.H08.1.454.CMB.1.raw
  modified_base (293)..(293): a, c, t, g, unknown or other
  misc_feature (293)..(293): n is a, c, g, or t
  modified_base (339)..(339): a, c, t, g, unknown or other
  misc_feature (339)..(339): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctggtaccagcagaaagtgcaggctccaggctctcatctttggngtgtccagtacgggcctctggtcgtcccagtcaggttcaggtgcgngtcggctcgtgggactagtagttcactctcacactcacgacacgctcgcgagtctagtaagtatttgtacttagtttattacgtgtactagtactaattaataatagtacgtcggtccgtacgtagttcgtactacgttttacggaccgtacggggtaaccgaaggtcgtagggaagacgtaacgaaacgtaacgtggtcggcgtacgg

SEQ ID NO: 241959 - DNA, 627 bp, Homo sapiens
  misc_feature: GYAE6OF01DI5BO.35.85.H08.1.454.CMB.1.raw
  modified_base (409)..(409): a, c, t, g, unknown or other
  misc_feature (409)..(409): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagacaagaaaggttggaccaggcctccccgaggcctccgtcatttcgttggtgtcgtcccgacgttacgggcccgtcgtcgggttcgtcccctaggtcgtaggtttccaggtcggcgagttcggctcgtggactagtacgttcacgtctacacntacagcacgtccgtgacgagtcgtagtaagtagtttacgtacgttagttttattacgttgtaccgtagtactaaacttaagtaacgttacgtaccgttacggtcccgttaccggtaacgtttcgtaccttaccggttttacgggacccggtaacggggtaaccctaaggtcgttagggaagtacgtaacgtaaacgaaggtacggtcgggtctaccgg

SEQ ID NO: 241960 - DNA, 502 bp, Homo sapiens
  misc_feature: GYAE6OF01B499T.35.85.H08.1.454.CMB.1.raw
  modified_base (195)..(195): a, c, t, g, unknown or other
  misc_feature (195)..(195): n is a, c, g, or t
  modified_base (287)..(287): a, c, t, g, unknown or other
  misc_feature (287)..(287): n is a, c, g, or t
  modified_base (337)..(337): a, c, t, g, unknown or other
  misc_feature (337)..(337): n is a, c, g, or t
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
tcagtacagatcgtcacgaccggtgctcgatttagtatcactcagtcgcggggaggaactgctcagttaggacccagacggaaccatggaagccccagcgcagcttctcttctcctgctattctggctccagatatcactggagaaatgtgatgacgcagtctccaacactctgtctgtgtctccgagggggaanagccatcctctcctgcagggccagtcagagtatcggaacagtagtctggtaccagcagaaacctggccaggctccaggctctcatctatggncatccaccagggcctatggtactccagccaggttcagtggcagtgggtcngggacagacttcacttcncgaccatcagcagctgcagtctgaanattatgctagtttattactgtcagcaatataatagactggctcgagttgctacgttttcggaccgtacggggaccaaggccgttagggagacgtacgtaaacgaaacgtgtagggctacgg

SEQ ID NO: 241961 - DNA, 532 bp, Homo sapiens
  misc_feature: GYAE6OF01A888A.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttgccaggctccaggctctcattcttggtgtgtccacgtacgggccgtcgtggtcgtcccagtcaggttcagtggcagtggctgtgggacagagttcactctcaccatcagcacgcctgcagtctagaatatttgacttagtttattactgtacagtactaattataatagtcgtacgtcctacgtagttcgtcttacgtttccggacgtaacggggtaccaaggtcgtagggaacgacgtaaccgaaacgtaattggtcgtcgtaccg

SEQ ID NO: 241962 - DNA, 563 bp, Homo sapiens
  misc_feature: GYAE6OF01DWSIH.35.85.H08.1.454.CMB.1.raw
  modified_base (369)..(369): a, c, t, g, unknown or other
  misc_feature (369)..(369): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcaagaaagttggccaggctccaggcctcctcattcgtttggtgtcgtccacgtagggcccgtcgttgggtcgtccccagtcgaggttcaggtggcaggtggctgtgggacnggtagttcactctcaccatcagcacgcctgcagtctgtaagtattttgtctagtttattacttgtactagacaattataatagtctcggtccgtccggtagttcgtcgtacgttttcgggaccggtaacggggaacctaacggtcgtaggaggtaacgtaacgaaaacggtaacgttacggtcggtcgtaccgg

SEQ ID NO: 241963 - DNA, 558 bp, Homo sapiens
  misc_feature: GYAE6OF01A97DP.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggcctcccaggcctcctcattcgtttggtgtgtccacgtagggccgctggtcgtcccagtcaggttcagtggctaggtggctcgtgggacaggtacgttcactctacacctatcagcacgtcctgctagtctagaagtattttgacttagtttacttactgtacagtactaattataagtagtcttacggtcccgtacggtagttcgacttacggttttcggaccggtaggggtaccaaggtcgtagggaacgtacgtaccgaaacgtaacgtcggtggtcgtaccg

SEQ ID NO: 241964 - DNA, 551 bp, Homo sapiens
  misc_feature: GYAE6OF01BAX7M.35.85.H08.1.454.CMB.1.raw
  modified_base (315)..(315): a, c, t, g, unknown or other
  misc_feature (315)..(315): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggccaggctcccaggctcctcattcgtttggtgtgtccacgtagggcccncgtgggtcgtccccaggtccaggtttcagtggcagtggctcgtgggactagagttcactctcacatcagcacgcctgcagtctagaagtatttgactagtttattactgtctagactaatataagtagtctcggtccctaccggtagttcgtcgttacgtttcgggaccgtaacggggtacccgtaaggtccgtagggacgacgttacgaaaccgtaacgtcggtgggtctaccgg

SEQ ID NO: 241965 - DNA, 743 bp, Homo sapiens
  misc_feature: GYAE6OF01E3PKS.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcacgggccagtcagagtgttagcagctaacttagcctggtaccagacgaagaaaggttggaccgaggccctccccgaggtcctcctcattcgtttggtgtcgtcccacgtacggggcccgtcgttgggttcgttccgaggttccgtagggtttccaaggtcgggctaggtcgggccgtcggtaggggactaagggtacgtttccacgttcctaccaacctactccgaaggccacggtcccgttacggacgtacggttcgtagtaagtttacgttttacgtacgtttaagtttttacgtttacgttacggtaccgtaacgtaaccttaaagttaacgttaaagttaacggtaccgttaccgggttccccgttacccgggttaaggtttaccggttacccgtttaccggtttttaccggggaacccgggtaaccgggggtaaacccgtaacgggtaccggttacgggtaaacgtaacgttaaacccggtaaaaccggtaaccggtttacgggttacgggtcccgttaccgg

SEQ ID NO: 241966 - DNA, 568 bp, Homo sapiens
  misc_feature: GYAE6OF01ETNEO.35.85.H08.1.454.CMB.1.raw
  modified_base (386)..(386): a, c, t, g, unknown or other
  misc_feature (386)..(386): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcaggaaagttggccaggcctcccgaggtcctcctcattcgtttgggtgttgtcccacgtacgggccgtcgtgggtcgtcccgagtcaggttcagtggcaggtggctcgtgggacaggtagttcactcncaccatcagcacgcctgcagtctagaagtatttgactagtttatttacgtgtacagtactaataataatagtcctacggtcccgtaccgtagttcgtccgttacgttttcggacccggtacggggaaccctaaggtcgtagggagtaacgttaacgaaaaccgtaacgtggttggcgtacgg

SEQ ID NO: 241967 - DNA, 547 bp, Homo sapiens
  misc_feature: GYAE6OF01EEPLW.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcattcgtttggtgtcgtccacgtagggccgcgtggtcgtcccagtcaggttcagtggcagtggctcgtgggacagagttcactctcacatcagcagcctgcagtctagaagtattttgactagtttacttacgttgtcagtactaattaataagtagtcgttcggtcccgttaccgtagttcgtcgttacgttttcgggaccgtacggggtaccaaggtcgtagggacgtaacgtacgaaacgtaacgtggtcggcgtacgg

SEQ ID NO: 241968 - DNA, 590 bp, Homo sapiens
  misc_feature: GYAE6OF01BJ4RE.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctactctggctcccagataccactggagaaatagtgatgacgcagtctccaaccactctgtctgtgtctccgaggggacagacgcccaccctctcctgcgacgggccagtcagagtgtagcagcaacgttagcctggtaccagcaaggtaaagttggccaggcctcccgaggtcctcctcagttcgtttggtgtcgtccacgtacgggcctgtggtcgtcccagtcgtaggttcaggtcgactaggtcgctcgtagggacagtacgttcactcgtaccactatcgacgcacgtcctgctacgtcgtagaagttatttacgacgttagtttacttacgtcgtactagtactaataattaagtacgtacgtacggtcctacgtacgttcgtacgttacgtttcggaccggtacgggactaggtcgtacggacgtaacgtaaccgtaaacgtacgtaggtacgtcgtcgtaccg

SEQ ID NO: 241969 - DNA, 640 bp, Homo sapiens
  misc_feature: GYAE6OF01BOVJI.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgttagcagcaacttagcctggtaccagcaagaaagttggccaggcctcccgaggcctcctcattcgtttggtgtcgtaccacgtacgggccgcgtggtcgtccccgagtccgaggttcaggtcggctaggtggctcgtggggactaggtacgttccgtaactccgtacaacctatacctagcacgcctgacgtacgtcgtagtaagttagtttagtacgttagtttatttacgttacgtacgtaagtactaattaagttaagtacgtcgttcggtacccgtacgtacggtttcgtaccgttacgttttacgggacccggtaacggggtaacccgtaacgggtaccgtaagggtaacggtaacgtaaccgtaaaaccggtaaacgttcgggtacgggtacgtacccgg

SEQ ID NO: 241970 - DNA, 681 bp, Homo sapiens
  misc_feature: GYAE6OF01DBVIX.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctttctgtgtctccgaggggacagagcccaccctctcctgcagggccagtcagagtgttagcagcaacttagcctggtaccagcagaagttgccaggctcccaggcctcctcattcgtttggtgtcgtcccaacgttacggggcccgtcttagggtcgttcccccaaggttccgaagggtttccgaggttcgggccgtaggtcgggtctcggttggggaacctagggtacgtttccaacttccttaccaaccctacttccgacgaccacggtcccgttagacccgtaagttccgtaaggtaacggttagtttttcgaccgtttaagtttttaacgtttaccgttagttactaggtaacttaaagttaacttaaagttaacggtcgtacgggtcccttaccggtaggtttcgtacctttacgttttcgggacccggtaacggggtaaccctagggtcgtagggaaagtacgttaaccgaaacgttacgtaggtcggcgtcgtaaccg

SEQ ID NO: 241971 - DNA, 494 bp, Homo sapiens
  misc_feature: GYAE6OF01A19ZY.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctctgggacagagttcactctcaccatcagcagcctgcagtctgaagtattttgctagtttattactgtcagcaatataatagctggcctcgagttgctacgtttggccgtaggggtaccaaggctggagactacgaaacgatgtggctcg

SEQ ID NO: 241972 - DNA, 664 bp, Homo sapiens
  misc_feature: GYAE6OF01BFWF4.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgtagcagcaattgcctggaccagcgaagaaagttggccaggcctcccgaaggcctcctcgtacttcgtttggtcgtcgttaccgaacggttaccggggccgtcgtcgggtcgtaccccgaggttccgtacggttccagggttcggacgtaggtcggctcggtcggggaactagggtacttcgtaaccgtcctaccgaacctacgtccgagtccgaacggtccctaggccgtagttccgtaaggtaacgtttatttttaggacgtttaagttttaacgttaccgttggttacctaagtaactaaattaacgtaagttaacgtccgtacggtcccctacggtagttcgtaccgttaacggttttccgggaccggtaacggggtaccaaggtacgtaggaacgtacgtaaccgaaacggtaccgttgccggtgtacg

SEQ ID NO: 241973 - DNA, 834 bp, Homo sapiens
  misc_feature: GYAE6OF01CNF77.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggaagaaatagtgatgacgcagtctccaaccactctgtctgtgtctccgaggggacagacgccaccctctcctgcgagggccagtcagagtgttagcagcaacttagcctaggtaccagacaaggtaaagttcggacccgaagggcctaccccgagggtcccttacccgtctaacgtttccgttttgggtcgttccggtacccgtaacggttaacggggcccgtcgttcgggtccgttcccccgtaaggttccgtaacgggtttccgaaggttcggggaccgtaaggttcgggtaccttcggtagggggaacctaagggtacgttttaccaaccgtttctaccgaacccgtaacttaccgaacggtaccgacggtacccgttacggaccgtacggttaccgttaaggtaaacggtttacgtttttacggtacgtttaacggtttttaacgtttaacgttaggttaaccgtaacggtaacctaaagtttaaacgttaaacgttaacggtacccggttacgggttaccccgttacccgggttaacggtttaccggttacccgtttaccggtttttaccgggaacccgggtaacgggggtaacccgtaaacgggtccggttaacgggtaaacggtaaacgttaaaccggtaaaaccggttaaccggttacgggttacgggtccgttaaccggg

SEQ ID NO: 241974 - DNA, 622 bp, Homo sapiens
  misc_feature: GYAE6OF01EJDV4.35.85.H08.1.454.CMB.1.raw
  modified_base (297)..(297): a, c, t, g, unknown or other
  misc_feature (297)..(297): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaaagttggccaggctcccaggctcctcatcgtttggngtcgtaccacgtagggcccgtcgtggtcgtccccaggtccagggtttcaggtcggctaggtggcctcgtggggactaggacgtttcacttctaccgacctatcagcacgccttgactagtccttaggaacgttattttacggacgttagttttaactttacgttagtcaagtactaaattaagttaatagtacgttacgggcccttaccggtaaggtttcgtaccgttaccgttttacgggacccggtaacgggggtaacccaaaggtccgtagggaaacgtacgtaaccgtaaaaccgtaaccttcgggttagggtccgtacgg

SEQ ID NO: 241975 - DNA, 547 bp, Homo sapiens
  misc_feature: GYAE6OF01CCYE9.35.85.H08.1.454.CMB.1.raw
  modified_base (313)..(313): a, c, t, g, unknown or other
  misc_feature (313)..(313): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcaagaaagttggccaggctcccaggctcctcattctttggtgtgtccatagggccnctggtcgtcccagtcaggttcagtgcagtgctcgtgggacagagttcactctcaccatcagcagcctgcagtctagaagtattttgctagtttattactgtcagtactaattataatagtacttcggtaccctcgtagttgtcgttaccgttttacgggcccgtaacggggtaaccctaaggtccgtagggaacgtaacgtaaccgaaaacggtaacgttggtcggtcgtacgg

SEQ ID NO: 241976 - DNA, 532 bp, Homo sapiens
  misc_feature: GYAE6OF01ETQKL.35.85.H08.1.454.CMB.1.raw
  modified_base (358)..(358): a, c, t, g, unknown or other
  misc_feature (358)..(358): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcattctttgggtgtgtccacgtagggccgctggtgtccccagtcaggttcagtggcagtggctcgtgggacagnttcactctcaccatcagcacgcctgcagtctagaagtattttgctagtttactctactgtcagtctaagtttaatagtcgttcggcccgtcgtccttcgttccgtttcgggacgggtacgggaccgtaagggtggagacgtaacgaaaaacggtactggtaggctgcgtaaccg

SEQ ID NO: 241977 - DNA, 543 bp, Homo sapiens
  misc_feature: GYAE6OF01D2CBU.35.85.H08.1.454.CMB.1.raw
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccacctctcctgcagggccagtcagagtgtagcagcaacttagcctggtaccagcagaaagttggtcaggctcccaggcctctcatcgtttggngtgtccacgtagggcctntggtgtcccagtcaggttcaggtggctaggtggctcgtgggacaggacgtttcaacttccgtacaccgtatcacgcacgcctgcagtctagaagtattttgactagtttattactgtcagcaattataatagtctcggtcctccgtagttcgctacgttttcgggacccgtacggggtaccaaggtccgtagggacgtacgtaccgaaaacgtaacgtaggtggcgttacg

SEQ ID NO: 241978 - DNA, 511 bp, Homo sapiens
  misc_feature: GYAE6OF01BM6B9.35.85.H08.1.454.CMB.1.raw
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtcctccaggggacagagccaccctctcctgcagggccagtcagagtgttagcagcaacttagcctggtaccagcagaaagttgccaggctccaggctcctcatctttggtgtcgtccacgtagggccgcgtggtcgtccccaggtcaggttcaggtggcagtggctcgngggacagngttcactctcacatcagcagcctgctagtctagaagtatttgctagtttattactgtctagactaagtatatagctgcctcgtagttgcttacgtttggcccgtaaggggacctaaggcgtaggagtgtcgtaaacgg

SEQ ID NO: 241979 - DNA, 597 bp, Homo sapiens
  misc_feature: GYAE6OF01CTYR2.35.85.H08.1.454.CMB.1.raw
  modified_base (229)..(229): a, c, t, g, unknown or other
  misc_feature (229)..(229): n is a, c, g, or t
  modified_base (384)..(384): a, c, t, g, unknown or other
  misc_feature (384)..(384): n is a, c, g, or t
  modified_base (403)..(403): a, c, t, g, unknown or other
  misc_feature (403)..(403): n is a, c, g, or t
  modified_base (439)..(439): a, c, t, g, unknown or other
  misc_feature (439)..(439): n is a, c, g, or t
tcagtacagatcgtcacgaccggtgctcgatttagtatcactcagtcgcgggggaggaactgctcagttaggacccagacggaaccatggaagcccagcgcagcttctcttcctcctgctattctggctccagatatcactggagaaatagtgatgacgcagtctccaaccactctgtctgtgtctccgaggggacagacgccaccctctcctgcacgggccagtcagngtgtagcagacaacttacgccgtaggtaccagacaaggaaacgttcggcctagggcctaccccgaggtcctccgtctagttcgtttggtcgtcgtacccgagtacgggccgtcgtggtccgtcctaggtctaggttcaggtggcaggtcgctcgnggactgtacgttcacgtcncactatcgacgcacgcctgcgtagtctagtaagttntttgtacgttagttttacttacgttgtacagtaactaagttaataagtacgtcgttcggtaccgttcgtacgttcgtacgttacggtttccggaccggtaacgggaacctaaggtcgtacggaagtacgtaaacgaaacggtacgtggtcggtctacg

SEQ ID NO: 241980 - DNA, 515 bp, Homo sapiens
  misc_feature: GYAE6OF01AW6R1.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatcgtttggtgtgtcccacgtaggggcccgtctgggtcgtccccagtcaggttcaggtggcaggtggctcgtgggacagagttcactctcaccatcagcagcctgcagtctagaagtattttgctagtttattactgtacagacaatataatagtctcggcctcgagttcgtctacgtttggccgtacgggaccaaggcgtaggagacgtacaaacgatggtgtctcg

SEQ ID NO: 241981 - DNA, 520 bp, Homo sapiens
  misc_feature: GYAE6OF01D3BDQ.35.85.H08.1.454.CMB.1.raw
  modified_base (357)..(357): a, c, t, g, unknown or other
  misc_feature (357)..(357): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaagttggccaggctcccaggctcctcattcgtttggtgtgtccacgtgggcctctggtcgtcccagtcaggttcaggtggcaggtggctcgtggacngtgttcactctacacatcagcagcctgcagtctagtaagtattttgcttagtttattactgtcagtactaatataatgtcgtcggtcctcgtagttgtcttacgtttcggaccgtacggggtaccaggtcgtaggagactacgaaacgtagtcgtggcgtacg

SEQ ID NO: 241982 - DNA, 733 bp, Homo sapiens
  misc_feature: GYAE6OF01A9VWW.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttcggccaggcctcccgaggcctcctcattcgtttggtgtcgtcccgtaacgttacggggcccgtcgttgggtcctaccccgtagtccgtaacggggtttctaagggttcgggcgtaagggttcgggtcccttacggtagggggaacctaagggtaacggttttccaaccgttccttaccgaaccctaacgtccgtaacgaccgaacggtcccgtacggaccgtaacggttccgttaaggtaagggttacgtttttcggtaccgtttaagtttttacgtttaaccgttcggttaccgtaaggtacctaaatttaagttaaacgttacggtaccgttacgggttacccgttaccggtaggttacgtaccgttacgttttacgggaccggtaacggggtaacccgtaacggtccggttaagggtaacgtaacgtaaccgtaaaacgtacgtacggttacggccgttaacgg

SEQ ID NO: 241983 - DNA, 577 bp, Homo sapiens
  misc_feature: GYAE6OF01BXFNO.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgttagcagcaacttagcctggtaccagcaagaaagttggccaggcctcccaggcctcctcattctttggtgtgtccacgtagggccgcgtggtcgtccccagtcaggttccaggtcggcaggtggctcgtgggacaggtagttcactctcacctatcagcagcctgcacgtctagaagttattttgacttaagtttacttacgtgtactagactaatataatacgtcgtcggacctcggtagttcgtcgttacgtttcgggacccggtaacggggtaacccaaggtccgtaagggaacgtaacgtaccgtaaaacggtaaccgttggtacgggtcgtaacccgg

SEQ ID NO: 241984 - DNA, 502 bp, Homo sapiens
  misc_feature: GYAE6OF01ER2Q8.35.85.H08.1.454.CMB.1.raw
  modified_base (293)..(293): a, c, t, g, unknown or other
  misc_feature (293)..(293): n is a, c, g, or t
  modified_base (365)..(365): a, c, t, g, unknown or other
  misc_feature (365)..(365): n is a, c, g, or t
  modified_base (368)..(369): a, c, t, g, unknown or other
  misc_feature (368)..(369): n is a, c, g, or t
  modified_base (371)..(371): a, c, t, g, unknown or other
  misc_feature (371)..(371): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
tcagtacagatcgtcacgaccggtgctcgatttagtatcactcagtcgcggggaggaactgctcagttaggacccagacggaaccatggagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttgngtgtccactagggccgctggtcgtcccagtcaggttcagtggcaggtggctctgggacagagttcactctcnacnncngcngctgcngtcagagtnttnctagtttatactntnagataataataagtagtcgtcgtcctcgtagtcgtcgtacgtttcggccgaggggacctagcgtaggacgtaactacgaaacgtacgtgtggtcg

SEQ ID NO: 241985 - DNA, 539 bp, Homo sapiens
  misc_feature: GYAE6OF01A1Z5D.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcatctttggtgtcgtcccacgtacgggcccgtcgttgggtcgtccccgaggttccgagggtttcaggtggcaggtggctcgtgggacagagttcactctcaccatcagcagcctgcagtctagaagtattttgctagtttattactgtctagtactaatataatagctcggtcctcgtagttcgcttacgtttcggaccgtacggggaccaaggtcgtagggagacgtacgaaacgtaatcggtggtcgtacg

SEQ ID NO: 241986 - DNA, 634 bp, Homo sapiens
  misc_feature: GYAE6OF01ETBDD.35.85.H08.1.454.CMB.1.raw
  modified_base (208)..(208): a, c, t, g, unknown or other
  misc_feature (208)..(208): n is a, c, g, or t
  modified_base (303)..(303): a, c, t, g, unknown or other
  misc_feature (303)..(303): n is a, c, g, or t
  modified_base (381)..(381): a, c, t, g, unknown or other
  misc_feature (381)..(381): n is a, c, g, or t
  modified_base (629)..(629): a, c, t, g, unknown or other
  misc_feature (629)..(629): n is a, c, g, or t
tcagtacagatcgtcacgaccggtgctcgatttagtatcactcagtcgcggggaggaactgctcagttaggacccagacggaaccatggaagccccagcgcagcttctcttcctcctgctactctggctcccagataccactggagaaatagtgatgacgcagtctccaaccactctgtctgtgtctccaggggacagagccaccctntcctgcagggccagtcagagtgttagcagctaaacttgcctggtaccagcatcgaaaaggtttgggcccaggggcctccccaggcctcccgttcncgtttcgtttcggtcgttcgtccgtaacggtcggccgtcggttcggtaccgtaccgtacgtcggtacggtacgtcggnggtacggtagggtacggtcgtcggttacggacgtacgtacgttaccgtacttcctacctacactaccgacgtaccgacgtccgtcgtacgtacgttcggtaagtaacgtttagtttacgtacgtttacgtttaacttacgtacgtagactaacgtaacttaagttacgtacgtcggtcgtcccgtacgttagtcgcgttacggttaccgcggtacgacgagcgagtagactacgaacgtagcggtcgngtacg

SEQ ID NO: 241987 - DNA, 579 bp, Homo sapiens
  misc_feature: GYAE6OF01EU3ON.35.85.H08.1.454.CMB.1.raw
  modified_base (191)..(191): a, c, t, g, unknown or other
  misc_feature (191)..(191): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggcaccgtcctccagggacgcccatgctgcaagtcggccagaggtgcccctgaacctgaaggccaatgagacccaagacaggccaaggtggtgtgacgaccctgagagctgggccctggtcccaggcagcgctcggccctgctgctgctggtctggcagtcgcgccatcgctgctcgcgccagtgtcgcaccgcgaacgccgggacccaggtacccgtggaccgcctacgtacggttacggaacgccgacgccgacgtacccaaggcccgttggaccggggacgtcccggttacgggtcgggggaccgtacgggtacccgaacgggaccccgaaccggtcccctaaaccccccgg

SEQ ID NO: 241988 - DNA, 599 bp, Homo sapiens
  misc_feature: GYAE6OF01EXH5W.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctcctcctgcagggccagtcagtagtgtagcagacaacttagcctggtaccagcaaggtaaagttcggccagggcctccgaggctcctctattcgtttgggtgttcgtacccgacgtacggggcccgtcgtcgggtcgtccccgaggttccgaggtttcaggtggctaggtggccgtcgtaggggactaggtacgttccaccttcctaccaacctagtccgagccgacgcctagccagttctaggtaattgttttgactttagttttattacgtgtacagactaattataatgtctggtccctacgtagttcgccttacgtttcgggaccggtagggacctaaggtcgtaggaagtaacgtaaccgaaacgtacgtcggtcggtcgtacgg

SEQ ID NO: 241989 - DNA, 551 bp, Homo sapiens
  misc_feature: GYAE6OF01E2XNL.35.85.H08.1.454.CMB.1.raw
  modified_base (407)..(407): a, c, t, g, unknown or other
  misc_feature (407)..(407): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcagaaagttggccaggcctcccgaggcctcctcattctttggtgtcgtccacgtagggccgcgtgggtcgtcccagtcaggttcagtggctagtggctcgtgggacagtagttcactctccaccatcagcagcctgcagtctagaagtntttgcttagtttacttactgtcagactaatataatagtcgtcggtcctcgtagttcgaccgttacgtttcgggaccggtaacggggtaaccctaaggccgttaggaacgtaagtaaccgaaacggtacgtcggtggtccgtacg

SEQ ID NO: 241990 - DNA, 635 bp, Homo sapiens
  misc_feature: GYAE6OF01D1FLD.35.85.H08.1.454.CMB.1.raw
  modified_base (404)..(404): a, c, t, g, unknown or other
  misc_feature (404)..(404): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatgctgcaaggtcggccagaggtcgcccctgaacctgaacgccaatgacgacccaagacacggaccgaaggtgggttgaggacgaccccgtggaggacgcgtcggcccgtcggtcccgaggccacggcgcgtcggcccctgcctgctgcgtggtcncggccgagtcggtccgccctagtcgcctgcctcgccgacccgtagtcggttcgaccgacgacggaacggccgggaacccgacgacccgtgggacctccgtacgtacgttacggacgtaccgacgccgacgtcccgaacggtcccgtacgggccggtacggtcccggtcgggttcggggaccgtacgggtacccgaccggacccccggaaccgggaccccctaaacccccgg

SEQ ID NO: 241991 - DNA, 520 bp, Homo sapiens
  misc_feature: GYAE6OF01E4L0L.35.85.H08.1.454.CMB.1.raw
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggngtgtccactagggccnctggtgtccccagtcaggttcaggtggcagtggctgnggggacagagttcactctcaccatcagcagcctgcagtctgaagtattttgactagtttacttactgtcagtcaatataatagctggcctcggtagttgctacgttttcggacccgtaggggacccaaggtccgtagggagtactaaccgaaacgaacgtggtggcgtacgg

SEQ ID NO: 241992 - DNA, 546 bp, Homo sapiens
  misc_feature: GYAE6OF01AUTGL.35.85.H08.1.454.CMB.1.raw
  modified_base (199)..(199): a, c, t, g, unknown or other
  misc_feature (199)..(199): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgagggggaanagccatcctctcctgcagggccagtcagagtattcggaacacgtagtctggtaccagcagaaacctggccaggcctcccgaggcctcctcatctatggtgcactccaccgagggccacgtggtactccccagccctaggttcaggtgcaggtgggtctgggacagacttcactctcaccatcagcagcctgcagtctagaagtattatgctagtttactctactgtcagtctagtttaatacgtctcggcccgtcgtccgttccgttccgtttcgggaccgggtaacgggaccgtaagggtcgggtaagaacgtaacgaaaacgtacgtaggtaggcgtcgctaccg

SEQ ID NO: 241993 - DNA, 560 bp, Homo sapiens
  misc_feature: GYAE6OF01D9P9P.35.85.H08.1.454.CMB.1.raw
  modified_base (468)..(468): a, c, t, g, unknown or other
  misc_feature (468)..(468): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaaacttagcctggtaccagcaagaaagttggccaggctcccaggctcctcattcgtttggtgtcggtacccacgtacggggcccgtctgggtcgttccccgaaggttccaaggggtttcaggttgggactaggtgggcttcgtggggactaggtagtttccacttctacaccatcagcagcctgcagtctgtatgtattttgctagtttattactgtcagtctattatanacttaacgtcggaccgttccgtgggtacgttcggacccgaagggaccgtaagggtacggaagtacccgaagaacgtggaggatcgctatacg

SEQ ID NO: 241994 - DNA, 685 bp, Homo sapiens
  misc_feature: GYAE6OF01BGMKP.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttagccgtggtaccagcaagaagtggccaggctcccgaggcctcctctatcgtttggcgtcgtcctagtacgggcctcgtggtcgtcccaggttccgaggtttcaggtggacctagggtcgtcgtcgtaggggactaggtacgttccacgtctcgacctactcaacgcgacgtccctgacgtagtcctaaggtaagttagttttcgacgtttacgttttaacttacgttagttacgacgttaactaaattaagttaaacgttaacggtccgttacgggtacccgttaccggtacggtttaccggtaccgtttaaccgggttttacgggaacccggtaacgggggtaaacccctaagggttacccgggtagggtaaacggttaacccgttaaaccggtaaaaccggttaaacggttcgggtacccgggtacccgttaaccggg

SEQ ID NO: 241995 - DNA, 586 bp, Homo sapiens
  misc_feature: GYAE6OF01DU7LJ.35.85.H08.1.454.CMB.1.raw
  modified_base (297)..(297): a, c, t, g, unknown or other
  misc_feature (297)..(297): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgtagcagcaacttagcctgtaccagcaagaagttggccaggcctccaggctcctcattcgttttggngtcgtccctacggtacggggcccgtcgttgggtcgtccccgtaaggttccgtaacggggtttccaagggttgggacctagggttcggcttcggtagggggaccaggtacgttccaacttcctacacactcagcagcctgcagtcagtaacgtattttcgacttagtttacttactcgtcaagtactaataattaagtagtcgtacggtcctccggtagttcgtcttacggtttcggaccgaacgggtacaggtcgtaggaacaacgtacgaaacgtagtgtgtcgtacg

SEQ ID NO: 241996 - DNA, 811 bp, Homo sapiens
  misc_feature: GYAE6OF01A3886.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgccgagggccagtcaggtacgtgttagcagacctaacgttagcccgtaggtaaccgagaccgaaggtaaacggtttcggacccgaagggtccccgttcccccgaacggggtccctttaccccgtacgtaacgtttccggttttcgggtcggtttccggtaccccgtaaccgggttaacggggcccccgtcggtttcggggttacccgttacccccgtaagggttcccgtaaagggggtttcccgtaaggggtcgggtaacccgttaggggtcggtacccgtttcgggtacggggaacgtaacggttacgtttcccgaacttccgtaccaacctacgtacgacggacccgtacgtccgttaggttaacgtccgttaaggtaacgttagtttttaggacttagttttaacgtttacgtcgttacgacgttaacgtaattaagtaaacgttacgtaccgttcgggttacccgttcggttacgtttcgaccgtttccggtttacgggacccggtaacggggaccggtaacgacggtacgggtaacgtaaccgttaacggtaaaaccggtacgttgggtaccggtacgtccggtaacccg

SEQ ID NO: 241997 - DNA, 537 bp, Homo sapiens
  misc_feature: GYAE6OF01A5HCQ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagtgccaggctccaggctctcattcgttggtgtgtccagtacgggccgtcgtggtgtccccagtccaggttcaggttggctagtggctctggggactagagtttcactctacgacctatcagcagcctgcagtctagaagtatttgactagtttatactgtacagtactaatataatagacttcggcctacgtgttcgtacctacgtttacgggccgtaacggggaccaaggtcgtacggagtacgtaccgaaacgtaacgtcgtaggtctacgg

SEQ ID NO: 241998 - DNA, 579 bp, Homo sapiens
  misc_feature: GYAE6OF01CJ3MC.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcaagtaagttggccaggcctcccgaggtcctcctcattctttggtgtgtccgacgtacgggcccgcgttgggtcgtccccagtcgtaggtttcaggtggctaggtggctcgtgggacaggtagttcactctcaaccatcacgcacgcctgctagtctagaagttagtttgtctagtttattactgtactagtactaatattaagtagtcgtcggtccttaccggtagttcgtccgttacgtttcggaccggtacggggaaccgtaacggtcggtacggaacgtacgtaaccgaaacgtaacgttacggtcggtcgtaccgg

SEQ ID NO: 241999 - DNA, 527 bp, Homo sapiens
  misc_feature: GYAE6OF01D9PGD.35.85.H08.1.454.CMB.1.raw
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttagcctggtaccagcaagaaagttggccaggctcccgaggctcctcattctttggtgtgtccacgtagggccgctgggtcgtcccagtcaggttcagtggcaggtgctcgnggacagngtcactctcaccatcagcagcctgcagtctgaagtatttgctagtttatactgtcagcaatataagtagctcggcctcggtagttgtcttacgtttgggacccgtagggggaaccaagggtcgtagggagtaacgtaccgaaaacggtacgttggtggtcgtacg

SEQ ID NO: 242000 - DNA, 674 bp, Homo sapiens
  misc_feature: GYAE6OF01CG2L3.35.85.H08.1.454.CMB.1.raw
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttagcctggtaccagcaagaaagttggccaggcctccgaggctcctcattcgtttggngttcgtccacgtacgggccncgttgggtcgtaccccgtaggtccgtagggtttccaagggttggaccgtaggttcgggccttcggtggggtaaccaggtacgtttccaccgttcctaccgacctactaccgacgccacgtcctgaccgtacgtcgtaggtaagttattttcgacttaagttttactttacgtcgttacagtaactaaattaacgtaaattacggtaccgttacgggtacccgttaccggtaagtttcggttaccgttaaccgtttttcggggaacccggtacgggggtaacctaacgggtccgttaagggaacgtaacgttaaccgaaaaccggttaacggtacggttcggaccgttaccgg

SEQ ID NO: 242001 - DNA, 619 bp, Homo sapiens
  misc_feature: GYAE6OF01DXZLN.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtctaccaaccactctgtctgtcgtctccgaggggacagacgcccaccctctcctgcgagggccagtcagtagtgtagcagactaacttgcctggaccagcaagtaagtggaccaggcctccgaggcctcctctacttcgtttggtgtcgtccgacggtacgggccctgtcggtcgtcccgtagtccgtacggttcagggtcggacgtacggtggtcctcggtggaactagtcgttccactcctacaccgtatcagcacgtcctgactagttcagtattgttatttgactttaagtttcttacgtgtacacgtacttaagttgtacgtaacttaccgcggtacccgttccggtagggtacccgttccgggaaccggaaacgggtaccgtaaggggtacgtaaaccgtacccgaaaggtcgtacgggtacggacccgtacgaccctaccgttaacg

SEQ ID NO: 242002 - DNA, 558 bp, Homo sapiens
  misc_feature: GYAE6OF01CMR3J.35.85.H08.1.454.CMB.1.raw
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
  modified_base (344)..(344): a, c, t, g, unknown or other
  misc_feature (344)..(344): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccactagggccgntggtgtcccngtcaggttcagtggcagtgctcngggacagtagttcactctcaccatcagcagcctgcagtctagaagtatttgcttagtttacttactgtacagtcaattataatagtcttcggacccttcggtacgttgtaccgttacgttttgggacccggtaacggggaacccgtaacggtcgttacgggtaaagtaacggttaaccgaaaaacggtacgtttacggtcggtacgttaaccgg

SEQ ID NO: 242003 - DNA, 551 bp, Homo sapiens
  misc_feature: GYAE6OF01C50NX.35.85.H08.1.454.CMB.1.raw
  modified_base (303)..(303): a, c, t, g, unknown or other
  misc_feature (303)..(303): n is a, c, g, or t
  modified_base (364)..(364): a, c, t, g, unknown or other
  misc_feature (364)..(364): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccaccctctcctgcagggccagtcagagtgttagcagctaattagcctaggtaccagcaagaaagttggccaggcctccgaggcctcctcattcgtttggngtcgtccagtacgggcctcgtggtcgcctagtcacggttcagtgcagtcggctcgtggacngtagtcacgtcacacatcgagcagcctgcacgtacgagtaagtagttttacgacgtagttttacttacgtcgtactagactaatataatgtcgtcggcctacgagttcgacttacgtttcggaccgtaggggtaccaaggtcgtagggaagtacgtaaccaaaacggtacgtacggtggtcgtacgg

SEQ ID NO: 242004 - DNA, 665 bp, Homo sapiens
  misc_feature: GYAE6OF01B6K6Q.35.85.H08.1.454.CMB.1.raw
  modified_base (117)..(117): a, c, t, g, unknown or other
  misc_feature (117)..(117): n is a, c, g, or t
  modified_base (120)..(120): a, c, t, g, unknown or other
  misc_feature (120)..(120): n is a, c, g, or t
  modified_base (126)..(126): a, c, t, g, unknown or other
  misc_feature (126)..(126): n is a, c, g, or t
  modified_base (151)..(151): a, c, t, g, unknown or other
  misc_feature (151)..(151): n is a, c, g, or t
  modified_base (161)..(161): a, c, t, g, unknown or other
  misc_feature (161)..(161): n is a, c, g, or t
  modified_base (191)..(191): a, c, t, g, unknown or other
  misc_feature (191)..(191): n is a, c, g, or t
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (384)..(384): a, c, t, g, unknown or other
  misc_feature (384)..(384): n is a, c, g, or t
  modified_base (406)..(406): a, c, t, g, unknown or other
  misc_feature (406)..(406): n is a, c, g, or t
  modified_base (417)..(417): a, c, t, g, unknown or other
  misc_feature (417)..(417): n is a, c, g, or t
  modified_base (447)..(447): a, c, t, g, unknown or other
  misc_feature (447)..(447): n is a, c, g, or t
  modified_base (543)..(543): a, c, t, g, unknown or other
  misc_feature (543)..(543): n is a, c, g, or t
tcagtacagatcgtcacgaccggtgctcgatttagtatcactcaggtcggcgggggaggaactgctcagttacggacccagacggaaccatggaacgcccagcgcagcttctctccnctnctatcngcctaccagatactcacgtgggaanaaatggtagntcgacgctatccaccaaactcgtctgtacngtgtcaccggaggacncggacgcccaccgtntccgngcgacggccagtacagagttcgtanacngtacctaacgttcggccttaggtacagtagaagtacggtccgaccgaggccctaccgaaggccctcgtacacgtttcgttcgacgtaccggtaccctaacgggcggtccctcggtcggtacctcccggnttaccgtaggggttccaggggntacccgtaggnggtcctcggaagacgaatccgtcaaccgtntaccaactacgacactcgacggtctacggacgtataccgtaaggtacgttattacgacctttaagtttactagtaccgtaactaagtaaccttaanaacgttaacgtccgtaccgtcggtaacccggttatacccggttgtaccggttaaccgtcggggaacgaaccgggtaacaggtcgtaaggaacttactaaccgaagttacggcacgggtcacg

SEQ ID NO: 242005 - DNA, 782 bp, Homo sapiens
  misc_feature: GYAE6OF01DR1DS.35.85.H08.1.454.CMB.1.raw
  modified_base (130)..(130): a, c, t, g, unknown or other
  misc_feature (130)..(130): n is a, c, g, or t
  modified_base (140)..(140): a, c, t, g, unknown or other
  misc_feature (140)..(140): n is a, c, g, or t
  modified_base (169)..(169): a, c, t, g, unknown or other
  misc_feature (169)..(169): n is a, c, g, or t
  modified_base (193)..(193): a, c, t, g, unknown or other
  misc_feature (193)..(193): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (500)..(500): a, c, t, g, unknown or other
  misc_feature (500)..(500): n is a, c, g, or t
tcagtacagatcgtcacgaccggtgctcgatttagtatcactcaggtcggcgggggaggaactgctcgagttacggacccagacggaccatggaacgccccagcgcagcttctctcctcctgcctatcgngcctccagtntatcacgtggaacgtaatgtagctcgacnctacgtctacccgaactctctgtntcgtgtcctcggaggacngtcncctactctccngccaggctgacngtagttgtacgcgtacaccttacgtcgtaccgtacggtaacacggtacgtaaagttaccggtccggaccgaccggtacccgtacccgacggtcccttacccgtaccggttagtttccggttacgtccggtaccgtaccgtaacggtccggtccgttcgtcggttaacctcccgaagttctacggttacgcggtacgtccgtggtcctcggttaccggacgggtactacggtaaccggtttccacctttcggaaccctaaccncttacggtaaccgtgaaccggtcccttacggaaccgttcgttaaggaccgttaaggttttacgttcgtaccgttttaaggttttccagggtaccttaaccgttaggtaaccttaaagttacgttaagggtcccccgtaggtttaaccggtccctttagggtaaccggttcgtttaaccggtttcccgttaccgggggtaaccggtaaccgggaacctttagggtcggtaaaccgagttaacccgtaaacggtaaccgttcggtacggtgtacccggtacccg

SEQ ID NO: 242006 - DNA, 632 bp, Homo sapiens
  misc_feature: GYAE6OF01BEPAT.35.85.H08.1.454.CMB.1.raw
  modified_base (355)..(355): a, c, t, g, unknown or other
  misc_feature (355)..(355): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaaagttggccaggcctccaggcctcctcattcgtttggtgtgtccacgtagggcccgcttggtcgtcccagtcaggttcagtggcagtggctcgnggactagagttccacgtcctcaccactcgacgcacgccctgacgacgttctacggtaagtagtttttgcttaaggttttaacttacgttacgttactaaggtactaaaatttaattaaagttacgtaccgttacggtccccgttaccggttaaggtttcgtaccgtttaccgttttaccggggaccggtaaccgggggtaacctaaacggggtcttaacggggaagttaacgtaaccgtaaaaccggtaaccgttacgggtacgggtcgtaacccgg

SEQ ID NO: 242007 - DNA, 567 bp, Homo sapiens
  misc_feature: GYAE6OF01CMDD4.35.85.H08.1.454.CMB.1.raw
  modified_base (377)..(377): a, c, t, g, unknown or other
  misc_feature (377)..(377): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaaagttggccaggctcccgaggctcctcattctttggtgtgtccacgtacgggccgctgggtcgtccccagtctaggttcagtggcaggtggctcgtgggacagtacgttcacgtcncgacatcagcacgcctgcgtagtctagtaagtagttttgacttagtttattactgtacgaagtacaattataaagttacgtccgttacggtcccttacggtacgttcggtacttaccggtttcggacccggtacgggtaccgaaggtcgtacggaagtacgtaacgtaaacgtacgtggtcggtcgtacg

SEQ ID NO: 242008 - DNA, 515 bp, Homo sapiens
  misc_feature: GYAE6OF01BFU1I.35.85.H08.1.454.CMB.1.raw
  modified_base (296)..(296): a, c, t, g, unknown or other
  misc_feature (296)..(296): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctccgtcatctttggngtgtccacgtagggccgctggtgtcccagtcaggttcagtggcagtgctgtgggacagagttcacgtctacaccatcagcagcctgcagtctagaagtattttgctagtttatacttgtcagtactaattataatagcttcggccttcggtagttcgcttacgttttcgggaccgtaggggtaccaggtcgtaggagatacaaacgtactgtggcgtcg

SEQ ID NO: 242009 - DNA, 496 bp, Homo sapiens
  misc_feature: GYAE6OF01EOZZ8.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttgaccaggcctccaggctcctcattctttggtgtgtccacgtagggccgcttggtcgtcccagtcaggttcagtggcagtgctcgtgggactagagttcactctacacctatcagcagcctgcagtctgaagtatttgctagtttatactgtcagcaatataatagctgcctcgagttgactacgtttgcgtagggaccagtcgtagagactacaaacgaactgtgctacg

SEQ ID NO: 242010 - DNA, 635 bp, Homo sapiens
  misc_feature: GYAE6OF01EVMN2.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctctgctattctggctcccagatatcactggagaaatagtgatgacgcagtcctccaaccactctgtctgtcgtctccgaggggacagacgcccaccctctcctgcgagggccagtcagagtgtagcagacaacttagcctaggtaccagcgaagtaagtcggccaggcctcccgaggcctcctctattccgtttggtgttcgtacccgacgtacggggcccgtcgttcgggtccgtaccccgtaggtccgtaaggtttccgagggttcggacgtagggtccgggtctcggtagggtaccaggtacgttcaccttcctacaacctatccgacgcgtacgcctgtcgtacgtccgtaggtaacgtttagttttgacgtttagttttaacttacgttcgtacgtagtactaaattataagtcgtacgtcggtaccctacggttacgttcgtacgttacggtttcggaccggtaacgggacctaaggtcgtaggtacgacgtaacggtaaaccg

SEQ ID NO: 242011 - DNA, 591 bp, Homo sapiens
  misc_feature: GYAE6OF01DR334.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctggtaccagcaagaaagttggccaggcctcccaggctcctcattcgtttggtgtcgtccgacgtacggggcctcgttgggtcgtaccccaggttcgaagggtttccaggtcgggactagggtggtcctcgtgggggaactaggtacgtttcaccgtctaccacactcaagccacgcctcgctacgtcgtagaagttatttgtacttagtttattacttgtactagactaatataatagtctcggtacctacgtacgttcgtacgttacgtttacggaccggtacgggaccgtaaggtcgtacggaagtacgttaacgaaacgtaagtcggtaggcgtacgg

SEQ ID NO: 242012 - DNA, 557 bp, Homo sapiens
  misc_feature: GYAE6OF01EHYIG.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatcgtttggtgtgtccacgtagggccgtcgtggtcgtccgagtcgtaggttcagtggctaggtggctcgtgggacaggagttcactctacaccatcagcacgcctgcgagtcgtagaagttatttgacgttagtttattacgttgtcgtagtacaattataagtagtcgttcggtccttaccggtagttcgccttacgttttcggaccggtacggggacctaacgggtcgtacgggagtaacgtacgaaacgaagttcggtcggcgtacg

SEQ ID NO: 242013 - DNA, 554 bp, Homo sapiens
  misc_feature: GYAE6OF01D80OZ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccacctctcctgcagggccagtcagagtgttagcagcaacttagcctggtaccagcagaagtgccaggctcccaggcctctcattcgtttggtgtcgtccacgtagggccgtcgtgggtcgtccccgagtccaggttcaggtggcaggtggctcgtgggacaggtagttcactctcaccatcagcacgcctgcagtctagtaagtatttgactagttttattacttgtctagtactaatataagtacgtcgtcggtcctccgtagttcgtacgtacgttttcgggacccggtaacggggaccctaaggtcgtagggaagaacgtacgaaaacgtacgtaggtggtcgtaccgg

SEQ ID NO: 242014 - DNA, 732 bp, Homo sapiens
  misc_feature: GYAE6OF01CMJSM.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgtagcagacaacttagcctggtaccagcgaaggtaaagttcggccacggctaccccgaggtcctccgtctagttcgtttgggtcgtcgtaccgacgtacggggcccgtcgttcgggtcgtcccgaagtccgtaggggtttccagggttcgggacgtaggttgggccttcggtagggggaactagggtacgtttccgaccttcctaccctaacctaacgtaccgacggtaccgacggtccctacggaccgtacgtaccgttaggtaagttacgtttttacgacgtttagttttaactttaaccgttggtaacctaagtaacctaaagtttaacgttaaagttacggtaccgttacggtacccgttaccggttacggtttccggtaccgtttaccgttttcggggaccccggttaacgggggtaaccctaacgggttcggtacgggtaaacgtaacgtaaaaccgtaaacggtaaccgtttagggtacggtccgtaaccggg

SEQ ID NO: 242015 - DNA, 523 bp, Homo sapiens
  misc_feature: GYAE6OF01A58EP.35.85.H08.1.454.CMB.1.raw
  modified_base (412)..(412): a, c, t, g, unknown or other
  misc_feature (412)..(412): n is a, c, g, or t
  modified_base (463)..(463): a, c, t, g, unknown or other
  misc_feature (463)..(463): n is a, c, g, or t
  modified_base (519)..(519): a, c, t, g, unknown or other
  misc_feature (519)..(519): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttcggccaggcctcccaggcctcctcattctttggtgtcgtcccacgtacgggcccgcgtgggtcgtccccagtctacgggttcaggtggcaggtcggctcgtgggacagacgttcactctcaccatcagcacgcctgcagtctgatntttgctagtttatatgtacagactaatataagtagctcggcctcgtagttntctacgtttcggccgtacgggaccaggtcgtaggagactacgaacgtaagtgtggntacg

SEQ ID NO: 242016 - DNA, 856 bp, Homo sapiens
  misc_feature: GYAE6OF01BOBV8.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcacgggccagtcagagtgtagcagcaacttagcctggtaccagcaaggaaagtcggaccaggcctcccgaggcctcctcattcgtttggtcgtcgtacccgtacgtacggggcccgtcgttcgggtcgtccccgtaggttccgtaacggggttttccaaggggttcgggaccgtaagggttcggggtcccgttcgggttagggggaaaccctagggtaacggttttcccaaaccgtttccctaccgtaaacccgtaaccgttaccgaacggtaccgaacggtccccgttacggtaccgtaacggttacccgttaagggtaaacggtttaacgtttttacgggtaaccgttttaaacgtttttaacgttttaacccgtttaggttaaccgtaacggttaaccgttaaaattaaacgttaaaacgttaaccggttaccggtttaccggggttaccccgttaccgggttaacggtttaccgggttacccgtttaaccgggttttttaccgggaacccgggttaaaccggggggtaaccccgtaaacgggttacccggttaaccgggggtaaacggtaaaccgttaaacccggaaaacccgggttaaaccggtttacgggttacgggtacccggttaacccggg

SEQ ID NO: 242017 - DNA, 593 bp, Homo sapiens
  misc_feature: GYAE6OF01DA5TU.35.85.H08.1.454.CMB.1.raw
  modified_base (474)..(474): a, c, t, g, unknown or other
  misc_feature (474)..(474): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcagggacgcccatgctgcaagtcgggccagaggtcgccctgaacctgaaggccaagtgacgaccaagaccgaggccaagtgggttgtgacgaccctggacggagcgtcgggccctggtcccaggcgagccgcgtcggcccctggccgtgcgtcggcgttgggtcctgggccctagtcggtccgccgagtcgctgctcgcgccagtgtcgccacgacgaacggccgggaccacgacccgnggacgccgtacgacggttcggaacgccgacgccgacgcccgtacgcccgtggaccggacgtcccgtacgggcgggacgtacgggtacgaccggaccccgaaacggccccgtaaaccccg

SEQ ID NO: 242018 - DNA, 773 bp, Homo sapiens
  misc_feature: GYAE6OF01DF656.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctaggtaccagcagaagttggccaggcctcccgaggcctcctacatttccgttttgggtcgttcgtaccctacgttacggggcccgtcgttcgggttcgtccccgaagggttcccgtaagggttttccgaagggttcgggccgtaagggtcgggtccgttccggttagggggaacctaagggttacggtttacctaaccgttccttaccaacccgtaacgttccgaacggtacccgtaacggtccccgttaggacccgtaacggtttaccgtaaggtaaacgttttacgtttttacggaccgtttaaacggttttttaacgtttacgttacgggttaactacggtaaccttaaaagtttaacttaagttacggtaccgttacgggtacccctttacgggtaaggttttccggtaccgtttaaccggtttttcggggaaccccggttaaacgggggaaccctaaacgggtaccggttaggggtaaacgtaaccgttaaaccggtaaaaaccggg

SEQ ID NO: 242019 - DNA, 556 bp, Homo sapiens
  misc_feature: GYAE6OF01DWDDL.35.85.H08.1.454.CMB.1.raw
  modified_base (305)..(305): a, c, t, g, unknown or other
  misc_feature (305)..(305): n is a, c, g, or t
  modified_base (393)..(393): a, c, t, g, unknown or other
  misc_feature (393)..(393): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaaagttggccaggctcccaggcctcctcatcgtttgtgggggtntccgacgtacgggccgctgggtcgtccctagtcgaggttcagtggcaggtggctcgtggacagtagttcactcgtacaccatcagccngccctgctagtctaggtaatagttttgacttagttttattacgtgtcaagctaaattataacgtagcttcggtaccttccggtaagttcgaccttacgttttggacccggaggggtaacccaaggtcgtaggagtaacgtacgaaacgtagtgtcggctaccg

SEQ ID NO: 242020 - DNA, 620 bp, Homo sapiens
  misc_feature: GYAE6OF01BEEBW.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccaggggacagacgccaccctctcctgcagggccagtcagagtgttagcagcaacttagcctggtaccagcaagaaagttggccaggcctcccaggcctcctcattcgtttggtgtcgtcccacgtacggggcccgcgttgggtcgtccccgaggttcgtagggtttcaggttcgggctaggtgggccttcgtggggacaggtacgtttccacttctacaccactcacgcacgccgtgcgtacgtctagtaagtacgttttcgacgttagtttacttacgttgtactacgtactaaattaagtaagtagtccgttacggtcccgtaccggtagttcgtaccgttacgttttcgggacccggtacggggtaacccgtaacggtcgtacgggtaacgtaacgtaacgaaaccgtaacgttcggtcggtcgtacgg

SEQ ID NO: 242021 - DNA, 497 bp, Homo sapiens
  misc_feature: GYAE6OF01CCCW1.35.85.H08.1.454.CMB.1.raw
  modified_base (324)..(324): a, c, t, g, unknown or other
  misc_feature (324)..(324): n is a, c, g, or t
  modified_base (486)..(486): a, c, t, g, unknown or other
  misc_feature (486)..(486): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaaagttggccaggctcccaggctcctcatctttggtgtgtccactagggccnctggtgtcccagtcaggttcagtggcagtggctcgtgggacagagttcactctcaccatcagcagcctgcagtctgaagtattttgctagtttattactgtctagtctaatatatagctgcctcgagttcgctacgtttggccgtagggacctagctagganagtcgtaaacg

SEQ ID NO: 242022 - DNA, 613 bp, Homo sapiens
  misc_feature: GYAE6OF01CH2DW.35.85.H08.1.454.CMB.1.raw
  modified_base (383)..(383): a, c, t, g, unknown or other
  misc_feature (383)..(383): n is a, c, g, or t
  modified_base (395)..(395): a, c, t, g, unknown or other
  misc_feature (395)..(395): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgtagcagcaacttgcctggtaccagacaagtaagtcggaccaggcctccgaggcctcctctattcgtttggtcgtcgtaccgacggtacggggccctcgtcgggtccgtcccgtagtcgtacggttcaggtggcaggtcgctggtggacngtacttcactcncacatcagcacgcctgctacgtcgtagtaagttatttgacgtttaagtttacttacgtgtactaacgtactaaatacgttaaacgtacgtccgttacggtcccttacggtaacgttcgtaccgtttacggtttacgggaacccggtaacggggtaacccaagggtcgtagggtaaacgtacgtaaaccgtaaaacggtacgtgggtacggtcgtaccg

SEQ ID NO: 242023 - DNA, 580 bp, Homo sapiens
  misc_feature: GYAE6OF01CZGIJ.35.85.H08.1.454.CMB.1.raw
  modified_base (366)..(366): a, c, t, g, unknown or other
  misc_feature (366)..(366): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggaccaggcctccgaggctcctcattctttggtgtcgtccacgtacgggccgtcgtgggtcgtccccgagtccaggtttcaggtggcaggtcggctcgngggacagtagttcactcctcaccatcagcacgcctgctagtacgtagtaagttagtttacgtacgtttagtttactttacgtcgtacgagtaactaataagttaagtacgtcgtcgtacccgtcgtacgttcgtacgttacgtttacggaccgggtacgggtaacgaaggtcgtaggaagtacgtaacgaaacgtacgtacggtcggtcgtacg

SEQ ID NO: 242024 - DNA, 566 bp, Homo sapiens
  misc_feature: GYAE6OF01B11RD.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttagcctggtaccagcaagaagttggccaggctcccaggcctctcattcgtttggtgtcgtcccacgtagggccgtcttgggtctcccagtcaggttcagtgcagtggctcgtggacaggagttcactctacaccatcagcacgccgtgctagtctagtaagttattttgacttagtttacttactgtacagtactaaattataatacgtcgttcggtacctcgtagttcgtacgttacgtttacgggaccggtaacggggtaccaaggtccgtagggaacgtaacgttaacgaaacggtaacgtttggtacggtccgtaacg

SEQ ID NO: 242025 - DNA, 564 bp, Homo sapiens
  misc_feature: GYAE6OF01CXEGP.35.85.H08.1.454.CMB.1.raw
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctaggtaccagacaagaaagttggccaggcctcccaggcctcctcatcgtttggtntcgtccagtacgggccgtgtggtcgtccccagtcaggtttcaagtggcaggtggctcgngggacagacgttcactcacaccatcagcacgcctgcagtctagaagttatttgcttatttattactgtacagtactaattactaatagtcgttcggtaccttccggtagtttcgtaccgttacgttttcggaccggtacggggaacccgaacggtcgtagggtagtacgtaaccgtaaacgacgttaggcggtcgtacgg

SEQ ID NO: 242026 - DNA, 538 bp, Homo sapiens
  misc_feature: GYAE6OF01AUNAG.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcaggccagtcagagtgtagcagcaacttagcctggtaccagcagaaagttggccaggctcccgaggctcctctatctttggtgtcgtccacgtagggccgtcgttggtcgtccccagtcacggttcaaggtcggctaggtcgggcttcggtgggacctaggtagttccacttcctcaccatcagcacgcctgcagtctagtaagtattttgactagtttattactgtcagactaatataactagctcggcctacgagttcgcttacgtttcggaccgagggaccaacgtcgtaggagtacgtacgtaaaacg

SEQ ID NO: 242027 - DNA, 506 bp, Homo sapiens
  misc_feature: GYAE6OF01ARM1J.35.85.H08.1.454.CMB.1.raw
  modified_base (316)..(316): a, c, t, g, unknown or other
  misc_feature (316)..(316): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtcgtccacgtagggcccngtggtcgtcccagtcaggttcagtggcaggtggctcgtgggacagagttcactctcaccatcagcagcctgcagtctagagtatttgctagtttattactgtacagctaatataatagcgtgcctcgtagttcgctacgtttggccgtacgggaccagtcgtggagactacgaaacgaactgtgtctacg

SEQ ID NO: 242028 - DNA, 585 bp, Homo sapiens
  misc_feature: GYAE6OF01C36XI.35.85.H08.1.454.CMB.1.raw
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctcagggacgcccatgctgcaagtcggccagaggtcgcccctgaaccctgaacggccaatgagacccaagacaggaccaagtcgggtgtcgacgaccctggaggagcgtcgggcccgtggtcccgaggcagcgcgtcggccctgcgtcgctgtcgtcgggtactcggccagtcgggtccgccctagtcggccttgcgtcgccgcccgagtcggttcgccgaaccgacgaaacggccgggaacccacggacccgtggaccgcctcgacgttcgaagcgacgccgatcccgagccgtggcggacgtcccggtggtcgggacgacggtcgacgtcccgaacggccctaaaccccg

SEQ ID NO: 242029 - DNA, 569 bp, Homo sapiens
  misc_feature: GYAE6OF01DCMI1.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcaagaagttggcaggctcccaggctcctcatctttggtgtcgtccacgtacgggccgtcgtgggtcgtccccgaggtccaggtttcgaggtcggcaggtggctcgtgggacaggagttcacttctacacatcagcagcctgctagtctagtaagtagttttgcgtagttttacttacgttgtacgtagtactaattaataatacgtcgttcggacccttcggagtttcgtacttacgttttcggaccggtaacggggacctaaggtcgtaggtaagtacgtaaccgaaaacgtagtacggtcggcgtacgg

SEQ ID NO: 242030 - DNA, 598 bp, Homo sapiens
  misc_feature: GYAE6OF01BKXEP.35.85.H08.1.454.CMB.1.raw
  modified_base (291)..(291): a, c, t, g, unknown or other
  misc_feature (291)..(291): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttagcctggtaccagcaagaaagttcggccaggcctccaggcctcctntattcgtttggtgtcgtaccacgtacgggcctgttggtcgtcccagtcgaggttcaggtggctaggtggcttcgagggactaggtacgttccaacgttctaccgacctatcacgcagcctgctagtctagaagttattttgacttagtttattacgttagtacctaagtactaaattaacttaagtacgtacttcgggtacccttacggtagttcgtccgttaacgttttcgggacccggtaacggggtaacccaaggtcgtagggaacgtaacgtacgaaaacggtagttacggtcggtcgtacgg

SEQ ID NO: 242031 - DNA, 610 bp, Homo sapiens
  misc_feature: GYAE6OF01BYV5Q.35.85.H08.1.454.CMB.1.raw
  modified_base (227)..(227): a, c, t, g, unknown or other
  misc_feature (227)..(227): n is a, c, g, or t
  modified_base (450)..(450): a, c, t, g, unknown or other
  misc_feature (450)..(450): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagngtgttagcagcaacttagccctggtaccagcaaggaaagttggccaggcctcccgaggcctcctcattcgtttggtgtcgttcccaacgttacggggcccgtcgtcgggtcgtcccccgaggttccaaggggtttccaggttcgggactaggttcgggcttcggtaggggaacaggtagtttccaacgtctacacctatcagcacgcctgcagtctagaagtnttttgacgttagtttattactgtacagtactaaataattaagtagtcgttcggccttacggtagttcgtacttacgtttcggaccggtacggggtaaccaaggtccgttagggaaacgtaacgttaaccgaaaacgttaacgtggtcgggacgtaaccgg

SEQ ID NO: 242032 - DNA, 528 bp, Homo sapiens
  misc_feature: GYAE6OF01BWF54.35.85.H08.1.454.CMB.1.raw
  modified_base (296)..(296): a, c, t, g, unknown or other
  misc_feature (296)..(296): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccacgtgggccgctgggtcgtcccagtcaggttcagtggcagtggctcgtgggacagagttcactctcaccatcagcacgcctgcagtctagtaagtatttgacctaacctacttattgtacaactagtacgttacacgtacgcccgcgatcacgtcttcggaccgaacgggacgacggtacgtaggaacgtaagttaaaagacgtaggtacggactcgccacgtacg

SEQ ID NO: 242033 - DNA, 216 bp, Homo sapiens
  misc_feature: GYAE6OF01D4UGP.35.85.H08.1.454.CMB.1.raw
  modified_base (212)..(216): a, c, t, g, unknown or other
  misc_feature (212)..(216): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccaggaactgtggctgcaccatctgtcttcatcttcccgcatctgaacgatctgtactgagcgggctggcaaggcgcatagnnnnn

SEQ ID NO: 242034 - DNA, 575 bp, Homo sapiens
  misc_feature: GYAE6OF01BY8R0.35.85.H08.1.454.CMB.1.raw
  modified_base (373)..(373): a, c, t, g, unknown or other
  misc_feature (373)..(373): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgtagcagcaacttgcctggtaccagcgaagaaagttcggccaggcctccccgaggcctcctcattcgtttggtcgtcgtccacgtacgggcctgtcggtcgtccgaggtctaggttcaggtcggctaggtcgccgttcggngggacctaggtacgtttccaccgttctaccaacctagtccacgcctacgtccgtgcgtagtctagtagtactttgacttagtttatacgtgtacagtactaattactaagtacgtcgtcgtacctacgtagtcgtacgttacgtttacggcgtaacgggacacggtcgtaggaacgtacgtacaacgtagtgtcgtcgtacg

SEQ ID NO: 242035 - DNA, 591 bp, Homo sapiens
  misc_feature: GYAE6OF01EJIVC.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttagcctggtaccagcaagaaagttggccaggcctcccgaggcctcctcattcgttttggtgtcgtccacgtacgggccgcgttggtcgtccccgagtcgtaggttcaggtggctaggtggcttcgtggggactaggtagttccacttcctacacctatcacgcacgcctgctagtcgtagtaagttagttttgacttagttttattacgttgtacagtactaataattaatagtcgtcggtaccctacggtacgttcgtccgttacggttttcggacccggtaacgggtacctaaggtccgtaggaacgtaactaacggaaacgtacggtcggtacggtcgtacgg

SEQ ID NO: 242036 - DNA, 519 bp, Homo sapiens
  misc_feature: GYAE6OF01A1D5Q.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatcgtttggtgtcgtccacgtagggcccgctgggtcgtcccagtcaggttcagtcggcagtggctcgtgggacagtagttcactctcacatcagcacgctgcagtctagaagtatttgctagtttattactgtcagactaatataatagtctcggtacctcgagttcgctacgtttcggaccgtacgggacctaaggcgtaggagtaacgtacgaaacgtagtggtggtctacg

SEQ ID NO: 242037 - DNA, 546 bp, Homo sapiens
  misc_feature: GYAE6OF01DS93V.35.85.H08.1.454.CMB.1.raw
  modified_base (310)..(310): a, c, t, g, unknown or other
  misc_feature (310)..(310): n is a, c, g, or t
  modified_base (354)..(354): a, c, t, g, unknown or other
  misc_feature (354)..(354): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggcaggctccaggctcctcatctttggtgtgtccacgtagggccncgtggtgtcccagtcaggttcagtggcaggtggctcgtgggacngagttcactctacaccatcagcagcctgcagtctgaagttattttgcttaagttttattacgttgtactagtactaattaattaagtagtcgtcggtaccctccggtagtttcgacttaccgttttggacccggtaggggtaacccaaggtcgtagggagtaactacgaaaacgacgtacggtggtctacgg

SEQ ID NO: 242038 - DNA, 522 bp, Homo sapiens
  misc_feature: GYAE6OF01D1WND.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtgtccacgtagggccgctggtcgtcccagtcaggttcagtgcagtgctcgtgggacagagttcactctacaccatcagcagcctgcagtctgaagtattttgctagtttattactgtcagacaatataatagctcggcctcgtagttcgtctacgtttgggcccgtaacggggaccaaggtcgtagggagaacgtaccgaaaacgtaacgtaggtggcgtacgg

SEQ ID NO: 242039 - DNA, 519 bp, Homo sapiens
  misc_feature: GYAE6OF01AIOS0.35.85.H08.1.454.CMB.1.raw
  modified_base (369)..(369): a, c, t, g, unknown or other
  misc_feature (369)..(369): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcatctttggtgtgtccagtagggccgctggtcgtcccagtcaggttcagtggcaggtggctcgtgggacaggtagttcactcncaccatcagcagcctgcagtctagaagtatttgctagtttattactgtacagacaattataatagtctcgcctacgtagttgtcttacgtttgggaccgtacgggaccaggtcgtaggacgactaaccgaaacgtaacgtgtggctacgg

SEQ ID NO: 242040 - DNA, 525 bp, Homo sapiens
  misc_feature: GYAE6OF01CQMAS.35.85.H08.1.454.CMB.1.raw
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (403)..(403): a, c, t, g, unknown or other
  misc_feature (403)..(403): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcattctttggtntgtccatacgggccncgtggtcgtcccagtcaggttcaggttggcagttggccttcgtgggacagtacgttcactctacaccatcagcagcctgcagtctgaagtntttgctagtttatactgtacagtacaatataatagtctaggtcctcgagttgtactacgtttcggaccgtacgggaccaaggtcgtaggagtacgtaccgaaacgtaacgtgtggtcgtacg

SEQ ID NO: 242041 - DNA, 535 bp, Homo sapiens
  misc_feature: GYAE6OF01CBI0A.35.85.H08.1.454.CMB.1.raw
  modified_base (315)..(315): a, c, t, g, unknown or other
  misc_feature (315)..(315): n is a, c, g, or t
  modified_base (359)..(359): a, c, t, g, unknown or other
  misc_feature (359)..(359): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctccaggctcctcattctttggtgtgtcccacgtagggccncgtggtcgtcccagtcaggttcagtggcagtggctcgtgggacngagttcacgtctcaccatcagcagcctgcagtctagaagtatttgactagtttacttactgtacagtactaatataatagtcgtagtacctcgtagttcgctacgttttcggaccgtacgggtacctaaggtcgtaggtaacgacgtaacgaaacggtaactggtcggtcgtacgg

SEQ ID NO: 242042 - DNA, 549 bp, Homo sapiens
  misc_feature: GYAE6OF01B1VM6.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcaagaaagttggccaggcctcccaggcctcctcattctttggtgtcgtcccacgtacgggcccgtcgtggtcgtccccaaggtccagggtttcaggtggcaggtggctcgtggggacaggtacgttcacgtctacaccatcagcacgctgcagtctagaagtatttgctagtttattactgtcagctaatataatagctacggtcctcgtagttcgtactacgtttcggacccgtaggggtaccaaggtcgtacggtaagtaacgtacgtaaacgaagtcggtggtcgtacg

SEQ ID NO: 242043 - DNA, 763 bp, Homo sapiens
  misc_feature: GYAE6OF01D1QAR.35.85.H08.1.454.CMB.1.raw
  modified_base (173)..(173): a, c, t, g, unknown or other
  misc_feature (173)..(173): n is a, c, g, or t
tcagtacagatcgtcacgaccggtgctcgatttagtatcactcagtcgcgggggaggaactgctcagttaggacccagacggaaccatggaagccccagcgcagtcttctcttcctcctgctattctggctcccagatatcactggagaaatgtgatgacgcagtctcaaccnctctgtctgtgtctccgaggggacaggagcccaccgtctcctgcgagggccagtccagagtgttacgcagctaacgttacgcctacggtaccagcgaacggtaaaggttcggacctaggtcctaccccgagggtcctcctctacgttccgttttgggtacgtcggttcccaaggttacggggccctcgttcgggtcgtaccccgtaggtccgtaagggtttcgaaggttgggacacgggtttcgggccttacgggtacggggaactacgggtacgggtttcccaaaccgttttccaaccgaaccctaacgttaccgacgtaccgacgtacccttacggacctaaggttccgttacggttaaggtttacgtttttacggtacgttaacgttttttaagtttaaccgttcggttaccgtaaggtaactaaagttaattaaacgttacgttaccgttcggtacccgttacggttacgtttaccggtcgttaaccggttttcggggacccggtaacggggtacctaaacggttcggtaagggacgttaaacggttaccgtaaaacggttacgtacgggttcggtccgtaaaccg

SEQ ID NO: 242044 - DNA, 682 bp, Homo sapiens
  misc_feature: GYAE6OF01BCZB0.35.85.H08.1.454.CMB.1.raw
  modified_base (229)..(229): a, c, t, g, unknown or other
  misc_feature (229)..(229): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgccagggccagtcagngtgttagcagcaacttagcctggtaccagcagaagttcggccaggcctcccgaggcctcctcattcgtttggtgttcgtccacgttacggggcccgcgttgggtcgtccccaggttcgtagggtttcaggttggcaggtcggctcgtaggggactaggtagtttccacgttcctaccgaacctactaccgacgaccgacggtcccgttggacgtacgttaccgtaggtaagttagtttttacggtacttaagtttttactttaaccgttacgtaccgtaacggtaactaaacttaagttaaacgttacggtaccgttacggtcccgttacccgggtaggtttccgtaccgtttacggttttaccgggacccggtaacgggggtaacccgtaacgggtccgttagggaacgtaacgtaaccgtaaaacggtaacggtggttacgggcgtaccgg

SEQ ID NO: 242045 - DNA, 553 bp, Homo sapiens
  misc_feature: GYAE6OF01DEJ5T.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagtaaagtggaccaggctcccaggctcctcattcgtttggtgtgtccacgtacgggccgtcgtgggtcgtcccagtcaggttcagtggcagtggctgtgggacaggtagttcacttctcaccatcagcacgcctgctagtctagtaagtattttcgacttagtttattacgtgtacgagactaataataagtagtctcggtcctcgtagttcgtcgtacgtttcggaccgtacggggaccaaggtcgtagggtacgtaacgtaccgtaaaacggtacgttacggtggtcgtacg

SEQ ID NO: 242046 - DNA, 552 bp, Homo sapiens
  misc_feature: GYAE6OF01DBA9D.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgttagcagcaacttagcctggtaccagcaagaagttggccaggcctccgaggctcctcattcgtttggtgtgtccacgtacgggccgtcgtggtcgtccccgagtcaggtttcaggtggctaggtcggctcgtgggacaggtacgttcactctccacatcagcacgcctgcacgtcgtgtaagttagtttgtacttagtttactttacgttgtactagtactaataataatagtcgtcggtcctcgtagttcgtcttacgtttcggaccgtacgggacctaggacgtaggaacgtagtacgtaaacgg

SEQ ID NO: 242047 - DNA, 659 bp, Homo sapiens
  misc_feature: GYAE6OF01CQZCF.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgttagcagactaacttagcctggtaccagacagaagttggccaggcctccaggctacctctattcgtttggtgtcgtacctacgtacgggcccgtcgttgggtcgtccccaggtcgtaggtttccaggttggcgaggttcggcttcggtagggacacgtgttaccactctcacatcagtcacgctgctagtctagtaacgttgtttagtaccgttaagttttacttacgttacgttacgaacggtaactaaagttaacttaaagttacggtaccgttacgggttcccttaccgggttaggtttaccgtaccgtttacggtttttaccgggaccggttaaccggggaaccttaaacgggtccggttaagggaacgttaacgtaacccggtaaaacggtaccgttacggtacgggtccgttaacccgg

SEQ ID NO: 242048 - DNA, 514 bp, Homo sapiens
  misc_feature: GYAE6OF01A2CO4.35.85.H08.1.454.CMB.1.raw
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggccaggctccagctcctcatctttggngtgtccactgggccncgtggtcgtcccagtcaggttcagtggcagtcggctcgtgggacagtcgtcactctcaccatcgagcagcctgctagtctagtagtatttgcgttagtttattactgtctagactaatatagtagtcgtcgcctacgtgttcgtcttacgtttcggaccgtagggacctacggcgtaggacgtagtacgtaaacg

SEQ ID NO: 242049 - DNA, 552 bp, Homo sapiens
  misc_feature: GYAE6OF01ADA7Z.35.85.H08.1.454.CMB.1.raw
  modified_base (283)..(283): a, c, t, g, unknown or other
  misc_feature (283)..(283): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgtagcagcaacttagcctggtaccagcagaagttgccaggctccagcctcctnatcgtttggtgtcgtccacgtacgggccgtcgttcgggtcgtccccgagtccgaggtttcaggtggcgaggtggctcgtgggacagtcgttcactctcaccatcagcagcctgctagtctagtaagttattttgcttagttttacttacgtgtacaagtactaattataagtagcgtcggtccctcgtagttcgcttacgtttcggaccgtacggggtacctaaggtcgtagggactaacgtacgaaacggtacgttggtcggctacgg

SEQ ID NO: 242050 - DNA, 538 bp, Homo sapiens
  misc_feature: GYAE6OF01B03O2.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtcgtcccacgtacgggcccgtctcgggtcgtccccaggtccaggttcaggtggcaggtggctcgtgggacaggagttcactctcaccatcagcacgcctgcagtctagaagtattttgctagtttattactgtcagactaatataagtagtcgtcggtcctaccgtagttcgtcttacgtttcggccgtacggggtaccaaggtccgtaggaagtacgtacaaacgaacgttggtggcgtcg

SEQ ID NO: 242051 - DNA, 683 bp, Homo sapiens
  misc_feature: GYAE6OF01ETRZ2.35.85.H08.1.454.CMB.1.raw
  modified_base (261)..(261): a, c, t, g, unknown or other
  misc_feature (261)..(261): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtcctccgaggggacagacgcccaccctctcctgcagggccagtcagagtgtagcagactaacttgcctaggtaccngacaagtaacgttggaccaggcctcccgaggtcctcctacgtactttcgtttaggcgttcgtaccctacggtacgggccctcgttgggtccgtacccgtaggtcgtagggttacaggtggccgtaggtcggtccttacgggtagggaactagggtacgtttccaaccgttctaccgacctagtaccgagccgacgtccctagaccgtagtacgtaaggtaagtttcgtttagaccgtttaagtttacttacgttagtacaaggtataattaagtacgttaggtcccgttacggtacccttaacggttgttaccggtacgtttaccgggttaccgggaccgggttaacggggaacctagggtccgtaacggggtaactaaccgttaaccgggaaaactacgggttcgggacgtcgttaacccg

SEQ ID NO: 242052 - DNA, 586 bp, Homo sapiens
  misc_feature: GYAE6OF01CTOA4.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcgagagtgttagcagctaattacgcctggtaccagcaggtaaagttcggccaggcctcccgaggtcctcctcattcgtttggtgtcgtccacgtacgggcctcgtgggtcgtcccgagtcgaggttcaggtcggcgaggtcggtcgttcgtgggactaggtacgtttccactccgtacacctactcgacgcgacgcgtcgcgcgtcgtagtagtatttgactagtttattacgtcgtactagtacgtaattattaagttagtcgttcgtccgtcgtagttcgtcgtacggtttcggaccggtacgggtaccgtaggtcgtagggtaggaacgtaacgaaacggagtcggtggccgtacgg

SEQ ID NO: 242053 - DNA, 920 bp, Homo sapiens
  misc_feature: GYAE6OF01DMDYV.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctactctggctcgaggaaccactggagaaacagtgatgacgcagtctccaaccactctgtctgtgtctccgaggggacagacgcccaccctctcctgcgagggccagtcagtagtgttaagcagacctaacgttacgccgttcggaacccaggaccgtaaagggtaaaacggtttcgggaccccaaggggtccccttacccccgaacggggtcccttacccttccgtaacgttttcgtttttcggggttgttccggttaccccgtaacgggttaccgggggtcccgtcggtttcgggttcccgtaccccgtaagggttccgtaacgggtttacgtaacgggtccggtacgaacgggtttccggggcctttacggggtacgggaaaccgtaaggttaccggttttacccgaacctttccgtaacccaaccgtaacgttaccgtacggaccgtaaccggtcccgttacggtaccgttacgggttaccgttaagggttaaacgttttaacgtttttacggtaaccgttttaaaggtttttaaccgttttaacgtttacggttaaaccgttaaggttaaccttaaagtttaaacgttaaacgttacggtaccggttaccggttacccggttaccggttaacggtttaccgttaccggttttaccggttttaccggggaacccgggttaaaccggggtaaccgtaaacgggtacgggttaacgggtaaacggtttaacccgtaaaacggttaaaaccggtaacggtttaccgggtaaccggttcgtaccgtaacccgttaacccgg

SEQ ID NO: 242054 - DNA, 523 bp, Homo sapiens
  misc_feature: GYAE6OF01AG66P.35.85.H08.1.454.CMB.1.raw
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccgaggaaccactggagaaacagtgatgacgcagtctccagccatcctgtctgtgtctccgaggggagagagccaccctctcctgcagggccagtcagactattagtaccaacttagcctggtaccagcagaagtgccaggctccagctctnatctttggntgtccacgtgggccnctggtcgtcccagtcaggttcagtggcagtggctcgtgggacagngttcactctcaccatcagcagcctgcagtctagtaagtattttgcgttagtttattacgtgtactagtactaataataatacgcgtcggtccgtcgtagttgtctacgtttcggccgacgggtaccaaggtcgtaggagactaccgaaacgacgtgtaggctgcgacgtacg

SEQ ID NO: 242055 - DNA, 739 bp, Homo sapiens
  misc_feature: GYAE6OF01BWOK2.35.85.H08.1.454.CMB.1.raw
  modified_base (190)..(190): a, c, t, g, unknown or other
  misc_feature (190)..(190): n is a, c, g, or t
  modified_base (201)..(201): a, c, t, g, unknown or other
  misc_feature (201)..(201): n is a, c, g, or t
tcagtacagatcgtcacgaccggtgctcgatttagtatcactcagtcgcggggagacgctctggggaggaactgctcagttaggaccagacggaaccatggaagccccagcgcagcttctcttcctctgctattctggctcccagatactcactggaagaaatagtgatcgacgcacgtcctaccaaccnctctgtctgtntctccgagggacagcgccacctctcctgacgacgggccagtcaggtagtgtagcagctaaacgttcgcctacggtaccagcgtaaggtaaaggttcggaccaacgggcctaccccgaggtcctacctctactttcgtttggtcgtcgtaccgtaacgtacgggccgtcgttcgggtccgttccccgaggttccgttaaggtttccgaaggttcggcgtaacggttcgggtaccgttcggttacggggaacctaggttaacggtttcccgtaacccgttccgttaccgaaacccgttcttacccgaacgtacccgaaccggtcccgttacggtaccgttacggtttaccgtaaggttaaacgtttgtttttacggtaccgtttaaggttttactttaccgtacgttacgtaacgttacttaaattaacgttactacggtacgttacggtccttacccggttaagttccgttacgtttaccgggtttcggaaccggtagggtaccgtacggtacgtacgggactaacgtacggtaaaacg

SEQ ID NO: 242056 - DNA, 644 bp, Homo sapiens
  misc_feature: GYAE6OF01CY4IG.35.85.H08.1.454.CMB.1.raw
  modified_base (225)..(225): a, c, t, g, unknown or other
  misc_feature (225)..(225): n is a, c, g, or t
  modified_base (255)..(255): a, c, t, g, unknown or other
  misc_feature (255)..(255): n is a, c, g, or t
  modified_base (545)..(545): a, c, t, g, unknown or other
  misc_feature (545)..(545): n is a, c, g, or t
  modified_base (607)..(607): a, c, t, g, unknown or other
  misc_feature (607)..(607): n is a, c, g, or t
  modified_base (611)..(611): a, c, t, g, unknown or other
  misc_feature (611)..(611): n is a, c, g, or t
  modified_base (620)..(620): a, c, t, g, unknown or other
  misc_feature (620)..(620): n is a, c, g, or t
tcagtacagatcgtcacgaccggtgctcgatttagtatcactcagtcgcggggaggaactgctcagttaggacccagacggaaccatggaacgccccagcgcagcttctcttcctcctgctattctggctcccagatatcactggagaaaatagtgatgacgcagtcctacccaaccactctgtctgtcgtccgtccgaaggggacagacgcccctaccctctcngcgacgggccagtcgagagttgtaagcaanactaattcgcgtaggtaccagacaagtaagtggaccacggcctccgaggtccctccgtctacttcggtttggtcgtcgtaccgtacggtacgggcccgtgttacggtccgtacccgaggtaccgtagggtttaccgaggttcggacgtacggtggtccgttacgggtagggaaccgtaaggttaccgtttacccgtaaccttcctaacccgaacctacgtacgaacggccgtacggacccttggacgtacgttcgtaagtaagttcgtttagactttagtttactacgtntacagtacaatactaagtacgtctacgtctacgtgttctacgttagttcgggacgacggtanacgngtacggaanacgtacgaaacgagtgaggctacg

SEQ ID NO: 242057 - DNA, 816 bp, Homo sapiens
  misc_feature: GYAE6OF01D3O40.35.85.H08.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctaccaaccactctgtctgtgtcctccgaggggacagacgcccaccctctccngcgaggccagtcagngtgtagcagactaacttgccgtaggtaccagcaagaagttcgaccacggcctcccgaggtcctcctctatttcgtttggtcgttcgtaccgtacggtacgggccgtcggttcggtccgtaccccgtaaggttccgtaaggttccgaaggttcggacgtaggttcggtcgttcggtacgggaacgtacggtacggtttaccaccgttccgtacctaaccgtagtacccgaacgtccgtaaccgtccgttacggaccgttaacggttaccgttaaggttaaacgttttacgtttttacgggaccctttttaaaggtttttaacctttaccggtttacggttaaccgtaaacggtaacctttaaaaagtttaacgttaaaccgtttacggttacccggtttaccgggttacccccgtttaacggttacgggtttacccgttaaccgggttttacccggttttaacccgggggaacccgggtaaccgggggttaaacccgtaacgggtccggttaacggggtaaaccgtaaaccgttaaacccggtaaaaacggttacccggttgggttaccgggtccgtaacccgg

SEQ ID NO: 242058 - DNA, 519 bp, Homo sapiens
  misc_feature: GYAE6OF01CS9UQ.35.85.H08.1.454.CMB.1.raw
  modified_base (298)..(298): a, c, t, g, unknown or other
  misc_feature (298)..(298): n is a, c, g, or t
  modified_base (414)..(414): a, c, t, g, unknown or other
  misc_feature (414)..(414): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctggtaccagcaagaaagtggccaggctccaggctcctcatctttggtntgtccagtagggccgcgtggtcgtcccagtcaggttcagtggcagtggctcgtgggacaggagttcactctcacatcagcagcctgcagtctgaagtatttgctagtttattactntacagtactaattataatagctggtcctcgagttcgactacgtttggaccgtaggggacctaaggcgtaggagaacgtaccgaaacggtacgtaggtggcgtacg

SEQ ID NO: 242059 - DNA, 518 bp, Homo sapiens
  misc_feature: GYAE6OF01BNOLY.35.85.H08.1.454.CMB.1.raw
  modified_base (393)..(393): a, c, t, g, unknown or other
  misc_feature (393)..(393): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttgccaggctcccaggctcctcattctttggtgtgtccacgtagggccgctggtgtcccagtcaggttcagtggcagtggctcgtggacagagttcacgtctcaccatcagcagcctgcagtctgaagtntttgctagtttattactgtcagacaatataatagtctggtcctccgtagttcgtctacgttttcggccgtaggggtaccaaggtcgtagggagtacgtacgaaacgtaacgtggtggcgtaccgg

SEQ ID NO: 242060 - DNA, 513 bp, Homo sapiens
  misc_feature: GYAE6OF01DX0J8.35.85.H08.1.454.CMB.1.raw
  modified_base (489)..(489): a, c, t, g, unknown or other
  misc_feature (489)..(489): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtcgtccacgtaggggcccgctgggtcgtccccagtcaggttcaggtggcagtggctcgtgggacagtacgttcactctcacatcagcagcctgcagtctagaagtattttcgctagtttattactgtcagtcaattataatagctgtcctcgtagttgctacgtttggccgtaggggaccaggtcgtagganacgtacaaacgagtcggtggctcg

SEQ ID NO: 242061 - DNA, 568 bp, Homo sapiens
  misc_feature: GYAE6OF01CMWPN.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagactattagtaccaattagcctggtatcagcagaaacctggtcaggctccaggcctcctcatctatggtgcatccaccgacgggccacgtggtactcccgagccgaggttcaggtggcaggtcgggtcgtgggaacaggtacgttcactctcacctatccagcacgcctgacagtctagtaagtagttttgaccttagttttacttacgttcgtactagtactaaattaacgtaattcgtcgtacggtaccctcggtagttcgtccttacggtttcggaccgtaacggggacctaaggccgtaggacgtacgtaacgaaacgtaagtcggtcggtcgtacg

SEQ ID NO: 242062 - DNA, 603 bp, Homo sapiens
  misc_feature: GYAE6OF01EVWVT.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctaggtaccagcagaaagttggccaggcctcccgaggcctcctcattcgtttggtgtcgtcccacgtacggggcccgtcgtgggtcgtccccgagtccgaggttcaggtggcaggtggctcgtggggacaggacgttcactctcacctatccagcacgtcctgcagtctagaagttattttgacttagttttacttacgttcgtactagtactaaattataatacgtcgttcgggtcccttacggtacgtttcggtaccttacggtttacgggacccggtaacgggggaaccctaagggtcttacggggaagtaacgttaaccgaaaacgtaacgttcgggtaggtccgtaacgg

SEQ ID NO: 242063 - DNA, 554 bp, Homo sapiens
  misc_feature: GYAE6OF01B70RM.35.85.H08.1.454.CMB.1.raw
  modified_base (314)..(314): a, c, t, g, unknown or other
  misc_feature (314)..(314): n is a, c, g, or t
  modified_base (358)..(358): a, c, t, g, unknown or other
  misc_feature (358)..(358): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgcccaccctctcctgcagggccagtcagagtgttagcagcaattagcctggtaccagcagaaagttggccaggctcccaggctcctcatctttggtgtgtccactagggccgntgggtgccccagtcaggttcagtggcagtggctcgtgggacagngttcactctcacatcagcagctgcagtctgaagtatttagctagtttacttacttgtacagactaattataagtagtacgtcggtacccttaccggtagttgtccgttacgttttcgggacccggtacggggtaacccaacggtcgtacgggtaagtacgtaaccgaaacgtaaggttcggtcgggtcgttaccgg

SEQ ID NO: 242064 - DNA, 501 bp, Homo sapiens
  misc_feature: GYAE6OF01ES1AH.35.85.H08.1.454.CMB.1.raw
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttgccaggctccaggctcctcattctttggtgtgtccacgtagggccgctggtntcccngtcagtcagtggcagtgctcgtggacagagttcatctcaccatcancagctgcagtctgaagtntttgctagtttatactgtcagcaatataatagtcgtgcctcgagttgtactcgttttcggccgtaggggtaccaaggtcgtaggagaacgtacaaacggtaactgtggcgtacg

SEQ ID NO: 242065 - DNA, 624 bp, Homo sapiens
  misc_feature: GYAE6OF01BJKWV.35.85.H08.1.454.CMB.1.raw
  modified_base (618)..(618): a, c, t, g, unknown or other
  misc_feature (618)..(618): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagtagtgtagcagctaacttagcctggtaccagctaagaaagttcggccaggcctcccgaggcctcctcattcgtttggtgttcgtacctacgtacgggcccgtcgttggtcgtccccgaggttcctaggttcaggtggctaggtcggcttcggtgggaactaggacgttcacttcgtacacccgtatccgagccacgtcctcgtcgacgttctaggaagtttagttttcgtacgttagttttattacgtcgtaccgagtaaccttaataacgttaacgtacgtccgtcggtaccttaccggtagttcgtccttaacggtttcggaaccggtaccggggtaccacggtcgtacggtaagtacgtaaccggaaacgtacggtaggtccggtntaccgg

SEQ ID NO: 242066 - DNA, 563 bp, Homo sapiens
  misc_feature: GYAE6OF01CGO2R.35.85.H08.1.454.CMB.1.raw
  modified_base (315)..(315): a, c, t, g, unknown or other
  misc_feature (315)..(315): n is a, c, g, or t
  modified_base (551)..(551): a, c, t, g, unknown or other
  misc_feature (551)..(551): n is a, c, g, or t
tcagtacagatcgtcacgaccggtgctcgatttagtatcactcagtcggcggggagagctctgggggaggaactgctcagttaggacccagacggaaccatggaagccccagcgcagcttctcttcctcctgctattctggctcccagatatcactggaagaaatagtgatgacgcagtctccaaccactctgtctgtgtctccgaggggacagacgccaccctctcctgcagggccaggtcagagtgtagcagcaacttagctggtaccagcagaaagtggccaggcctcccgaggcctcctcattctttggtntcgtccacgtagggccgcgtcggtcgtacccgaggtcgaaggttcgaggttggctaggttcgggctcggtgggaacaggtacgttcgtactcgtaccaccgaatcagcacgtcctgctaggtctagtaacgtattttgacttaaggtttactaacgtgtactagtactaaatataatagtcgtcggcctacgtagttcgacttacgtttcggacgtacgggaactaggcgtagganagtacgtaaacg

SEQ ID NO: 242067 - DNA, 539 bp, Homo sapiens
  misc_feature: GYAE6OF01B48OG.35.85.H08.1.454.CMB.1.raw
  modified_base (393)..(393): a, c, t, g, unknown or other
  misc_feature (393)..(393): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtcgtccacgtagggccgctggtcgtcccagtcaggttcagtggcagtgctgtggacagagttcactctcacatcagcagcctgcagtctagaagtnttttgacttagtttattactgtacagactaattataagtagtcgttggccctcgtagttcgtactacgtttcggacccggtaggggtaacccaggtccgtagggaacgtacgtaacgaaacggtaacgttggtacggtcgtaccgg

SEQ ID NO: 242068 - DNA, 668 bp, Homo sapiens
  misc_feature: GYAE6OF01C7KG2.35.85.H08.1.454.CMB.1.raw
  modified_base (229)..(229): a, c, t, g, unknown or other
  misc_feature (229)..(229): n is a, c, g, or t
  modified_base (247)..(247): a, c, t, g, unknown or other
  misc_feature (247)..(247): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggcctcccagatatcactggaagaaatagtgatgacgcagtctaccaaccactctgtcctgtgtcctccgaggggacagacgcccaccctcncctgcgaggccagtcagngttgtagcagcaacttagccgtaggtaccagacaagaagttcggcaggtcctaccgacggtcctcctctacgtttcgttggtctcgtccgtacgtacgggcctcgttcggtcgtacccgtaggtcctaggttccgaggttcggcgtaggtcgtcgtcggtagggaacctaggtacttccgacttccgtaccaacgtactcgaacgtcgtaaccgtccgtgactcggtacgtagtaacgtttctttacggtactttaagttttaactacgtacgtacgtaacgtacttaaagttaactaacgttacgtcccgttacggtaccccgttacggtaggtttaccgtccgtttaacggtttccgggaaccggtaacggggtaacctacgggttacgtaaggtaacgtaagtaacccggtaaaacgg

SEQ ID NO: 242069 - DNA, 818 bp, Homo sapiens
  misc_feature: GYAE6OF01DY51E.35.85.H08.1.454.CMB.1.raw
  modified_base (124)..(124): a, c, t, g, unknown or other
  misc_feature (124)..(124): n is a, c, g, or t
tcagtacagatcgtcacgaccggtgctcgatttagtatcactcagtcggtcgggggaggaactgctcagttaaggacccagacggaaccatggaagccccagcgaccagcttctcttcctcctncctatctggctcccagactagtcactggataaattaggtgatgacgcagtcctccaacccactctggtctgtgtctccgaggggacagacgccgaccctctccgtgcgaagggccacggtcgacgtagtggttagcgtacgcctaacgttacgaccgttcggtaccaaggacctaagtaaacgtttcggaccaagggtcctaccccgtaggtaccttaccctacgtacgtttcggttttgggtcgttccggtacccgtacggtacgggtcccgtacgttcgggttcgtacccgaggttcggaaggtttcgaaggttcggtacgtacggtcggtacgttacggtacgggaactaggtacgttccaacttccgtacaccctaagtccgacggccgtacgtacccgttcgtcgtaacgttccgtaggtaacgttacgttttaccgacgtttaacgttttacctaacgtttaggtaacctaacggtaaccttaaagttaacggttaaacggttacggtcccggttacggggtacccctttacgggttaagtttaccggttaccgttaaccgggttttacccggggacccggttaaaccgggggttaaccctaacgggttccggtaacggggtaacggttaaaccggttaaccggtaaaaaccggttacgtttcggggtaacgggttaccgtaaccggg

SEQ ID NO: 242070 - DNA, 520 bp, Homo sapiens
  misc_feature: GYAE6OF01BGRR7.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggccaggctcccaggctcctcattctttggtgtcgtccacgtagggcccgtcgttggtcgtccccagtccaggttcagtggcagtggctcgtggacagacttcactctcaccatcagcacgcctgcagtctagaagtatttgctagtttattactgtcagactaatataatagcgtcgcctcgtagttgtctacgtttcggaccgtacgggaccaacggtcgtaggagacgtacgaaacgtacgtgtgtcgtacg

SEQ ID NO: 242071 - DNA, 697 bp, Homo sapiens
  misc_feature: GYAE6OF01C9XZN.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcgacgggcagtcagagtgttagcagcaacttagcctggtaccagacaagtaagttcggccaggcctccgaggctcctcacgttctttggtgtcgtcctacgtacgggccgtacgtgggtcgtccccaggttctaggggtttccaaggttcgggactagggttcggcttcggtggggactaggtacggtttaccaacgttcctaccgaacctactaccgaacggtccaacggcccgttgaccgtaaggttaccgtaggtaacgttagtttttaggaccgtttaaggtttttactttacgttgttacaagtactaattaagttaaacgttagtcgttcgggtacccgttccggtacggtttcgtaccgttaccggttttacgggaacccgggttaaccggggtaaccctaagggtcccggttagggtaacgtaacgttaaacccggaaaacgggttacgtttacgggtacggtcgtaacccgg

SEQ ID NO: 242072 - DNA, 533 bp, Homo sapiens
  misc_feature: GYAE6OF01AS44R.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttagcctggtaccagcagaaagttggccaggctcccgaggcctcctcattcgtttggtgtcgtccacgtacgggccgtcgtgggtctccccgagtcctaggttcaggtggcaggtggctcgtgggactagtgttcacttctcaccatcacgcacgcctgcagtctagaagtatttcgactaacctattactcgacctaactagtagtggtagtacttccgtctacgttccggccgtcggacctaaggtcgtatactacgaaacgtacgtgtgcgtcgacactatcgtgttcc

SEQ ID NO: 242073 - DNA, 504 bp, Homo sapiens
  misc_feature: GYAE6OF01CCBE0.35.85.H08.1.454.CMB.1.raw
  modified_base (220)..(220): a, c, t, g, unknown or other
  misc_feature (220)..(220): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (317)..(317): a, c, t, g, unknown or other
  misc_feature (317)..(317): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctntcctgcagggccagtcagagtgttagcagcaacttagcctggtaccagcagaaagtggcagctcccagctcctnatcttggntgtccactagggccntggtgtcccagtcaggttcagtggcagtggctcgtgggacagagttcactctcaccatcagcagccctagccatctgaactattttgctagttttattactgtcagtcaataataatagctggcctccgagttgactacttttggacccaaggggaaccaagactagggacgtagtacgaaaaaccg

SEQ ID NO: 242074 - DNA, 576 bp, Homo sapiens
  misc_feature: GYAE6OF01BT6VF.35.85.H08.1.454.CMB.1.raw
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
  modified_base (316)..(316): a, c, t, g, unknown or other
  misc_feature (316)..(316): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaagttggccaggctccaggctctcatctttggntntccacgtagggccnctgggtntcccagtccaggttcagtgcagtggctcgtggacagtgttcactctcaccgatcacgcacgcctgcagtctagaagtattttgacgttagttttattacgttgttacagtactaaacttaattaagtacgttaccgttacgggtcccgttaccggtacggtttcgtaccgttacgttttaccgggaccggtacggggtaccctaacgggtccgtagggaacgtaacgtacgaaacggtacgttcggtacggtcgtaccgg

SEQ ID NO: 242075 - DNA, 824 bp, Homo sapiens
  misc_feature: GYAE6OF01A0G15.35.85.H08.1.454.CMB.1.raw
  modified_base (229)..(229): a, c, t, g, unknown or other
  misc_feature (229)..(229): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagngtgttagcagacaacgttagcctcggtaccagactaaggaaagttggccaggcctccccgaggcctcctactagttcgtttggtcgttcgtacctaccggtacgggccgtcgttcgggtccgtccctaggtaccgtagggttcgagggtcggcgtacggtcggtcgtacggtggggaactacggtacgtttcccgaaccttcccgtacctaaccctagttccgaacggtacccgtaacggtccccgttaggtaaccgtaaccggttacgttaacgggttaaactttacggttttttcgtaaacccgttttaggtttttaaaccttttacggtttacgttaaccgtaaggttaaccttaaaagtttaacgttaaacgttaacggttccgtttacccgggtacccgttacggttaacggtttaccgtaacccggtttttacccggggtttttaaccgggaaccccggggtaaggggggttaaaccccctaaacgggggttccggttaaacggggtaaaccgttaaaacccgttaaaacccgggttaaaacccggggtaaggtttaaccgggggtaccggttccggttaaaccccggg

SEQ ID NO: 242076 - DNA, 751 bp, Homo sapiens
  misc_feature: GYAE6OF01B91DX.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctaccaaccactctgtctgtgtctccgaggggacagacgcccaccctctcctgcgacggccagtcagagtgttagcagactaacgttacgccgtacggtaccaagacaaaggtaaacggttcggaccgaacgggccctacccgacggtccttccgtactattcgttttggtcgtcgtaccacggtacgggcccgtcgttgggtccgtccccgtaaggtcgtacgggttcgtaggtcgggacgtaggtcggccttcggtaggggaactagggtacgttctaaccgtccttaaccaccgtacgtaccgacgtaccgtaccggaccttcgactaggttacgtacggtaagtttagttttacgtacgtttaagttttaacgttacgtcggttacaagtacttaaagttaaattaacgtacggtcgttaccgggtacccttacggttacgttaccggtaccgtttaccgggttttaccgggaacccggtaaccgggggtaaacccgtaacgggtaccggttagggtaaaccggtaaaccgttaaaccggtaaaaaccggttacggttacggttacgggtcccgttaaacggg

SEQ ID NO: 242077 - DNA, 759 bp, Homo sapiens
  misc_feature: GYAE6OF01AK2P6.35.85.H08.1.454.CMB.1.raw
  modified_base (230)..(230): a, c, t, g, unknown or other
  misc_feature (230)..(230): n is a, c, g, or t
tcagtacagatcgtcacgaccggtgctcgatttagtatcactcagtcgcgggggaggtaactgctcagttaggacccagacggaaccatggaagccccagcgcagcttctcttcctcctgctattctggctcccagatatcactggagaaatagtgatgacgcagtctccaaccactctgtctgtgtctccaggggactagagccaccctctcctgcagggccagtcagngtgttagcgagcaacttagcctggtaccagcagaaagttggacctaggctcccgaggcctcctctagtctttggtgttcgtacccacgtacgggccgctgggtcgtcccctagtcgaggttccaggttgggctaggtggccttcgtacggggtacaggtacggtttcaaccgtttcgtacccaaccgtacgttccgacgccgtacggcccgttaggaccgtaggttccgtaggaaggttactttttacggaccgtttaagttttacgttaaccgttgttaccgtaagtaccgttaaagttaacttaaacgttacggtaccgtttacgggtaccccgtttaccgggtaacggttttccggacccgtttaaccggttttttaccgggggacccccgggttaaaccggggggtaacccccgttaaaacggggtcccggtttaacgggggtaaaaccgtacggtttaaaacccggtaaaaaccgggttaaacccggtttacggggttacccgggttcccggttaaacccgggg

SEQ ID NO: 242078 - DNA, 539 bp, Homo sapiens
  misc_feature: GYAE6OF01CT312.35.85.H08.1.454.CMB.1.raw
  modified_base (294)..(294): a, c, t, g, unknown or other
  misc_feature (294)..(294): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggngtgtccacgtagggccgctgggtcgtcccagtcaggttcaggtggcagtggctcgtgggacagtagtcactctcaccatcagcagcctgcagtctgagtagttttgctagtttattactgtcagtctaatataatagtctggtacctccgtagttcgcgttacgttttgggaccgtaacggggacctaaagggtcgtagggtaagtaacgttaccgaaaacggtaacgttacggtcggcgtacgg

SEQ ID NO: 242079 - DNA, 507 bp, Homo sapiens
  misc_feature: GYAE6OF01A1KV3.35.85.H08.1.454.CMB.1.raw
  modified_base (409)..(409): a, c, t, g, unknown or other
  misc_feature (409)..(409): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttagcctggtaccagcagaaagttggccaggctcccaggctcctcatctttggtgtgtccacgtagggccgctggtcgtcccagtcaggttcaggtggcagtggctcgtgggacaggtacgttcactctcaccatcagcagcctgcagtctgaagtnttttagctagtttattactgtcagcaattataatagctgcctcgtagttcgctacgtttcggccgtaggggacctaagtctaggagagtacgtaaacg

SEQ ID NO: 242080 - DNA, 519 bp, Homo sapiens
  misc_feature: GYAE6OF01E3Z00.35.85.H08.1.454.CMB.1.raw
  modified_base (514)..(514): a, c, t, g, unknown or other
  misc_feature (514)..(514): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgtagcagcaacttagcctggtaccagcaagaaagttggccaggcctcccgaggcctcctcattcgtttggtgtgtccacgtacgggccgcgtggtcgtcccagtcaggttcagtggcagtggctcgtggacagtagttcactctcaccatcagcagcctgcagtctagaatattttgctagtttattacgtgtcagtctaatataagtagcttcggccttacggagttcgcttacgtttcggaccgacgggtacagtcgagagactacgaaacgatgtcgngtacg

SEQ ID NO: 242081 - DNA, 554 bp, Homo sapiens
  misc_feature: GYAE6OF01D3TZ3.35.85.H08.1.454.CMB.1.raw
  modified_base (173)..(173): a, c, t, g, unknown or other
  misc_feature (173)..(173): n is a, c, g, or t
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
  modified_base (550)..(550): a, c, t, g, unknown or other
  misc_feature (550)..(550): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccnctctgtctgtgtctccgaggggacagacgcccaccctctcctgcgagggccagtcagagtgttagcagcaacttagcctaggtaccagcaaggtaaagttggccaggcctccaggtcctccgtcagttcgtttggngtcgtccacgtacgggccctntgggtcgtcccagtcgtaggttcaggtcggactaggtcggcttcggtgggactaggtacgttcacgttcctacactatcagcagtcctagctagtcgtagtaagttgtttcgcgttaagtttacttactgtacagtaactaatataacgtgtctcgtcctcgtgttcgtcgttacgttcggacgtagggacagtcgtaggatactacgaaacgtgtgtgntacg

SEQ ID NO: 242082 - DNA, 701 bp, Homo sapiens
  misc_feature: GYAE6OF01C5D82.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtcctccaaccactctgtctgtgtctccgaggggacagacgcccaccctctcctgcgacgggccagtcagagtgtagcagcaacgttagccgtaggtaccagacaaggtaaagttcggaccgaggcctcccgaggcctccgtctattcgtttggtgtcgtccgagtacgggccgtcgtggtctccgagtcgtaaggttcaggttcggacgtaggtcggcgttcggtacggggacctaggtacgttccgaacttcctaccgacctacgtaccgacggctaacggccctggactacgttacgtaggttaaagtttacgtttttggaacctttaaggtttttaactttacgtacgttactaacgttaactaaagttaacgtttaagtaacggtcgttaccggtacccgttcggtacgtttcgtacccgtttacgggttttaccgggaacccggtaacggggtaaacccaggttaccggtaagggtaaacgtaacgtaaaccgggtaaaaccgttaggttacgggtcgggtcccttaaccggg

SEQ ID NO: 242083 - DNA, 560 bp, Homo sapiens
  misc_feature: GYAE6OF01DVQKG.35.85.H08.1.454.CMB.1.raw
  modified_base (409)..(409): a, c, t, g, unknown or other
  misc_feature (409)..(409): n is a, c, g, or t
  modified_base (430)..(430): a, c, t, g, unknown or other
  misc_feature (430)..(430): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttagcctggtaccagcagaaagttggaccaggctcccgaggcctcctcattcgtttgggtgtcgtccacgtagggccgtctgggtcgtccccagtcaggttcaggtggcaggtcggctcgtgggacagtagttcactctacaccatcagcagcctgcagtctgaagtntttgactagtttatactgtanacgtactaatataatcgtcgttggacccttccggtagttcgcttacggttttcgggacccggtaacggggtaccaaggtccgtagggtaagtaacgtaaccgaaaaccggtacttgggtacggtctacgg

SEQ ID NO: 242084 - DNA, 617 bp, Homo sapiens
  misc_feature: GYAE6OF01CLGFA.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctggtaccagcagaaagttggccagctccaggctcctcatcgtttggtgtcgtccgatacgggccgtcgtcggtcgtccccgagttcgtaggttcaggtggcaggtggcttcggtgggacaggtacgttccacttcctacacccactcgagcgacgcctgcgagttctagaagttagttttgtacttagttttactttaacgttgttaccaaggtactaaattaacgtaaagttacgtccgttacggtcccgttaccggtacgtttcgttaccgttaccgtttttcgggacccggtaacggggtaacccgtaacggtcggtagggaacgtaacgtacctaaaacggtagttcggtaggtccgtaccgg

SEQ ID NO: 242085 - DNA, 578 bp, Homo sapiens
  misc_feature: GYAE6OF01EG6UB.35.85.H08.1.454.CMB.1.raw
  modified_base (303)..(303): a, c, t, g, unknown or other
  misc_feature (303)..(303): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaaggtaaagttggccaggcctcccaggtctcctcattcgtttggngtcgtccaccgagggccactggtactcccgagccgtaggttcagtggctaggtgggtctgggacaggtacgttcaacgtctacaccatcagcacgcctgcagtctgtatcgtattttcgattagtttattacgtgtacagtactaattactagtaattaaccgtcggtacccgttccggtaggtaccggttccgggtaccggaaacgggtaaccggtaaacggttagggaacgtaccgaacggtaacgtcggtacggactacgccgacctgtccg

SEQ ID NO: 242086 - DNA, 702 bp, Homo sapiens
  misc_feature: GYAE6OF01CX4NP.35.85.H08.1.454.CMB.1.raw
  modified_base (159)..(159): a, c, t, g, unknown or other
  misc_feature (159)..(159): n is a, c, g, or t
  modified_base (262)..(262): a, c, t, g, unknown or other
  misc_feature (262)..(262): n is a, c, g, or t
  modified_base (384)..(384): a, c, t, g, unknown or other
  misc_feature (384)..(384): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggaanaaatagtgatgacgcagtcctaccaaccactctgtctgtgtcctccgagggacagacgcccaccctctccgtagccgagggcccagtacaggtagttggttancgaagacctaaacgttacgccgttacggaaccagacgtaaaggtaaagttcggacgacggtcctacccgaggtccttcctactagtttcgtttggtcgttacgtaccgaacggtcgggtccncgttggtccgtcccgtagttcgtacggttcgaggttcggacgtaggtcggtacttcggtacgggtactacgggtacgttacctaccgttcctaccgtaaccgtacctaccggagaccgtacgtcccgtgtaccgtacggttactaggtaacgtttacgttttcgaccgtttaagtttttactacgttagttaccgagtacttaaagttaacgtagtacgtcggttcgtccgttacggtcgtttaccgacggttttaccgttacgggaccggtaacgggacctaacggtcggttaggaacgtaacgtaacggtaaaccg

SEQ ID NO: 242087 - DNA, 576 bp, Homo sapiens
  misc_feature: GYAE6OF01ENMS4.35.85.H08.1.454.CMB.1.raw
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
tcagtacagatcgtcacgaccggtgctcgatttagtatcactcagtcgcgggggaggaactgctcagttaggacccagacggaaccatggaagccccagcgcagcttctcttccccctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctnatctttggtntggtccactagggccntggtcgtcccagtcaggtcagtggcagtcggctcgtgggacagtagttcaactctcaccatctagcagcctgctacgtctagtaagttattttgtcttaagttttactttacttgtacgtacgtactaaattaataagttacgtacgttcggtcctaccggtacgttcgtacgttacgttttcggaccggtaacggggaaccgtaaggcgtacgggacgtaacgttaacgtaaacggtaacgttaggtggtccgtggtaacccg

SEQ ID NO: 242088 - DNA, 557 bp, Homo sapiens
  misc_feature: GYAE6OF01AZM5K.35.85.H08.1.454.CMB.1.raw
  modified_base (318)..(318): a, c, t, g, unknown or other
  misc_feature (318)..(318): n is a, c, g, or t
  modified_base (322)..(322): a, c, t, g, unknown or other
  misc_feature (322)..(322): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtntccngtcaggttcagtgcagtggctctgggacagagttcactctcaccatcagcagcctgcagtctagaagtattttgcttagtttacttacgtgtactagtactaagttataagtagtaccttggtaccccttcggtaagtttcgtcgttaccgttttcgggacccgtagggggtacccaaaggtccgttagggacgtaacgtaccgaaaaccggtaacgttcggtaggtcgtaccgg

SEQ ID NO: 242089 - DNA, 737 bp, Homo sapiens
  misc_feature: GYAE6OF01DZ2NQ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgttagcagcaacttgcctggtaccagcagtaagttgccaggcctccaggcctcctcattcgtttggtgtcgtaccacgttacgggcccgtacgtgggttccgtccccgtaggtaccgtaaggggtttccaaggggttcgggaccgtaaggggttccgggaccgttacgggtacggggaacctaagggtacggttttcccaaccggtttccctaccaaccgtacgtaccgacgccgacgttcccgtacgtaccgtaacgttccgtacggtaacgtttagttttcgaccgtttaagtttttaactacgtttcgtacctaggtaaacctaaatttaacgttaaagttaccggtacgtttaccgggtacccgttaccggtttaacgttcgtaacccgtttacgggtttacccgggacccgggtaaccggggtaacctaacggtccggtaagggaacgttaaacgtaacccggtaaaacggtacgttacgggtacggtccgttaaccgg

SEQ ID NO: 242090 - DNA, 533 bp, Homo sapiens
  misc_feature: GYAE6OF01E2WOD.35.85.H08.1.454.CMB.1.raw
  modified_base (311)..(311): a, c, t, g, unknown or other
  misc_feature (311)..(311): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagtggccaggctcccaggctcctcatctttggtgtgtccacgtagggccnctgggtgtcccagtcaggttcaggtggctaggtggcctcgtgggacagtagttccactctacacctatcagcagtcctgcagtctagaagtattttgacttagtttattactgtcagtactaattataagtagtcgttacggcccttcggagttcgcttaccgtttcggaccgtacggggaccaaggcgtaggagtactacgaaacgaactggtggctacgg

SEQ ID NO: 242091 - DNA, 732 bp, Homo sapiens
  misc_feature: GYAE6OF01C0AYI.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatgtgatgacgcagtctaccaaccactctgtctgtcgtctccgaaggggacagacgcccacctctcctgcgagggaccagtcaggagtgtagcagaccaattagccgtaggtaccagacaaggtaaagttggaccaggcctacccgaggtcctaccgtctagttcgtttcgggtgttacgtaccctaagtcggggcctcggttacgggtctaccccgtaggtcgtaacggtttccgaaggtcggtacgaggttcgggaccttcgggtacgggaacctagggttacgtttaccctaaccgtttacgaccctaacccgtaacgttaccgaacggtaccgtaccgtcccgtagtaccgtaaggttaccgttaaggtaacgtttacgttttacgtaccgttaagttttacgttaacgttagtaccgtaagtaactaaacgttaattaaacgtacgtcgttaccggtacccgttacgtaggttcgtaaccgttaccgttttaccgggaccggtaacggggtaaccctaaggtacgtaacgggtaagtaacgtaaccggtaaacgtagttacgggtcggtcgtaacccgg

SEQ ID NO: 242092 - DNA, 670 bp, Homo sapiens
  misc_feature: GYAE6OF01C0PVS.35.85.H08.1.454.CMB.1.raw
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
  modified_base (327)..(327): a, c, t, g, unknown or other
  misc_feature (327)..(327): n is a, c, g, or t
  modified_base (482)..(482): a, c, t, g, unknown or other
  misc_feature (482)..(482): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggaagaaatagtgatgacgcagtcctaccaacctacttctttctgttcgtctccgagggaccagacgcccacctcgtcctgccgacggccagtcagagtgtacgcagcaacttacgccgtagtacngactaaggtaagtcgccagctccaggcctcatnttcgttggcgtcgccgtagtcggcgnttcggctccagtcgtaggttcgaggttcgacgtaggtcgtcgttcggaacgggtactaacgggtagtttcccactttccgacgaaccctacgtaccgaagcccgtaaggtcccgttacgacgttaacgttacgtaaaggtagtttcttttacgtntttaacggttttataccgtgtaccgtaagtaacttagttaaacgtagtacgtacgttccggtaacccgtttcggaaggttttccgaccggttttaccggttgggaaccccgtaagggaacccgtagttacgggactacggtaaacttaaaccggtaaaggttaccggttggtcggccgtacgtaaccc

SEQ ID NO: 242093 - DNA, 659 bp, Homo sapiens
  misc_feature: GYAE6OF01CHOYB.35.85.H08.1.454.CMB.1.raw
  modified_base (454)..(454): a, c, t, g, unknown or other
  misc_feature (454)..(454): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgttagcagctaacttagccgtaggtaaccagaccgaaggtaaaacggtttcgggacccgtaagggccctaccccgagggtcctccctctagttccgtttgggtcgtccgtccgtaacgtacggggcccgtcgtacgggtccgtccccgtagtcggtacggttcaggtggtacgaggtcggtcgttcggtgggaactaggtacgttctaccttctctaaccntacgacgaccacgtccgtcgaccgtagttaccgtagtaacgttacgttttagactttaggttttacttacgttcgttactagtaactaattaacgtaattcggtaccgttcgggtacccttacggttacgttcgtaccgttcggtttacgggaccggtacgggaactaggcgtagagactaacggaaactacgtggtgtcgtacg

SEQ ID NO: 242094 - DNA, 702 bp, Homo sapiens
  misc_feature: GYAE6OF01CC273.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctaccaaccactctgtctgtcgtctccgaggggacagacgcccaccctctcctgcgaggccagtcagagtgtagcagcaacgttcgccgtaggtaccagacaaggtaacgttcggaccgacgggcctaccgaggtccctcctcgttacttcgtttggtacgttcgtaccgtacggtacgggcccgtcggttcggtccgtcccgaggttccgtacgggtttaccgagggttcggacgtcgggtcggtcgtcggtagggacctaggtacgttccaacgtctaccgactagtcacgcgacgtcctgacgtagtacgtaaggtaacgtttagttttacgtacgtttaggttttaacttacgttagttaacccgtaagtaactaaattaattaaacgtacggtccgttacgtaacccggttacgtacgtttcggtaccggtttaaccggttttacgggacccggtaagggtaacccgaagggttccgtagggtaaacccgtagtaaaccggaaacgttaccggtggccggttacgtaacccgg

SEQ ID NO: 242095 - DNA, 747 bp, Homo sapiens
  misc_feature: GYAE6OF01DRRCS.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggaagaaatagtgatgacgcagtcctaccaaccactctgtctgtgtcctccgaggggacagacgccctaccctctcctgcgacgggccagtcagtagtgtagcagacaacttcgcgtgtaccagtacgaaggtaagttcggaccacggcctacccgacggtcctcctactactttcgtttggtcgtcgtaccgtacggtaccgggccgtcggttcgggttacccgtcccgtacggttccgtacgggttaccggaggtcgggtcgtggttcggtcgtcggtagggactaggtacgttccaccgtcctacaccgtatcgacgccgacgtccgtcgacgtaagtcctaaggtaacgttattttacgaacctttagttttaacgttacgtacggttactaacgtaacttaaacttacgttaaacgttccggtaccgtttaccgggtaccccgttacggttacggtttaccggttacctttaacccgggttttcggaaacccggggtaccggggttaaaccgtacgggtacccgttaaggggtaaccgttaacccgtaaaaccgggtaaaccggttaacggttaggggttcccgacgggttaacccgg

SEQ ID NO: 242096 - DNA, 736 bp, Homo sapiens
  misc_feature: GYAE6OF01EN6UQ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcgagggccagtcagagtgttagcagctaacttgcctggtaccagcaagtaaagttcggaccaggcctccccgaggtcctccctacgactttcgttttgggtgttcgtacccgtacggtacggggccctcggttgggtcgtccccgagtccgtaggttcaggtgggctagggttcggccgttcggtcggggaactagggtacgtttccgaaccttccgtaccacctataccgacggaccgtacgtccctggaccgtacgttcgtaaggtaagtttacgttttacgtacgtttaagttttaacgtttacgttcggtacgtaacgtaccgttaaattaagttaaacgttacgggtaccgttaccgggttaccccgttaccggttaaggtttaccggtaccgttttaccgggttttaccgggacccgggtaacggggtaacccgtaacgggtccggttacgggtaaacgtaacgttaaacccggtaaaccggtaaacggttcgggttacggtccgtaacccgg

SEQ ID NO: 242097 - DNA, 693 bp, Homo sapiens
  misc_feature: GYAE6OF01CTARE.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtcgtctccgaggggacagacgcccaccctctcctgcgacgggccagtcagagtgttacgcagcaacttacgccttaggtaaccagacgaaggtaaacggttcggcccagggtcctccccggaggccttcctctattcgtttggtcgtcgtcccgtagtacgggcctggttcggtcgtccccaggtaccgtaggttccaagggtggcctaggtcggcgttacggtggggaactagggtaacgtttcgaaccttccgtaccctacgactaccgacgccgtacgccgttcggacgtacggttacgtaaggtaacgttagtttttacgtacgtttaacgtttttaactttacgttcggtaactacgtaactaaacttagttaacgtagtaccgttcggtaccgtcggtacgtttacgtccgttaccgtttcgggaccggtacgggtaccgtaacggtcgttaagggaacgttaacgtaaccgtaaaaccgttgtaacgggttcgtcgtaacccg

SEQ ID NO: 242098 - DNA, 747 bp, Homo sapiens
  misc_feature: GYAE6OF01BSRYH.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgcccacctctcctgcagggccagtcagagtgttagcagctaacttacgcctggtaaccagacaagaaagttggccaggcctcccgaggcctcctcacgttcgtttggtcgtcgtccacgtacggggcccgtcgtcgggtcgtaccccgtaggtccgtagggtttcaagggttcggcaggttgggtcctcggtagggggaactagggtacgtttaccaaccgtttcctacctaacccgtaacgttaccgaaacggtccgaacggtcccgttacggaccgttacgttaccgttaaggtaacggtttaacgtttttacggaccgtttaagtttttaacgtttaccgttagttacaggtaactaaagttaaagttaaagttaacggttcgttacgggtacccgttaccggtacggtttacgtcccgtttaccggttttaccggggacccggtaaacgggggtaacccgtaacgggtccggttacggggtaaacggtaaccgttaaacggaaaacccggtaacggtttacggtacgggtcccggttaaccgg

SEQ ID NO: 242099 - DNA, 729 bp, Homo sapiens
  misc_feature: GYAE6OF01BXF2X.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctaggtaccagcagaaagttggccaggcctcccgaggcctccgtctattcgtttgggtgtcggtcccacggtacgggccgcgttcgggtcgtccccgagtccgtagggtttcaggttcgggcgtaggttgggccgttcgtaggggactaggtacgttttaccaccgttccgtaccaaccgtactccgacgccgacgtcccgtcgacgtacggttacgttaggtaaacgtttactttttaggaccgtttaaggtttttactttacgtttacgttaccgtaagtaacttaaatttaagttaaacgttacgtaccggttccgggtacccgttaccggttacggtttcggtaccgtttaccggttttaccggggacccggtaacggggggtaaccccgtaacgggttaccggttaacgggtaacggtaaaccgttaaaccggaaaaccggttaaccggttacgggttacggtccgttaacccgg

SEQ ID NO: 242100 - DNA, 551 bp, Homo sapiens
  misc_feature: GYAE6OF01BT38E.35.85.H08.1.454.CMB.1.raw
  modified_base (173)..(173): a, c, t, g, unknown or other
  misc_feature (173)..(173): n is a, c, g, or t
  modified_base (434)..(434): a, c, t, g, unknown or other
  misc_feature (434)..(434): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgnagtctccaaccactctgtctgtgtctccagggggacagagccaccctctcctgccagggccagtcagagtgttagcagcaacttagcctaggtaccagcaagaagttggccaggcctccgaggctccgtcatcgttttgggtgtcgtccacgtacggggcctcgtggtcgtcccaggttcagggtttcaggtcggcaggtcggctcgtggggactaggtcgttcactccgtcaccatcagcagcctgacagtcgtgaagtnttttgcttagtttattactgtactagtataattagtaatagcgttggcctcgtagttcgtcgttacgtttcgggaccgtaagggtaccgaacgcgtaggaacgtgtacgtaaaccgg

SEQ ID NO: 242101 - DNA, 720 bp, Homo sapiens
  misc_feature: GYAE6OF01CDZCI.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtcctccgaggggacagacgcccaccctctcctgcacgggccagtcaggagtgttagcagtactaacttagcctaggtaccagacaaggtaaagtcggccaggtcctcccgaggtcctcctctattcgtttggtcgtcgtacctacgtacgggccgtcgtcggtacgtcccgagtcgtaggttcaggtcggcgtagtcggctcggtagggaacgaggtacgttccacttcccgtacaaccgtactaccgaacggccgtaacggtcccgttaggtaccgtacggttaccgttaaggtaacgtttacgtttttacggacgttttaaggttttaactttacggtttagtaccgttaaagtacctttaaaacgttaattaaaccgttaacgggtcccgttacggttaccccgttaccggttaaggtttcggtacccgtttaaccggttttccgggaaacccggtacggggtaaacctacgggtccgtacgggtaacgtacgtaaacccggtaaacgtaaggttcggtcggacgttacccgg

SEQ ID NO: 242102 - DNA, 609 bp, Homo sapiens
  misc_feature: GYAE6OF01CDQCL.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttgcagcaacttagcctggtaccagcagaaagttggccaggctcccaggctctcattctttggtgtgtcccagtacgggcctcgtggtcgtaccccagttccgaggttccaaggttcgggctacggtgggtccttcggtacggggactaggtacgttcaacgttccttaccaacctatacacgcctagcctgctagtcgtagaagtattttcggacttacggttttacttacgttcgttactaacggtactaaagttataaagttacgtaccgttacggtacctccggtaagttcgtcgttaccgttttacgggacgtaaccggggtaccaaggtcgtacgggtaagtaacgtaccgaaacgtatcggaggtcgtacg

SEQ ID NO: 242103 - DNA, 560 bp, Homo sapiens
  misc_feature: GYAE6OF01D47NR.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctcccgaggcctcctcattcgtttggtgtcgtccacgtacgggcccgtcgtgggtcgtccccagtcaggttcaggtggcaggtggctcgtgggacagtagttcactctcaccatcagcacgcctgcagtctagtaagtattttgacttagtttattactgtacagtactaattataagtagtcgtcggtcctacgtagttcgtacgttaccgttttcggaccggtacgggtaccgtaaggtcgtagggaagtaacgtaacgaaacgtaagtggtcggtcgtaccgg

SEQ ID NO: 242104 - DNA, 553 bp, Homo sapiens
  misc_feature: GYAE6OF01CCPGL.35.85.H08.1.454.CMB.1.raw
  modified_base (425)..(425): a, c, t, g, unknown or other
  misc_feature (425)..(425): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttgcctggtaccagcagaaagttggccaggctcccaggctcctcattctttggtcgtgtccacgtacggggcccgtcgtgggtcgtcccccaggttccgagggtttcaggttcgggcaggttggccttcgtggggacaggtagttccacttctcaccatcagcacgcctgcagtctagaagtntttgacttagtttattactgtcagtactaatataagtagtcgtacggtcctcgtagttcgtctacgtttcggaccggtacggggaccaaggtcgtaggagacgtacgaaacgtagtcggtgtcgtacg

SEQ ID NO: 242105 - DNA, 577 bp, Homo sapiens
  misc_feature: GYAE6OF01CLBC2.35.85.H08.1.454.CMB.1.raw
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
tcagtacagatcgtcacgaccggtgctcgatttagtatcactcagtcgcgggggagagctctggggaggaactgctcagttaggacccagacggaaccatggaagccccagcgcagcttctcttcctcctgctattctggctcccagatatcactggaagaaatagtgatgacgcagtctccaaccactctgtctgtgtctccgaggggacagacgcccaccctctcctgcagggccagtcagagtgttagcagcaacttagcctggtaccagcagaagtggcaggctccaggctcctctatctttgggtcgtcgtccacgtacgggccgcttgggtcgtcccgaggtctagggttcaggttggctaggtcggctcgtgggacaggtacgttcactcncaccntcagcacgccctgcagtcgtagtaagttagttttcgacttagtttaacttacttggtactagactaattaagttaagtacgtcgtacggtcccttaccggtagttcgtccgttacgtttcgggaccggtaacggggaccgtaacggacggtaggaacgtagtaacgtaaaccgg

SEQ ID NO: 242106 - DNA, 739 bp, Homo sapiens
  misc_feature: GYAE6OF01AW2J6.35.85.H08.1.454.CMB.1.raw
  modified_base (551)..(551): a, c, t, g, unknown or other
  misc_feature (551)..(551): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccacccgtctccgtgccgagggccagtcgaggtagttggttagcgagacctaaacgttacgcccttacggtaacccagaccgtaagtaaacggttcggacccaagggtccctaccccggacgggtccctccccgttacgtacgtttcggttttcgggttcggttccgtacccgtacggttacggggttccgtaccgttcgggttaccgtaccccgtaggttccgtaacggtttcgaggtcgggactaggttcggacttcggtggggaactacggtacggtttccacttaccgtaccacctaacgtccgacgccgtaacgtcccgtgaccgtagtacgtagtaacgttntttcggtacgttagtttactacgttcgtacgtaacgtacttaagtactaagtacgtcggttacgtaccgttacggtacggttccgttacgttaccggtttccgggaccggtaacggggacccttaagggtccgttaacgggtacgtaaccgttaacgtaaacgtacggtacggtcggtaccgtaccgg

SEQ ID NO: 242107 - DNA, 834 bp, Homo sapiens
  misc_feature: GYAE6OF01CODG2.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttagcctaggtaccagcaaggtaaacgttcggccaggcctccccgaggtcctcctctattcgtttgggtcgtcgtcccgaacgttacggggcccgtcgttcgggtcgtaccccgaggttccgtaacggggttttccaaggggttcgggccgtaagggtttcgggcccgtttacgggtaggggggaaccctaagggttaacggttttaccgaaacccgttttccggttacccaaaccccgtaacgttacccgaaccggtaccgtaacggtaccccgtttacggacccgttaacggttacccgttaagggttaaacggttaacgttttttacggaaccgttttaacggtttttaacgtttaaccgtttacggttaaccgtaacggttaaccttaaaagtttaaacgttaaacgtttaacggtaccggtttaccgggttaccccgttaccgggttacggtttaccggtaccgtttaaccggtttttacggggaacccggtaacgggggtaaccctaaacgggtccggttacgggtaacgtaaacgttaaccggtaaaaccggttacgttacgggttacgggtccgtaacccgg

SEQ ID NO: 242108 - DNA, 543 bp, Homo sapiens
  misc_feature: GYAE6OF01DWV0J.35.85.H08.1.454.CMB.1.raw
  modified_base (312)..(312): a, c, t, g, unknown or other
  misc_feature (312)..(312): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttagcctggtaccagcaagaaagttggccaggctccaggctcctcatctttggtgtgtccacgtagggccnctggtctcccagtcaggttcagtggcagtgctcgtgggacagagttcactcgtcacatcagcagcctgcacgtctgtaagtatttgctagtttacttacgtgtacagtactaataataatagtctcggtcctcgtagttcgtactacgtttcggccgtaacgggtaaccgaaagggtacggaaaacgttaccgaaaaccggtaacgttacggtaggacgtcgccgtaaccg

SEQ ID NO: 242109 - DNA, 583 bp, Homo sapiens
  misc_feature: GYAE6OF01BDRLJ.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcaggccagtcagagtgttagcagcaacttagcctggtaccagcagaaagttggccaggctcccaggctcctcattcgtttggtgtgtccacgtacgggccgtctgggtcgtccccaggtccaggttcaggtcggcgtaggtggctcgtggggactaggtagttcacgttcctcacccgtatcagcacgcctgcgagtctgtatcgttagttttgactagttttattacgttgtactagtactatttatacgtaattaacgtcggtccctccggtgggtaccgttccgggaaccgaacggggaccgtaagggtcgggtaaacggtacccgaaacggtaacgtgggttacggacttacggccgtaccgtacg

SEQ ID NO: 242110 - DNA, 636 bp, Homo sapiens
  misc_feature: GYAE6OF01DJKIU.35.85.H08.1.454.CMB.1.raw
  modified_base (462)..(462): a, c, t, g, unknown or other
  misc_feature (462)..(462): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcgagggccagtcaggtagtgttagcagcaacgttacgccttaggtaccagacgtaaggtaaacggttcggccagggcctcccccgagggtccttccctactagtttcgtttggtgtcgtcccacggtcgggtcctcgtgggtcgtcccagtccgaggttcgagtcggctaggtgtctcggtaggacaggtacgttcacgttcctaccactatccgacgactacggcctgactagtctaggtagttnttttcgacttagttttactacgttgtactaagtactaattaactaagtcgtaccgttcggcccttacgtagttcgtaccgttacgtttacgggacccggtaaacggggaccctaggttcccggagggtaacgaaaccttaacggaaaaccggtagttcgggtacgtctaaccgg

SEQ ID NO: 242111 - DNA, 691 bp, Homo sapiens
  misc_feature: GYAE6OF01EVSIE.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtcctccaaccactctgtctgtgtctccgaggggacaggacgcccaccctctcctgcgacggccagtcaggtagtgttagcagacaacgttgcctggtaccagacaaggtaaaggttcggaccgacggcctaccccgaggtcctcctcgtatttccggtttggtgttccggtccgtacggttacgggccccgtgttcgggtccgtaccccgaggttccgtaagggtttcgagggttcggtcgtagggtcggtcgttcggtaggggaactaggtaccggttttccaaccgttcctaccaaccctagtcccgaacgtccgaacgtcccgttacgaccgtaacggttacgtaagtaaggtttattttcgacgtttaacgttttattaaccgttggtaactagtaactaactaagttaagtacggtccgttacggtacccttcgggtagttcgtaccgtttacggttaccgggaccggtagggaaccgtaggtcggtaagagtaacgtaacgaacgtacgtggtcgcgtacg

SEQ ID NO: 242112 - DNA, 546 bp, Homo sapiens
  misc_feature: GYAE6OF01CODST.35.85.H08.1.454.CMB.1.raw
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (533)..(533): a, c, t, g, unknown or other
  misc_feature (533)..(533): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggcagagccaccctctcctgcagggccagtcagagtgttagcagcaacttagcctggtaccagcaagaaagttggccaggcctccaggctcctcatctttggtgtcgtccacgtacgggccgtcgtgggtcgtccccgaggttccaggtttcaggttggcgtagtggctcgtgggacaggtagttcacttctaccaccatcagcacgcctgcacgtcngtaagtnttttgacttagtttacttctgtacagtactaatataatagcttacgccttcggtagttcgacttaccgtttcggaccgtaggggtaaccaggtcgtaggataactaccgaaagntacggtgctacgg

SEQ ID NO: 242113 - DNA, 656 bp, Homo sapiens
  misc_feature: GYAE6OF01A1DDU.35.85.H08.1.454.CMB.1.raw
  modified_base (287)..(287): a, c, t, g, unknown or other
  misc_feature (287)..(287): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgccagggccagtcagagtgttagcagcaacttagcctggtaccagcagaaagttggccaggctcccaggctccnctatctttggtgtcgtccacgtagggccgtctggtcgtccccgtagtcgaggtttcgaggttcggcgtaggttcggcgttcgtaggggacctagggtacgtttcaactcgttaccaaccgtacttccgacgtccgacggtcccttaggacctacggttccgttaggtaagttacgtttttgacgtttaacgttttactttacgttagttacctagacctaaataagttaaacgtacgtacgttacggtccttaccggtacgttcgtaccgttacgttttacggacccggtaacggggtaaccctaggtaccgtacgggtaagacgttaaacggaaaccgtaaaccgttcggttacggtcgttaaccggg

SEQ ID NO: 242114 - DNA, 830 bp, Homo sapiens
  misc_feature: GYAE6OF01APFD3.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtctccaaccactctgtctgtgtctccgaggggacagacgcccaccctctcctgcgaggccagtcagagtgtagcagctaacttagccctggtaccagacgaaggtaaacggttcggcccaagggtccctaccccgaggtcccttccctacgactttccggtttggtcgtacgtaccccgtaacggtacggggtccccgtcggttcgggttaccgtacccccgtaagggttcccgtaaagggggttttccctaagggggtttccgggacgtacggggtttcgggacccgtttcgggttaagggggaacccttagggtaaccggtttacccgaccttacccggttaccaacccgtacttaccgaaccgggtacctaccggtccccgtaggaccgttaacgggtttacccgtaaggttaaaggtttacgttttcggtaccgtttaacggtttttaacgtttaacggttcgtaaccgtaagttaccgttaaaacgttagtaaaccgttacgggttaccgttacgggttacccccgttaacgggttacgtttacggtaccgttttaaccggttaccggggtacccggtaaacgggggtaccctaaggggtcccgttaagggaccgttaaacgtaaccggtaaacggttacgttaggtccgtcgtacccgg

SEQ ID NO: 242115 - DNA, 790 bp, Homo sapiens
  misc_feature: GYAE6OF01BANM5.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcgaggccagtcagagtgtagcagacaacttacgcctggtaccagcaagtaaaggttcggaccaggcctacccgaggtcctcctcgtacgttcgtttgggtcgttacgtaccgaacggttacggggcccgtcgtttcggggtccgttaccccgtacgggttccgtaggggttaccgtagggttacggggacctagggttcggccgtttcggtacgggggaacctagggttaccggttcctaacctttccgtaacccgaaccctaacgttaccgaacggtccgtaaccggtcccgtggaaccgtacgggttaccgttaacggttaagtttacgtttttacggacgttttaacgttttacgtttacgttacggttacgtaagttaacctaaatttaacgttaaacgtaccgttacggttacggtaccccgttacggttaacggttccggtaccgtttaaccggttttacgggacccgggttaaacggggacccttaaagggtaccgttaacggggtaaccgaaacgttaaacccggaaaacggttaaccggtcgggttaacgggtccgttaacccgg

SEQ ID NO: 242116 - DNA, 571 bp, Homo sapiens
  misc_feature: GYAE6OF01B8BL9.35.85.H08.1.454.CMB.1.raw
  modified_base (437)..(437): a, c, t, g, unknown or other
  misc_feature (437)..(437): n is a, c, g, or t
tcagtacagatcgtcacgaccggtgctcgatttagtatcactcagtcgcggggagagctctgggggaggaactgctcagttaggacccagacggaaccatggaagcccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaaagttggccaggcctcccgaggctcccgtcattcttttggtgtcgtccctacgtacgggcccgtcgtgggtcgtccccgagttcgaggttcagttggctaggtggctcgtgggacaggtagttcactcctccgaccatccagcagcctgctagtctagaatnttttgcttagtttatactgtactagactaattaatatacgtctggccctaccggtagtttcggtacttaccggttttcgggacccgtaaggggaaccctaaggtaccgtagggacgtaacgtacgtaaaaccgg

SEQ ID NO: 242117 - DNA, 583 bp, Homo sapiens
  misc_feature: GYAE6OF01DAX8Y.35.85.H08.1.454.CMB.1.raw
  modified_base (366)..(366): a, c, t, g, unknown or other
  misc_feature (366)..(366): n is a, c, g, or t
  modified_base (442)..(442): a, c, t, g, unknown or other
  misc_feature (442)..(442): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcacgggccagtcagagtgttagcagcaacttagcctggtaccagcagaaagttgccaggctcccaggctcctcatctttggtgtgtcccacgtagggccgtcgtgggtcgtccctagtcagggtttcaggtcggcagtggctcgtgggacnggtagttcactctaccactactcagcagcctgactagtctagtaagtatttgtcgtagtttactttactgtcgtanactaattaataataggactcggtaccttcggtagttcgtacgtacgttttcggggacccgtaacggggtaacccgtaacggtccggtagggaaacggtacgttaaccgtaaaacggtacgttacgggtgggtacgtaccgg

SEQ ID NO: 242118 - DNA, 734 bp, Homo sapiens
  misc_feature: GYAE6OF01D4DVU.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtcgtctccgaggggacagacgccacccgtctcctgcagggccagtcagtagtgtagcagacaacttagctaggaccagacgaagtaaaggttcggacctagggcctacccgaggtcctccgtacacgtttcgtttggtcgttcgtacccgtacgttacgggccgtcttcgggtccgttcccacggtacgtacggttaccgaaggttggaccgttaggtcggtccgttcggtacggggaactaggtacgttacctaacgtccgttcaacccgtataccgacgtaccgaacggtccgtagtaccgtacggttaccgtaaggtaacttacggtttttacgaccgtttaaggtttttaactttaacgtacggtttacaacggtaacttaaattaaagttaaacgtacgtaccgttacggtacccgttaccggttaagtttacggtacgtttaccgtttaccgggtaacccggtacggggaaaccctaacggtacgggtacgtaaacggtaacgtaaacccgttaaaggtaccggttacggtaccggtagtaacccg

SEQ ID NO: 242119 - DNA, 554 bp, Homo sapiens
  misc_feature: GYAE6OF01DKOVH.35.85.H08.1.454.CMB.1.raw
  modified_base (545)..(545): a, c, t, g, unknown or other
  misc_feature (545)..(545): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcaagaaagttggccaggctccgaggctcctcatctatggtgcatccaccgagggcccacgtcggtactcccgaagtcccgtaggtttccaaggtggactaggtcggggtctaggggactagtcttacactctcaaccatcagcacgcctgcagtctagaagtattagtgacgtagtttactctacgttgtacaagtactagtttaactggtccgtcggcccgccgtctccgttcggttccgggacggtagggaccgtaagggtcggagaagtacgaaaagtcgtggnggtcgtacg

SEQ ID NO: 242120 - DNA, 649 bp, Homo sapiens
  misc_feature: GYAE6OF01ALNS4.35.85.H08.1.454.CMB.1.raw
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
tcagtacagatcgtcacgaccggtgctcgatttagtatcactcagtcgcggggagagctctggggaggaactgctcagttaggacccagacggaaccatggaagcccccagcgcagcttctcttcctcctgctattctggcctcccagatatcactggagaaatagtgatgacgcagtctccaaccactctgtctgtgtctccgaggggacagagcccaccctctcctgcgagggccagtcagagtgtagcagctaacttgcctggtaccagcaagaagtcggcaggcctccgagcctcnctatcttttggngtgtcctacgtacgggccctgtcggtcgtcccagtcgtaggttcaggttggctagggtggtccttggtcgggactaggtacgtttcacttcctccaccgatccgacgtcaacgtccctagactacgttccgtagtaacgtagttttacgacgtttaagttttaacgtttacttacggttacctagtaacttaaagttaactaagttacggtaccgtccgggtacccgttaccggttaacgtttccggtaccgtttaccggttttcgggaacccgggtaaccggggtaaccctaaacgggtcgtaagggtaacgttaacggtacccggtaaaaaccgg

SEQ ID NO: 242121 - DNA, 711 bp, Homo sapiens
  misc_feature: GYAE6OF01B95FY.35.85.H08.1.454.CMB.1.raw
  modified_base (323)..(323): a, c, t, g, unknown or other
  misc_feature (323)..(323): n is a, c, g, or t
tcagtacagatcgtcacgaccggtgctcgatttagtatcactcagtcgcggggaggaactgctcaggttaggtacccagacggtaaccattggaagccccagcgcagcttctcttcctcctgcctattctggctcccagatatcacttggagaaatagtgtaatgacgcagtctaccaaccactctgtctgtcgtctccggaggggacagacgcccaccctcgtcctgccagggccctagtcagagtgttagcagcctaacttacgcctggtaccagacagaaagttggaccaggcctccccaggcctcctcagtcgtttggngtcgtcctacgtacgggccgcgttgggtcgtccccgagtctacggttcgagtggccagttcggctcgtagggacaggtacgtccgtaccgtctccgtaaccactccacggaccaccggtcccttagaccgtactaccgtagtaagttacgttttacgaccgtttaaggttttaacttaacgttcgtacctagtaaccctaaattaacgtaaacgttacggtaccgttaccgggttacccttacccggttagggtttccgtaccggtttaaccggtttttacccgggaaccgggttaacggggtaacccgtaaccggtacggttacgggaaacgtaacgttaacccggtaaaacgtaaccggtttacggtacgggtccgttaacccggg

SEQ ID NO: 242122 - DNA, 736 bp, Homo sapiens
  misc_feature: GYAE6OF01DA3SP.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgcccaccctctcctgcgacgggccagtcagagttgttagcagactaacgttacgcctagggtaccaggacaaaggtaaagttcggaccgacggtcctccccgaggtccttcccgtactagttccgttttggtcgtcgtacccgtacggtacgggcccgtcgttcggtcgtccccgtagtcgtacggttcgaggtcggcgacggttcggtcctcggtcggggaaccagggttacgtttaccacgttcctaccaaccctataccgacgccacggtccctagtccgtaacgttcgtaggtaagtttacgtttttcgaccgttaagtttttacgtttacgttgttaaccgtaagtaacttaaatttaacttaaagttaccggtccgtttaccgggtaacccgtttaccggtacggtttaccggtacctttaccgggtttaccgggaacccgggtaacgggggtaacccgtaagggtcccggttaagggacgttaaacgttaacccggaaaacggtaccgttagggcggtccgtaacccgg

SEQ ID NO: 242123 - DNA, 629 bp, Homo sapiens
  misc_feature: GYAE6OF01CK0P7.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccacctctcctgcagggccagtcagagtgttacgcagcaacgttagcctaggtaccagacaaggtaaagttcggccgaggcctcccaggtcctcctctattcgtttggtgtcgtcctacgtacgggcctcgtggtctcccaggtctaggttcaggtcggctaggtggctcggtagggactaggtacgttcacgttcctacacctatcgagcacgcctgacgtagtctaggtaagttacgtttcgacgtttagttttaatttacgtgtaccgaagtaactaaagttaagttaaacgtacgtaccgttacggtcccgttacggtacgtttcgttaccgttaccggttttcgggaccggtaacggggtaacctaacggtcggtaaggagtaacgtaaccgaaacggtacgttacggtcggtccgtaccg

SEQ ID NO: 242124 - DNA, 567 bp, Homo sapiens
  misc_feature: GYAE6OF01E3KEH.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggcctcccgaggcctcctcattcgtttggtgtcgtcccacgtacgggccgcgtggtcgtcccagtcaggttcagtggcagtggctcgtgggacaggtagttcactcctcaccatcagcacgcctgcagtctagaagtatttgctagttttattacttgtacagactaaataataatacgtcgtcggtcccttaccgtagttcgtcttacgttttcgggacccgtaacggggaacccaacggtcgttagggaacgtaacgtaaccgaaaaccggtaacgttcgggtcggtcgtaccgg

SEQ ID NO: 242125 - DNA, 737 bp, Homo sapiens
  misc_feature: GYAE6OF01AWJFW.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtcctccgaggggacagacgcccaccctctcctgcgacgggccagtcagagtgttagcagacaacttgcctggtaccagcaagaagtcggccaggcctcccgaggtccctcctctacgtttcgtttgggtcgtcgtaccctacggtacggggcccgtcgttgggtcctcccgtagtcgtaggttcaggtcggctaggtcggtcgtcggtgggaactggtacttccacttccgtaccacctagtccgacgccgacgtcccgttgacgtacgtacgttaggtaacgtttacgttttacggtactttaagttttacgtttaccgttacggttaccgtaaggtaaccttaaagtttaacgttaacgttaaccggtccgttacccgggttcccttaccgggttacggtttaccgtaccggttttaaccgggtttacccggggaacccggggttaacggggtaacccgtaaacgggtaccggttaagggtaaaccgttaaaccgttaaacccggtaaacgggttaaccggttacgggttaccggtaaccggttacccgg

SEQ ID NO: 242126 - DNA, 737 bp, Homo sapiens
  misc_feature: GYAE6OF01CPTX7.35.85.H08.1.454.CMB.1.raw
  modified_base (191)..(191): a, c, t, g, unknown or other
  misc_feature (191)..(191): n is a, c, g, or t
tcagtacagatcgtcacgaccggtgctcgatttagtatcactcagtcgcggggactgcttcagggcagttggtagatgcccctctgggagagatccccaggggtgacagccatggaccctggaagggcctgggctagggacagggaccagagccagccagggagaggacagagccaagtggacgtggggtntactgtaacagccctgctggcgagagggaccagggcaccgtcctccgagggacgcccatgctgcgaaggtcggccgaggacggtcgccccgtacgaaccgtacggaacggacccaaagtcggaacgaaccccgaaacggaaccgaacggaccccgtaaagggttacggggtttacggttacggaaccggtaccccccgttagggaacggggaacggtccggtttcgggggcccccggttaccgggtccccgacggggacgacgggcccggtccgttccgggcccccgtggtcccgttcgccgttcggtcgttccggggttcgtcgggccgtacgtccgggtcccgtacccgtcggtccgtcccgtcggtccgtccggcccgaccgtagtcggttacgccgaccgacgaaccggccgggacccgacggaacccgtggaccgccgtacgacggtggaacgcgacgacacgtccgacgtccgcggcggacgtcgggtacggtggggaccgtcgggtacgaccggcccgaaccgggtacccctaacccgg

SEQ ID NO: 242127 - DNA, 734 bp, Homo sapiens
  misc_feature: GYAE6OF01DMX5V.35.85.H08.1.454.CMB.1.raw
  modified_base (319)..(319): a, c, t, g, unknown or other
  misc_feature (319)..(319): n is a, c, g, or t
  modified_base (339)..(339): a, c, t, g, unknown or other
  misc_feature (339)..(339): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtcctaccaaccactctgtctgtgtctccgaggggacagacgcccaccctctcctgcacgggccagtcagagtgttagcagcaacttgcctggtaccagcaggaaagttggccaggcctccgaggcctccgtcattcgtttggtnttcgtaccacgtacgggccncgtgggtctccccgtagtcgtacggttcgaggttcggcgtagggtcgtctcggtaggggacctaaggtcgttcctaaccgttctacccaacctacgttccgagacctaaccgggtcccttaggaccgtaaccggttacgtaggtaaacgtttcgtttttacggacttttaacggttttaactttacgttacggttaccctaggttaaccttagttttaagtacggttaacttaaccggttccgggtacccgtttaccgggtaccggggttaaccgggttaccccgggtaaccggtaaaccgggggtaaaccccgtttaaggggggttaaaccggtaaacccggggttaaaaccgaaaaccccggggttaacgtttcggggtaccgggttaacccc

SEQ ID NO: 242128 - DNA, 777 bp, Homo sapiens
  misc_feature: GYAE6OF01BQGS2.35.85.H08.1.454.CMB.1.raw
  modified_base (173)..(173): a, c, t, g, unknown or other
  misc_feature (173)..(173): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccnctctgtctgtgtctccgaggggacagacgcccaccctctcctgccagggccagtcagtacgtgttagcagtcaacttagccgtggtaccagacaaggtaaacgttggaccaagggcctacccgagggtccctaccgttacgtacttccggttttcgggtcgttccggttacccgtaacggttaaccgggggtccccgtccggttcggggttaccggtaccccccgtaaggttacccgtacggggtttaccgaaaggggttcggggtaccgtaacgggttcggtaacgttccgggttacggggaaccgtaaggtacgttttaccgaaccgttaccggtacctaaccctagttaccgaacgtccgacgtccgtagaccgtaagtcgtagtaagtttacgtttacgacgttagttttacgttacttgtaacgtacgtaacctaaatttaacgtaacgttacgtaccgttccggtacccgtacggttacggttacgtaccggtttaccgttttacgggaccggtaacccggggtaactaacggtcgtaagggtaacgttaaaccggtaaaccgtaaacggtaacgtcgggttaccggacgttacccgg

SEQ ID NO: 242129 - DNA, 647 bp, Homo sapiens
  misc_feature: GYAE6OF01A8SO6.35.85.H08.1.454.CMB.1.raw
  modified_base (231)..(231): a, c, t, g, unknown or other
  misc_feature (231)..(231): n is a, c, g, or t
  modified_base (324)..(324): a, c, t, g, unknown or other
  misc_feature (324)..(324): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccacccgtctcctagcgagggccagtcagngtgtagcagacaacttagcctaggtaccagcaagaaagttgccaggcctaccgaggctccgtctattcgttggtgtcgtactacgtagggccngtcggtcgtaccccgtagtcgtacggtttcgaaggtcggacgtaaggtcggtacgttacgtaggggaacctaggtacggttccacgttaccgtccgaacctactacgacgtaccgacgcccgtgccgtagtacgtagtaacgttagtttacgacttacgtttaacgttacgtcgtacgtagtacctaaattataagtaacgtcgttacgacccgttccgtagttcgtaccttacggttttaccggaccggtaacgggaaccgtaacgtcggtaacggtacgtaacgtaaccgtaaacgtaagtacggttcgggtcgtaaccgg

SEQ ID NO: 242130 - DNA, 649 bp, Homo sapiens
  misc_feature: GYAE6OF01BUHAG.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtcctccaaccactctgtctgtgtctccgaggggacagacgccaccctctcctgcgacgggccagtcagagtgtagcagacaacgttcgccgtacgtaccagacgaaggtaaagttcggaccacgggcctccccgaggtcccttacctctatttcgtttggtgtcgtaccgtacgtacgggccgtcgtcggtctcccgaggttcgtacggttcgacggtggtacgaggttcggctacggtggaactagtcgtacctactactccgaactactcgtacgcgtaccgtccgtgacgtacgttacgtaggtaacgttcgttttagtacgtttaacgttttaatttacgtaggttactaagtataaattaataagttacgtccgtacggttccgtaccgttagttcgttaccgttacgtttacggaccgggtacgggaccgtacggtcgtaggtacgacgttaaccggaagtaccgtggtcggctacccgg

SEQ ID NO: 242131 - DNA, 515 bp, Homo sapiens
  misc_feature: GYAE6OF01D0AHA.35.85.H08.1.454.CMB.1.raw
  modified_base (209)..(209): a, c, t, g, unknown or other
  misc_feature (209)..(209): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctntccctgcagggccagtcagagtgttagcagcaacttagcctggtaccagcagaaagttgccaggctcccaggctcctcatctttggtgtgtccacgtagggccgctggtgtcccagtcaggttcagtgcagtggctcgtgggacagagttcactctcaccatcagcagcctgcagtctgaagtattttgctagtttattactgtcgagctaatataatagactggccttaccgagttgctacgttttgggcccgtaggggtacccaaggctagggagtaacgtcaaaacgaactggtaggctacgg

SEQ ID NO: 242132 - DNA, 816 bp, Homo sapiens
  misc_feature: GYAE6OF01CZNE8.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggaagaaatagtgatgacgcagtctccaaccactctgtctgtgtctccgaggggacagacgcccaccctctccgtgcgacgggccagtcaggagtgttagcagctaacttacgcctaggtaccagacaaggtaaagttcggaccacggcctcccgaggtcctccgtctactttcgtttggtcgttcggtaccgtaacggtacggggcccgtcgttacgggtccgtccccgaggttccgtaacggggttttccgaaggggttcgggaccggtagggttcggggacccgtttcggtacgggggtaacctaagggttaacggttttcccgaacccgttttacccgtaccgtaaacccctacgttaccgaacgggtaccaacggtacccgttcggaccgtaacggtttacccggtaaggtaaacggtttagtttttacggtaccgttttaagtttttaacgtttaaccgttagttaacgtaacggttaacttaaacttaaagttaaacgttacggttaccgttaccgggttacccgttaccggttacggtttacggttaccgttaccggttttaccgggaacccgggtaacgggggtaaaccctaacgggtacgttacggggaaacgtaaccgtaaaccggtaaaacggtaacggttacgggtaccggtcgtacccgg

SEQ ID NO: 242133 - DNA, 601 bp, Homo sapiens
  misc_feature: GYAE6OF01CT6VT.35.85.H08.1.454.CMB.1.raw
  modified_base (431)..(431): a, c, t, g, unknown or other
  misc_feature (431)..(431): n is a, c, g, or t
  modified_base (466)..(466): a, c, t, g, unknown or other
  misc_feature (466)..(466): n is a, c, g, or t
tcagtacagatcgtcacgaccggtgctcgatttagtatcactcagtcgcgggggagagctctgggggaggaactgctcagttaggacccagacggaaccatggaagccccagcgcagcttctcttcctcctgctattctggctcccagatatcactggagaaatagtgatgacgcagtctccaaaccactctgtctgtcgtctccgaggggacagacgcccaccctctcctgcagggccagtcagactattacgtaccaacttacgcctggtatcagacaagaaacctggacacggcctaccgaggtcctccgtcactctatggtgcactcccgacgacgggccacgtcggtacctccgagaccgtaggttacgaggtcggcgtagggtcgggtctcgggaacaggtacgttaccaccttcgtaccaactnaccacgccacgcctagctacgtctaggaattattnagtctaagtttacacgtacgtctacaacgttagtacgtttaatcggtcgtcccgggccgtcgtccgttccgttacggttccggggacgggtacggtaacggtacgggtaggagtaacgtaaagaaacggttacgg

SEQ ID NO: 242134 - DNA, 611 bp, Homo sapiens
  misc_feature: GYAE6OF01C8ZCN.35.85.H08.1.454.CMB.1.raw
  modified_base (378)..(378): a, c, t, g, unknown or other
  misc_feature (378)..(378): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagcgccaccctctcctgcagggccagtcagagtgttagcagctaacttgcctaggtaccagcaagaagttcggccaggcctccgaggtcctcctcattcgtttggtcgtgtcccaggtacgggccgcgttgggtcgtcccgagttcgtaggttcgaaggtcgggacaggttcggcttcggnggacagtacgttcactcgtacaccatcagcacgccgtgcgtagtctagtaagtagtttgtacttagtttattacgtgtactagtactaattaacttaagtacgtcgtacggtcccttacggtacgttcgtacgttaccgttttacgggacccggtaacggggtaaccaagggttccgtaagggtacgtaacgttaaccggaaaaccgtacggtacggttacggtcgtaaccgg

SEQ ID NO: 242135 - DNA, 654 bp, Homo sapiens
  misc_feature: GYAE6OF01BEROL.35.85.H08.1.454.CMB.1.raw
  modified_base (230)..(230): a, c, t, g, unknown or other
  misc_feature (230)..(230): n is a, c, g, or t
  modified_base (417)..(417): a, c, t, g, unknown or other
  misc_feature (417)..(417): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagngtgttagcagcaacttagcctggtaccagacaagaaagttcggccaggcctaccgaggcctcctcattcgtttggtgtcgtccacgtacgggccgtcgtcggtcgtcccctaggtcgtacggttcaggttcggctacggtcggtctcggtgggactaggtacgttccactctacgacctagtcagcngtcctgacgagtactagaacgttatttgcttaagtttacttacgtgtactaggtaacctaaagttaacgtaaagttacggtaccgttacggtaccccgttacggtaacgttacggttaccgttacggttttaccggggaccggtaaccgggggtaacccaacgggttccgtacgggtaaacgtaaccgttaaccggaaaaccggttacggttcggtacgggtacccgttaacccggg

SEQ ID NO: 242136 - DNA, 636 bp, Homo sapiens
  misc_feature: GYAE6OF01D4KIR.35.85.H08.1.454.CMB.1.raw
  modified_base (492)..(492): a, c, t, g, unknown or other
  misc_feature (492)..(492): n is a, c, g, or t
  modified_base (518)..(518): a, c, t, g, unknown or other
  misc_feature (518)..(518): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctaccaaccactctgtctgtgtctccgaggggacagacgcccaccctctcctgcgagggccagtcagacgtgtagcagcaacgttgccgtaggtaccagacgaaggtaaaggttcggaccgaggcctacccgaggtcctcctctacgttcgtttggtgttccgtaccgtacgtacggggccctcgttcgggtccgttaccccaggttccgtacgggttccgagggttcgggccgtagggtcggcgttcggtaggggactaggtacgttccaacgttctacgaacctagtccaggtccacgtccgttgacctagttcgtaggtaagttntttcgactttagtttactcgtcgtanagtataatactagtacgtcgttacgtcctacgtagttcgtacgttccgttacgggaccggtaacgggtacaggttcggtaggataacgtaacgaaacgtacgttcggtacgtgtaccg

SEQ ID NO: 242137 - DNA, 601 bp, Homo sapiens
  misc_feature: GYAE6OF01CD0VM.35.85.H08.1.454.CMB.1.raw
tcagtacagatcgtcacgaccggtgctcgatttagtatcactcaggtcgcgggggaggaactgctcagttaggacccagacggaaccatggaagccccagcgcagcttctcttcctcctgctattctggctcccagatatcactggagaaatagtgatgacgcagtctccaaccactctgtctgtgtcctccgaggggacagacgccaccctctcctgcagggccagtccagagtgttagcagctaacttagcctggtaccagacaagtaaagttcggccaggcctccccaaggtcctcctcattcgtttggtcgtgtacccacgtacgggccgtctgggtcgtcccagttccgaggtttcacggtggcaggtggctcgtgggactaggacgttccacttcctcaccatcgacgcgacgcctgctagtcgtagaagtagttttcgacttagtttacttacgtgttacgagtactaaatataagtacgtcgtacgtaccgtacgtacgttcgtacttaccggtttacggaccggtaacggggtacctaacggtcgtagggtacgtaacgtaccgaaaccggtaatcggtaggcgttaaccgg

SEQ ID NO: 242138 - DNA, 525 bp, Homo sapiens
  misc_feature: GYAE6OF01D9VGM.35.85.H08.1.454.CMB.1.raw
  modified_base (228)..(228): a, c, t, g, unknown or other
  misc_feature (228)..(228): n is a, c, g, or t
  modified_base (349)..(349): a, c, t, g, unknown or other
  misc_feature (349)..(349): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagngtgtagcagcaacttagcctggtaccagcagaaagttgccaggctccaggctcctcattctttggtgtgtccacgtagggccgctggtcgtcccagtcaggttcaggtggcagtggctcgnggacagagttcactcgtcaccatcagcacgcctgcagtctagaagtagttttgcttagtttattactcgtacagtctaattataatacgcttcggccctcgtagttgccttacgtttcggaccgtaggggaaccaggtcgagggaagacgtacgaaacgtaacgtggtgcgtacgg

SEQ ID NO: 242139 - DNA, 664 bp, Homo sapiens
  misc_feature: GYAE6OF01BUEE0.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtcctaccaaccactctgtctgtgtctccgaggggacagacgcccaccctctcctgcgacggccagtcagagtgttacgcagactaacgttacgccgtaggtaaccagacgtaaggtaaaggttccggaccgacggtcctacccggaggtcccttccgtctacgttcgtttgggtcgttcgtacccgtaggtaccgggccgtcgttcggttccgtcccgtaggtcgtacgggttcgaggtcggacgtaggtcggcgtacggtgggactagtacgttcctactcctacacctacgtcgacgcctacgccctagactacgttcgtagtacgttagtttcgtactttagtttacttacgtcgtactaagtactaattagtaacgttacgtccgttacgtcccgttacggttacgtcgttaccggttaacggtttccgggaccggtaacgggtaaccaggtcgtaagtacgtaacgtaaccgaacggtacgtggtcgtcgtaacg

SEQ ID NO: 242140 - DNA, 557 bp, Homo sapiens
  misc_feature: GYAE6OF01BH5XW.35.85.H08.1.454.CMB.1.raw
  modified_base (417)..(417): a, c, t, g, unknown or other
  misc_feature (417)..(417): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcattcgtttggtgtcgtcccacgtacgggcccgtcgtcgggtcgtccccaggtcctaggttcaggtggctaggtggctcgtgggacagtacgttcactctacaccatcagcagcctgcagtctagatttnttgcttagtttatagtgtacagtctaatataatcgtcgtcggcctcgtagttcgcttacgtttcggacccgtacggggtaacctaagggtccgtagggacgtaaccgtacgaaaccggtaacgtcgggtcggtcgtaccg

SEQ ID NO: 242141 - DNA, 598 bp, Homo sapiens
  misc_feature: GYAE6OF01EP3HT.35.85.H08.1.454.CMB.1.raw
  modified_base (327)..(327): a, c, t, g, unknown or other
  misc_feature (327)..(327): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgttagcagcaacttgcctggtaccagcaagtaaagttggaccaggcctccgaggtcctcctctacgttcgtttggtgtcgtccacgtagggcctntggtctccagtcaggttcagtggctaggtcgctgtgggactaggtacgttcacttcgaccacctagtccacgcacgtcctgacgtacgtcgtaggtaagttagttttgtactttattttacttacttcgtacagtactaaattaacgtaagtacgtcgtcggtaccctacggtacgttcgtacgttaccgtttcgggacccggtaacggggtaaccgaaggtcgtagggaacgtaacgtaaccgaaacggtacgtcggtcggacgtaccgg

SEQ ID NO: 242142 - DNA, 813 bp, Homo sapiens
  misc_feature: GYAE6OF01ARI2D.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccatcgtgtctgtgtctccgaggggacagacgccaccctctccgtgcgacgggccagtcgagagtgttagcagactaacgttcgaccgtacggtaaccagtaccgaaggtaaacggttcggacccgagggtaccttaccccggaagggtccctttaccgtacctaacgtttccggttttcgggtcggttccggttaacccgaccggttaccggggtcccgtcggttcggggttccgttaccccgtaaggttccggtaacggggttttaccgaaggggttcgggtacccggtaacgggttcggtacccgttcggttaacgggggtaacctaacgggtacggttttacccgacgtttacccttaacccgaaccgtaccgttaccggaacgtccggtaccggtaccgtacggtacgttaccgttacgttaacggtaacgttacgtttttacgaccgttttaaggttttaactttaacggttacgttaaccgaacgttacgttaaattacgttaaacgtacgtaccgttaccgtacccgtaccgttaacgttacgttacggtttaccgggaccgtacggggtaacctaggacggtacggaacgtaacgtaacccgtaacggtacgttaggaccgttcgcggtaacccg

SEQ ID NO: 242143 - DNA, 583 bp, Homo sapiens
  misc_feature: GYAE6OF01EQP36.35.85.H08.1.454.CMB.1.raw
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttagcctggtaccagcagaagttgcaggctccagctctcattctttggntgtccacgtagggccncgtggtcgtcccgagtccgaggttcagtggctaggtcggctcgtggacagtagttcactctcacatcacgcacgcctgctagtcgtagaagtagtttagtcctagttttaacttacgttacgtactagtactaataacttaaagtagtaccgttacggtcccttaccggttacgttcgtaccgttaccgttttcgggaccggtacggggtaaccgtaacggtcgtagggtaacgtaacgttaacgaaaccggtaacgtacggttcgggtcgtaccgg

SEQ ID NO: 242144 - DNA, 742 bp, Homo sapiens
  misc_feature: GYAE6OF01EIJIS.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtcctccgaggggcagacgcccaccctctcctgcgacgggccagtccagagtgttagcagcaacttgcctgtaccagcagaaagttcggaccaggcctccgaggtcctcctactacgttccgtttggcgttcgtcccgaccgtacggggcctcgtgggttcgtacccctaggtccgtaacggttcgaggtcgggctagggtcggtcgtaccggttgggactaggtacggttcctacgttctacccaccgtacttaccgacggtccacggtcccttaggaccgtaacgttcgtaacggtaacgtttacgtttttacggacgttttacggttttaacgtttaccgttacggttaccgtaacggtaactaaacgtttaaacttaaacggtttacgtacccgtttacgggtaccccgtttaccggtacggttttacccggtaccgtttacccggtttttacggggaccccggttaacggggggtaaaccctaaggttccgggtaacgggtagtaaaccgttaaccgaaaacccggtaacggttcggtacggaccgttacccgg

SEQ ID NO: 242145 - DNA, 802 bp, Homo sapiens
  misc_feature: GYAE6OF01ED3SB.35.85.H08.1.454.CMB.1.raw
  modified_base (248)..(248): a, c, t, g, unknown or other
  misc_feature (248)..(248): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggcctccagtatatcacgtggaagtaaatagtgatcggaacgctacgtcctaccaacctactcttgtcgttgtcgtcctacggaggggacacgccgaccctaccttctcgngacgacgggacctagtcgaaggtgttagttacgacgaacgtaccgttaaacttccggaccgttacggtaaccgaggtaaccggtaaaaggtaaacggttccggaccggtacgtcccgtaccggacggttccctaccgtacttacgtttcggttttggtcgttcgtaccgacgggttccgggccgtcggttcggtaccgtcccgtagtcggtaggttacgcggttcggacgttacggtcgggcctttggggtaacgggactaagggttaccgtttaccgaaccgttccgtaccgtaacctacgtaacctacggacgttaccgccgttacgacgttaacggttacgtaacggtaagttttcggttttacgacgtttttaacgtttacgtttacgtacggttaacgaacgttaacttaaaagttaacttacggtacgtccggtaccgttacccggtaggtttacggtccgttacggttttacccggtcgggaaacccgggtaggaacccggttacggtacgttaaacggggaacttaaccgaacggttaaaaccggg

SEQ ID NO: 242146 - DNA, 657 bp, Homo sapiens
  misc_feature: GYAE6OF01CF86W.35.85.H08.1.454.CMB.1.raw
  modified_base (259)..(259): a, c, t, g, unknown or other
  misc_feature (259)..(259): n is a, c, g, or t
  modified_base (276)..(276): a, c, t, g, unknown or other
  misc_feature (276)..(276): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccaggggacagacgccaccctctcctgcacgggccagtcagagtgtagcagctaacttagcctagtaccagnaagaagttgccgagccnccaggcctccgtctagtcgtttggtacgtcgtaccgacgtacgggccgtcgtcggtcgtcccgagtcgtaggtctagtcggtacgaggttcggctcgtgggactagtcgttacaccgttcgacctaccgacgtcgacggtcctaacggcctacgcgtaacggttaccgtaggtaacgttagttttacgtaccgtttaaggttttaacttacccgttagttaccgaaggtaccttaaaagtcgttaaaacgtcgtaccgttacggtcccgttaacgtacggtttcgtacgttacggttttccggacggtaaacggggttacccaagggtcttagggacgttaacgtaaaccgtaaacggtaacgtcgtaggtcgtaaccggg

SEQ ID NO: 242147 - DNA, 552 bp, Homo sapiens
  misc_feature: GYAE6OF01DRVYE.35.85.H08.1.454.CMB.1.raw
  modified_base (353)..(353): a, c, t, g, unknown or other
  misc_feature (353)..(353): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaagtggcaggctccaggctcctcatcgtttggtgtgtccagtacgggccgctggtcgtcccagtcaggttcagtggcagtggctcgtggacngtattcactctcaccatcagcagcctgcagtctgtaagtattttgtctagttttatttactgtcagtactaattaattaatagtcgttcggtcctccgtagttcgtaccttaccgttttacgggacccggtaacggggtaccgaacggtcgtagggtacggaacgttacgaaaacggtaacgtacggtggtccgtacgg

SEQ ID NO: 242148 - DNA, 774 bp, Homo sapiens
  misc_feature: GYAE6OF01DKZJ1.35.85.H08.1.454.CMB.1.raw
  modified_base (175)..(175): a, c, t, g, unknown or other
  misc_feature (175)..(175): n is a, c, g, or t
  modified_base (217)..(217): a, c, t, g, unknown or other
  misc_feature (217)..(217): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctccagatatcactggagaaatagtgatgacgcagtctaccaaccnctctgtctgtgtctccgaggggacagacgccaccctctccgngcgagggccagtcagagttgtacgcagactaacttacgccgtacggtaccagacaaggtaaacgtcggaccgaggccctacccgaggtcctacctcgtatttcgtttcggtcgtcgtaccacgtacgggtcccgtcgtggtccgtaccgtaggttaccgtacggtttacgaggttcggacgtaggtcggtcgtcggtagggacctaaggtccgttaccaccgttcctaccgaaccgtacgtaccgacggtaccgtaccggtacccgtagtacccgtaaggttcccggtaaggttaacggtttacgtttttaggtaccgttttaaacgggttttttacttaacccggtttagtaaccgtaaacgttacttaaaacttaacgttaaaccggttcggtacccgggttaccgggttacccgtttaacccggggtagttttaccggccggttttaccggtttaaccgggggaccccggttagggggtaaccctaacggttcggtaacgggtaaacgtaaccgtaaccggaaaccggttacgtcgggtaacgtcgtaacccgg

SEQ ID NO: 242149 - DNA, 699 bp, Homo sapiens
  misc_feature: GYAE6OF01AJNEC.35.85.H08.1.454.CMB.1.raw
  modified_base (328)..(328): a, c, t, g, unknown or other
  misc_feature (328)..(328): n is a, c, g, or t
tcagtacagatcgtcacgaccggtgctcgatttagtatcactcagtcggcgggggaggaactgctcagttaggacccaggacggaaccatggaagccccagcgcagcttctcttcctcctgcctattctggctccagatatcactggagaatagtgatgacgcagtcctccaactacgtctgtcctgtcgtctcccgaggggacaggacgcccacccgtctcccgtgccgagggccaggtcaacgagtcgttaagctagctaacttagccgtagtaccagccaagtaacgtcggctacggctacccgagcctccgtcaagtcttggtntcgtccagttacgggcctaggtcgcgttcccaggtctaagggttctagtgctaggtcgccttaggacgggaacctagggtatttccaccgtttctacccgatacgtacgacgtaccgacgtccgttcgacgtaacgtacggtacgtaacgtacgttttacgtcttaacggttttaactcgtttagtacccgtagaacgttaaagttaacctaagttacggtaccgttacggtacccgtacgggtaacgtttccggacctttacccggttttaagggacccggtaacgggtaaaccgtaaccgtccggttaacggaaaccgtacgttaaacccgggaaaccgttacggtacccggttcggtcgttaacccgg

SEQ ID NO: 242150 - DNA, 747 bp, Homo sapiens
  misc_feature: GYAE6OF01C7I6Q.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctaccaaccactctgtctgtgtctccgaggggacagcgcccaccctctcctgacacgggccagtcagaggttgttagcagtactaacgttacgccgtaggtacccagaccaaggtaaacgttcgggaccgacggcctaccccgacggtccttccccgttactacttcgttttacgggtcgttccggtacccgtacggtacggggcccgtcgttgggtccgtccccgaggtcgtaacggtttcgacggttgggacctagggtcggtcgttcggtagggaactacggttacgtcctaccgttaccgtaccaaccgtacttacgacggtcctaacggccctggaccgtacggtttacgtgtactttcggttatttttcggacttttaaggtttttaacttacgttacgtacgttacgtacttaagtttacgtagtaaaccgttaacggttccggtacccgttaccgggttacgggttacccggtacccgggtaccgtaaaccgggggtaaccgttaaaggggtaacggtaacccggttaaaccggaaaccgtaggttacggtacggcctacggaccctcgttaacg

SEQ ID NO: 242151 - DNA, 602 bp, Homo sapiens
  misc_feature: GYAE6OF01B3BFO.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttgcctggtaccagcaaggaagttggccaggcctccccgaggcctccctctacttcgttttgggtggttcgtcccaacggtacggggcccgtcgttcgggtcgtccccaggttccgtaaggttcaggtcggcaggtggctcggtagggacaggtgttcactctccaccatcacgcacgcctgctagtctagtaagttagtttgacttagtttattacgtgttacagtactaattataagtacgtcgtcggtacccgttcgtacggttcgtccgttacgtttcgggaccggtacggggtaacccgtaaggtcgtaggtaacgtaacgtaaccgaaaacggtacggtggtcggcgtacgg

SEQ ID NO: 242152 - DNA, 545 bp, Homo sapiens
  misc_feature: GYAE6OF01AX5IE.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttcggccaggctccgaggctcctcattcgtttggtgtcgtccacgtagggccgtctgggtcgtcccagtcaggtttcaggtggctaggtggctcgtgggacagtagttcactctcacctatcagcagcctgctagtctgaagtatttgactagtttatactgtcagactaatataatcgcttggtcctacgtagttcgacgttacgtttacgggaccgtacgggtacctaaggtcgtaggtaagtacgtaacgaaaccggttaagtcggtcggtcgtacgg

SEQ ID NO: 242153 - DNA, 697 bp, Homo sapiens
  misc_feature: GYAE6OF01B71XI.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgtagcagactaacttagcctaggtaacccagacgtaaggaaagttcggaccagggcctccccgaggccctcctacgtattcgtttaggtcgtcgtacccgacggtacgggcccgtcgtcgggtcgtccccgtaggtccgtaggtttcgaagggttcggacgtacggtcgggtccgttaccggacggggtacctagggtaccgtttccgaacccgtttccgtaccgaacccgtacgtaccgtaaccgaccgtaaccgtcccgtaggtacccgtaggttaccgttaggtaacgttacgttttcgaaccgtttaagttttacgttacgttacgtactagtacctaaagttacgtaagtacggtacgttccggttacccgtacgttagttacgtaccgttacgtttacggacggtaacgggacacggtcgtaggaactacgtaacgaaacgtagtcgtcggtcgtccg

SEQ ID NO: 242154 - DNA, 589 bp, Homo sapiens
  misc_feature: GYAE6OF01BFLI4.35.85.H08.1.454.CMB.1.raw
  modified_base (394)..(394): a, c, t, g, unknown or other
  misc_feature (394)..(394): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatgctgcaagtcggccagaggtgcccctgaacctgaaggccaatgagacccaagacaggccaagtggttgtgacgacccctgaggagctgggccctggtcccaggcagcgctggccctgctgctgcgtggtctggccagtcggtccncccgagtcggcctgcgtcgccgcccagtcggtcgccgaccgacgaacggcgggaccctacgacccgtacggacgtccgtacgtacgttacgggaagcgacgccgacgtcccgaggtcccgtcggaccggtacggccgtcgggtcggggaccgtacgggtccgaacggaccccgtaacgggccccgtaaacccccg

SEQ ID NO: 242155 - DNA, 641 bp, Homo sapiens
  misc_feature: GYAE6OF01BUR95.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcgagggccagtcagagtgttagcagctaacttagcctaggtaccagcaaggaaagttcggccaggcctcccgaggtcctccgtctagttcgtttggtcgtcgtaccgacgtacgggccgtcgttggtcgtcccaggtccgtacggttcaggttcggacgtaggtcggcgttcgtagggactaggtacgttcacgttcctaccaacctactcgacgccgacgtccgtacgactacggtcgtagtaagttagttttacgacgtttagtttacttacgttcgtacgtagtactaattagtaagtacgtcgtcgtaccgtacggtcgttacgtccgttacggtttacggacccggtaacggggtaacctaagggtccgtagggtaacgtaacgttaaccgaaacggtaacgttcggtcggtcgtaacg

SEQ ID NO: 242156 - DNA, 674 bp, Homo sapiens
  misc_feature: GYAE6OF01C9D47.35.85.H08.1.454.CMB.1.raw
  modified_base (246)..(246): a, c, t, g, unknown or other
  misc_feature (246)..(246): n is a, c, g, or t
  modified_base (287)..(287): a, c, t, g, unknown or other
  misc_feature (287)..(287): n is a, c, g, or t
  modified_base (393)..(393): a, c, t, g, unknown or other
  misc_feature (393)..(393): n is a, c, g, or t
  modified_base (516)..(516): a, c, t, g, unknown or other
  misc_feature (516)..(516): n is a, c, g, or t
tcagtacagatcgtcacgaccggtgctcgatttagtatcactcagtcggcgggggaggaactgctcagttaggacccagacggaaccatggaagcccagcgcagcttctctcctcctgctattctggctccagatatcacgtggagaaagtagtgatgacgcagtcctaccaacctctctgtctgtcgtcctccgaggggacaggacgcccaccctctcctgcgaggccagtcagagtgtagcganacttagcgtcggtaccagacaagaaggtcgccgacggtacncccaaggctcctcacttcgtttcggtgtctacccggtacgtacgggccgtcggttggtccgtcccgagtacggtacggttacgaacggtggactaggtcggtccgngtacggggacgtaacggtaggttccctaaacgtcgtacccaacggtctacgtacgacgaacgtcgcgtacgtacggtacgtagtaacgtagtttacgtacttaggttactttacgtacgttanaactagtaaataagtaacgtacgtacgtacggtcccgttacgtaggttccggtacttacggtttccgggaccggtaacggggtaacccgaagttaccgggtaagtacggtaaacttaaccggaaacgaacggttacggtcggacgtcggtaaaccccg

SEQ ID NO: 242157 - DNA, 692 bp, Homo sapiens
  misc_feature: GYAE6OF01CJ6K3.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcaggagtgttagcagcaacttagcctggtaccagcagaaagttggccaggcctacccgaggtcctccgtcagttcgtttggtgtcgtccacgtagggcccgtcgtcggtcgtccccaggttccgagggtttccaaggtcggacgtaggtcgggtctcggtgggaactaggtacgtttcaaccgttcctaccacctacgtccgaacgcgtacgtcccgtacgtcgtaagtcgtaggtaacgttagttttacggactttaagttttacgtttaacgttcgttacgtacgtactaaattaagttaaacgtacggtaccgttccgggtcccttaccggttaacggtttcggttaccgtttaaccggtttttccgggaacccgggtacggggtaacccgtaacgggtcgttacgggtaaacgtaacgtaaaccggtaaaccggaacggtttcggtaccgggtccgttaccggg

SEQ ID NO: 242158 - DNA, 719 bp, Homo sapiens
  misc_feature: GYAE6OF01CWOUR.35.85.H08.1.454.CMB.1.raw
  modified_base (231)..(231): a, c, t, g, unknown or other
  misc_feature (231)..(231): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcgagggccagtcagngtgttagcagctaacttacgccgtaggtaccagtacaaggtaaaggttcggccacgggcctccccgaggtcctccctctacttccgtttgggtgtcgtaccacgtacgggcccgtcgtggtcgtcccgtaagttcgtaacggttcgaggttcggacgacggttcgggtccgttacggtggggaacctagggtaccgttccgtaacttccctaccgaccttaagtccgacggacgaacggtcccgtacggacgtaggttcgtaacgtaagtttacgtttttacggaccgtttaaggttttttacttaaccgttgttaaccgtaagtaaccttaaaggttaacttaaagtcggttcctaccgggttcccttacgggttagtttacgtacccgttaggtttaccggggaccggttaaaccggggaactaacgggtccgttaaggggaacttaacgtaaccgtaaaacgtaaggtcgggtacgtccggtacg

SEQ ID NO: 242159 - DNA, 728 bp, Homo sapiens
  misc_feature: GYAE6OF01CXJWX.35.85.H08.1.454.CMB.1.raw
  modified_base (252)..(252): a, c, t, g, unknown or other
  misc_feature (252)..(252): n is a, c, g, or t
tcagtacagatcgtcacgaccggtgctcgatttagtatcactcagtcgcgggggactgcttcagggcagttggtagatgcccctctgggagagatccccaggggtgacagccatggaccctgggaagggcctgggctagggacagggaccagagccagtccgagggagaggacagagccaatggacgtggggtagtactagtaacagccctggctggcgaggaggaccgagggcaccgtcctccgaggggcnccatgctgcgaaggtccggcaggaggtcgcccgtagaaaccgtaggaacggaccaagtacgaaccggaacccgaaacgacgaacggaccgtaaaggttgggttcgtacggaacgaccccgtaggaacgggacggtccggtccggggtacccgtccgggtacccgacgggccgacggccgccgtcggccccgttcgccgtcgtcgtcgccgttgggtcccgtacggccgtaggtccggccgacccgtacggtccggtcctacggtccgacgtcccgaccgtaacgtcggtacgacccgaccggacggaaaccgggccgggaacccaacggtccccggagggacccgtaccggttagaccggttaggaacgccggaacgcgtacctaccgacgtcccggtacggaccggtacgtccgggtacggtacgggacggtacgaccggaaccggaaccccggtaacgacccccgtaaacccgg

SEQ ID NO: 242160 - DNA, 875 bp, Homo sapiens
  misc_feature: GYAE6OF01DMO1B.35.85.H08.1.454.CMB.1.raw
tcagtacagatcgtcacgaccggtgctcgatttagtatcactcagtcgcggggaggaactgctcagttaggaaccagacggaaccatggaagccccagcgcagcttctcttcctcctgctattctggctcccagatatcactggagaaatagtgatgacgcagtctccaaccactctgtctgtgtctccgaggggacagacgcccaccctctccgtgcgacgggccagtcaggagtgttagcagcaacttagcctggtaccagacgaaggtaaagttcggaccaacgggcctaccccgacgggtcctacccgtctacgttccgttttgggtcgttcgtacccgtacggtacggggtcccgtcgttcgggttccgtcccccgtaggttaccgtagggtttaccgaagggttcggggtacccgtaggggttcgggtccgtttacggtacggggggtaacctacggggttaaccggttttcccgtaaacccgtttacccgttacccgaaaccccttaacgtttaaccccgaacgggaacccctaaccgggtcccggttaacggtaccgttaacggtttaccgtttaaacgggtaaacggttttagttttttaaccggtaccgttttaaagtttttaacgttttaaacccgttcgttaacgtaacggtaaaccttaaatttaaaacgttaacgttacggtaccggtttacggtaccccgttaccgggttaacgtttaccggtaccgtttaccggggttttaccgggaacccgggtaaacgggggtaaacccgtaacgggttaacggttacgggtaaacgtaaaccggttaaaccggtaaaaccggaccggtttagggttaccgggtcccttaaaccggg

SEQ ID NO: 242161 - DNA, 843 bp, Homo sapiens
  misc_feature: GYAE6OF01DLY5B.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtcctaccaaccactctgtctgtgtcctccgaggggacagacgccctaccctctcctgcgacggcctagtcagtgtgttagcagactaattacgccgttaggtaccagtaccgaaaggtaacggttcggacccgacggtccctaccccgacgggtcccttacccgttcgtacgtttccggttttaggtacggttccgtaccctaaccgggtaccggggtcccgttcgttcgggtaccgtaccccgtaggttcgtacggttcgaggttcgcgtaggtcgcgttcgtggaactaggtacgttcctaacttccgtaaccctaccgtacgtacccgagtacccgtacggtcccgtaggtacccgtaacgttaccggttaaaggttaacgttttacggtttttaacgtaaccgtttttaaacggttttttaaccttaaccggttacggttaaaccgttaaacggttaaacctttaaagtttaaacgtttaacgttaacgggttacccggttaccgggtcccgtttaccgggttaagtttacccggttaccgggtttaaacccggtttaccggggacccgggtaaaccgggttacccgtaaagggttccgggttaaacgggtaaacgtaaccgttaaaacgggtaaacccggttaacggttgggtacccggtaccgttaacccgg

SEQ ID NO: 242162 - DNA, 613 bp, Homo sapiens
  misc_feature: GYAE6OF01ARTCN.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgtagcagacaactagcctggtaccagcagaagttgcaggctccagctcctcattcgttggtgtcgtccacgtacgggccgtcgtggtcgtccctaggtcgtaggttccaggtcggcgtaggtcggtctcgtggggtactaggtacgttacacctcgtaccacctatcgacgccacgtccctgacgtacgtctacggaagttagtttagtacttaagttttagttacgtcgtacgtaagtactaaattaactaaagtacggtacctacggtacccgtacggttacgttacgtacgtttaccgtttacgggacccggtaaggggtaacccaaggtcggtaggaactaacgtaaccgaaacggtacgtagggtcgtcgtaaccg

SEQ ID NO: 242163 - DNA, 787 bp, Homo sapiens
  misc_feature: GYAE6OF01ERRU2.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgagggacagacgccacctctctgcgaggccagtcagtagtgtagcagctaacttacgcctggtaaccagacgtaaggtaaacggttcggacccgaggccctaccccgaggtccttcccgtctagtttccggttttgggtgttaccggtacccgtaacggtacggggcccgtcgttcgggtccgtaccccgaggttccgtaggttccgagggtcgggctaggtcggtcgtcggtaggggaactacggtacgttaccgtacttccgtaccgacctacgtaccgacgtaccgacgtccgtacgcgtaacggttacgttaggtaacgtttacgttttcgtaaccgtttaacgttttacgtttacgttaccggtacgtaaggtaaccttaaagtttaaagttaacgttaacggttaccgttacccgggttaccccgtttaacgggttaacggtttaccggttaccgtttacccgggttttaccggggacccgggtaaaccggggggtaaacccaacgggtttaccggtaacggggttaacggaaaccgttaaacccggtaaaaccggttaaaccggttcggggttaacggtccgttaaccgg

SEQ ID NO: 242164 - DNA, 882 bp, Homo sapiens
  misc_feature: GYAE6OF01CELT5.35.85.H08.1.454.CMB.1.raw
  modified_base (173)..(173): a, c, t, g, unknown or other
  misc_feature (173)..(173): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccnctctgtctgtgtctccgaggggcagacgcccaccctctcctgcagggccagtcagtagtgtagcagactaacgttagcctaggtaccagacgaagtaacggttcggacccgagggcctaccccgaggtcccttccgtctaagtttccgtttcgggtcgttccggttaccctaacggttcggggcccgttcgttcggggttccgtaccccgtaaggttccgtaacgggtttccaagggttcgggaccgtagggttcggccgttcggtcggggaacacgggttacgttctaccgttcctacgaccgtactcgaacgccgtaacgtccgttacggactacggttacgtagtaacgtttacgttttacgaccgtttaaagtttttaccgttacgtttacggtaacgttaacggtaactttaaaacgtttaaacgttaaccgttaacgggttacccgtttaccggggttacccccgtttaaccgggtttaacgggtttccggtttaaaccccggtttttacccgggtttttaccgggggaaacccccgggttaaaccgggggggttaaacccccgtaaacgggggtttacccgggttaaacggggggtaaaccctttaaacccggggttttaaaaaaccccggttaaaaaccggggtttaaccccggggtttaaacggggtttcccggggttaaccccgtttaaaccccggggg

SEQ ID NO: 242165 - DNA, 783 bp, Homo sapiens
  misc_feature: GYAE6OF01C14EL.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtcctaccaaccactctgtctgtgtctccgaggggacagacgcccaccctctcctgcgaggtcagtcagagttgtagcagacaacttcgcctaggtaccaggacaaggtaaacggttcggaccgacggtccctacccgacggtcctccctctacgtttcgtttgggtcgttccgtacccgtacggtacgggccgtcgttcggttccgtacccgtaggttcgtacgggtttcgaggttcggtcgaggtcggtacttaacggtgggactaggtcgttacgtaccttacctaccaccgtactacgacgaccgtacgtcccgtaggtacgttacggttacttaacgggtaagtttcgttttaggaaccgttttaagttttaccgtttacgttacgttacgtaaccgtaatttaaagttaacgttaaacgttccgggttaccgtaccgggttaaccccgtttccggtaacggtttaccgttaccggtttaacccgggttttaccgggaacccggggttaaaccgggggtaaccctaaaggggtcccggttaacggggtaaactaacccgggtaaaccggtaaaaccggttaccgggttcgggtaaccggtccgttaaccccggg

SEQ ID NO: 242166 - DNA, 613 bp, Homo sapiens
  misc_feature: GYAE6OF01C8HGZ.35.85.H08.1.454.CMB.1.raw
  modified_base (362)..(362): a, c, t, g, unknown or other
  misc_feature (362)..(362): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaattagcctggtaccagcagaaagttggccaggctccgaggctcctcattctttggtgtcgtccagtacgggccgcgttggtcgtccccagtcgaggtttcaggtggcaggtggctgtgggacngtagttcactctacgaccatcagcagcctgcagtctagtaacgttagtttgtactagttttactttactcggttactagtactaaattaattaaacgttacgtacgttacggtaccccgttaccggttacggtttacggtaccgttaccggtttttacgggacccggtaaccgggggtaacccgaaacgggtccgttaacgggaacgtaacgttaccgaaaaaccggtacgttacgggtggtccgtacggg

SEQ ID NO: 242167 - DNA, 543 bp, Homo sapiens
  misc_feature: GYAE6OF01AZDTJ.35.85.H08.1.454.CMB.1.raw
  modified_base (53)..(53): a, c, t, g, unknown or other
  misc_feature (53)..(53): n is a, c, g, or t
tcagtacagatcgtcacgaccggtgctcgatttagtatcactcagtcgcgggngaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccactagggccgctggtcgtcccagtcgaggttcaggtggctaggtggctcgtgggacagtacgttcactctacactatcacgcacgccctgctagtctagaagtatttgctagtttattactgtacagtactaattaataatagcgttggtacccgtacgtagttcgtacgttacgtttcggccgtaggggaacctaaggtccgtaggaacgtaacgtacgaaaaccggtactggtcggtacg

SEQ ID NO: 242168 - DNA, 666 bp, Homo sapiens
  misc_feature: GYAE6OF01AFCUL.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagccctggtaccagactaaggaaacgttcggacctaaggccttccccgaaggtcccttaccttctaacgttccgttttgggtgttcggtacccaacggtcggggcctcgttcgggtcgtccccagtcgtacgggttcaggttggacgtaggtcggcgtcgtggggaactaggtagtttcacgttccaccgacctaactcgaacgtccgacgtccgtcgtacgtacgttcgtaacggtaacgtttatttttggaccgttaagttttacttagttcgtacgagtactaaataattaacgttacgtcgtcgtacccgtacgttacggttctaccgttacggtttccggacgggtaaccggggtaacctaaggtcgtaacggtaacggaacgtaaacgtaacgtacgttggtaccgtcgtaacccg

SEQ ID NO: 242169 - DNA, 736 bp, Homo sapiens
  misc_feature: GYAE6OF01BM56U.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtcctaccaaccactctgtctgtgtctccgaggggacagacgccaccctctcctgcgagggccagtcagtagtgttagcagactaacgttagcccgtacggtacccaggacgaaggtaacgttcggacccgaggtccttaccccgaggtccttccctaccgtagttcgttttgggtacgttcggtacccgtacggtacggggtcccgtcgttcgggtcctacccgtaggtccgtaggttcgaggtcggacgtacgtcggcttcggtagggacctagggtacgtttccgacgtaccgttacaacccgtagttccgaacggtccgtaccggtccgttacggtaacgtacgttaccgttaagggtagtttacgtttttacggaccgttttaacgttttacttacgttccgttacgtaacgtaacgttaattaacgtaagttcggttcgttccgtaccggttacggttgttaccgttccgtttaacgggttcccggacgggtaacggggtaccctagggtacgttacggaacgtaacgtaacggtaaaccgtacgtttacggcgggtccttaaccgg

SEQ ID NO: 242170 - DNA, 777 bp, Homo sapiens
  misc_feature: GYAE6OF01DXZJ3.35.85.H08.1.454.CMB.1.raw
  modified_base (224)..(224): a, c, t, g, unknown or other
  misc_feature (224)..(224): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcacgtggaagaaatagtagatgaacgcagtcctaccaaaccacttctgtctgtgtcctaccgaggggacagacgcccacctctcngcgacgggacagtcagtgttagtacgctaggactaacttacggccgttacggaaccgagaccgaaggtaaacggttcggaccgacggtcctaccccggaggtcccttcctacgtatttcggtttaggtcgtcgtaccgtacggtacggccgtcgtaggtcctacccgagttcgacggttcagggtggctaggtcggtctacggtagggaactacgtacgtttccaccgtttacctacaacccgtacgtaccgacgtaccgacggtacccgtacggtacgtaacgttacgtaaggtaaagtttacgttttacggtacgttttaacgttttaacgttacgttacgtaccgtaagtaaactaaagttaaacgttaaacgtcgtaccggttaccggtaccgttaccggttaacgttaccgttaccggtttaccggttttacgggaacccgggttaaaccggggtaaccgtaaacgggtacggttacgggtaaacgtaaaccggttaaaaccggaaacccggttaacggttacggttaacgggtcggttaaaccccgg

SEQ ID NO: 242171 - DNA, 535 bp, Homo sapiens
  misc_feature: GYAE6OF01C00TP.35.85.H08.1.454.CMB.1.raw
  modified_base (318)..(318): a, c, t, g, unknown or other
  misc_feature (318)..(318): n is a, c, g, or t
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctaggtaccagcagaaagttggcaggctcccaggctctcattctttggtgtgtcctacgtacgggcccncgttggtcgtccccagtcaggttcagtggcagtgctgtgggacngattcactctcactatcancagcctnctagtctagaagtattttgctatttactacgtgtactagactaatactaagtgctggtccctcggtagtttgcctacgtttggacccgtagggacccaaggtccgtaggtagtacgtaaccgaaacggtagtcgggtggtcgtacgg

SEQ ID NO: 242172 - DNA, 797 bp, Homo sapiens
  misc_feature: GYAE6OF01E1DI4.35.85.H08.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtcctccaaccactctgtctgtgtctccaggggacngacgccaccctctcctgcagggccagtcagngtgtagcagcaacttagcctaggtaccagacgaaggaaagttcggaccacgggcctaccccgaaggtccttaccctcgtacttcgttttgggtcgttcgtacccacgttacggggccccgtcgttacgggtccgtaccccgaggttccgtacgggtttccaagggttcgggaccgtagggttcgggtcccttcggtagggggtacctaagggtacgttttaccaaccgtttcctaccgaacccgtactaccgtaacgccgtacgtaccccgtcggtaccgtaacggtcgttaacggtaacgtttagttttttacggtaccgttaaggtttttaactttaaccgttacgttacgtaacggtaacctaaaattaacgttaaacgttaacggtaccgttaccgggtacccgttacccgggttaacgtttacggtaccgtttaacccggtttttaccggggacccgggtaaaccgggggtaacccgtaaacgggtccggttaacggggaacggtaaaccgttaaaccggtaaaaccggtaaccggttacgggttacggtcccgttaaccgg

SEQ ID NO: 242173 - DNA, 735 bp, Homo sapiens
  misc_feature: GYAE6OF01BS1M4.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacaggacgccaccctctcctgcgaggccagtcagagtgttagcagcaacgttagccgtaggtaccagacagtaaagttcggaccgaggcctaccgaggcctcctctattcgtttggtgttcgtccgacgtacgggccgtcgttcgggtacgtccccgtaggtccgtagggttaccgaggttcgggacgtacggttcggggccgttacggtggggaacctagggtaccggtttccaacgttccgtaccaaccgtattaccgagtaccgaacgtcccgtagacgttaacgtccgtaacggtaagtttacgttttacgacttttaaggttttactaccggtttcgtacgtaagtacctaaattaagttaaacgtacggtacttacccgggtaccttaccggttacgggtttctaccggttttaacccggtttcggaaccccggggtaaccggggaaccgtaaaggtcccgggttaaaggtaaccgtaaaccggtttaaacgaaaacccggttaagggttcggtaacggggtccctaacccggg

SEQ ID NO: 242174 - DNA, 722 bp, Homo sapiens
  misc_feature: GYAE6OF01C696A.35.85.H08.1.454.CMB.1.raw
  modified_base (147)..(147): a, c, t, g, unknown or other
  misc_feature (147)..(147): n is a, c, g, or t
  modified_base (178)..(178): a, c, t, g, unknown or other
  misc_feature (178)..(178): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactgganaaatagtgatgacgcagtctaccaaccactntgtctgtgtctcgaggggacagacgccctaccctctccgtgccgagggccagtcaggtagtgtagcagactaacgttacgccgtaggtaccagacgtagtaaacggttcggaccgacggcctccgacgtcctcctctagtttcgtttggtcgtcgtaccgacgtacgggtccgtcgtcgggtcgtacccgaggttccgtaagggtttccgaggttgggaccgtaggttccggtacgttccggtaggggtactacggtaccgtttacccgtactacccgtaccgaacctacgtccgaacgggtcctacgggtcccgttagtaccgtaaggttccgtaaggttaagttcgtttttacgacgtttaacgttttaccgttacgtaccgtacgtaacgtaacttaagtttaagttaaccgtcgggttcttaaccgggtacccgttaggttacgttcggtaaccgtttacgggttaccgggacccggtagggtaccctagggtaccgaggtaaccgtacgtaacgaacggttagcggtcggtccgtaacg

SEQ ID NO: 242175 - DNA, 683 bp, Homo sapiens
  misc_feature: GYAE6OF01EFKH0.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatgtgatgacgcagtctccaaccactctgtctgtgtctccgaggggacagacgcccaccctctcctgcgagggccagtcagtagtgtagcagcaacttagcctggtaccagcaagaaagttggaccaggcctacccgaggtcctcctctacgtttccgttttagggtgtacgtcccgaacggttaccggggcccgtcgttgggttcgtaccccgtagttccgtaggtttaccgaggtcgggacgtaggtcggtaccgttcggtacggggactagggtaccgtttccgaccttccgtaccaaccgtacgttccgacgtaccgaacggtcccgttacggaccgtacggttacgttacggtaagtttacgtttttcgacgtttagttttactttacgttcgtacgacgtaactaaagttaagtaagttacgtcgtacggtccttacgtacgttcgtaccttacggtttcggacccggtacgggtaaccacggtacgcggtaagaccgttaacgaaacgtaccgttggtcgcgtaccg

SEQ ID NO: 242176 - DNA, 817 bp, Homo sapiens
  misc_feature: GYAE6OF01DCH3U.35.85.H08.1.454.CMB.1.raw
  modified_base (201)..(201): a, c, t, g, unknown or other
  misc_feature (201)..(201): n is a, c, g, or t
tcagtacagatcgtcacgaccggtgctcgatttagtatcactcagtcgcggggaggaactgctcagttaggacccagacggaaccatggaagccccagcgcagcttctcttcctcctgcttattctggctccagatatcatggagaaatagtgatgacgcagtctccaaccactctgtctgtgtctccgaggggacagacncccaccctctcctgcgacgggccagtccagtacgttgttagacagaccaacttacgcctaggtaccaggactaaggtaaagttcggaccgacggcctacccgaggtccttaccgtctagttcgttttcggtcgttacgtaccgtacggtacggggtcctcggttcgggtaccgtaccccgtaggttccgtacgggtttccgaagggttcgggtaccgtagggttcggtcgttacggtacggggaactagggtaacgtttccgaccgttacctacctaaccgtacgttaccgacgaccgtacggtcccgttacggtacgtaacggttacgttaacgggtaagtttacgtttttacgtaacgtttaacgtttttaacgttttacgttacggttaaccgtaacggttaacttaaagtttaacgtttaaaagtttacggtaccgttaccgggttacccgtttaaccggttacggttttaccgttacggtttaacccgggttttaccggggaacccggggttaaaccggggtaacccggttaacgggtaccggttaacgggtaaacgttaacggtaaaccgtaaaaccgggttacggttacggtcgggttacgtaacccgg

SEQ ID NO: 242177 - DNA, 578 bp, Homo sapiens
  misc_feature: GYAE6OF01A0VFN.35.85.H08.1.454.CMB.1.raw
  modified_base (404)..(404): a, c, t, g, unknown or other
  misc_feature (404)..(404): n is a, c, g, or t
  modified_base (428)..(428): a, c, t, g, unknown or other
  misc_feature (428)..(428): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcaagaagttggccaggcctccccgaggcctccctcattcgtttggtgtcgtccacgtacgggcccgtcttgggtacgtccccagtccgtaggttcaggtcggcaggttggccgttcgtggggacaggtacgttcactctcgaaccntcagcacgtcctgcagtcctagtnttgttatttgactagttttattactgtcagtctagtttatagacttaactcggtacccttccggtaggtaccggtttacccggacgaaccgggtaccgaagggtacggtaacgtaccgaaacgtaccgtagttcggagtcgccgactacg

SEQ ID NO: 242178 - DNA, 528 bp, Homo sapiens
  misc_feature: GYAE6OF01B27HZ.35.85.H08.1.454.CMB.1.raw
  modified_base (358)..(358): a, c, t, g, unknown or other
  misc_feature (358)..(358): n is a, c, g, or t
  modified_base (523)..(523): a, c, t, g, unknown or other
  misc_feature (523)..(523): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgtagcagcaacttagcctggtaccagcaagaagttgccaggcctccaggcctctctatcgtttggtgtcgtccacgtacgggccgcgtggtcgtcccagtcaggttcagtggcaggtgctcgtggacngtacgttcactctacacatcagcacgcctgctagtctagaagttgtttagcttagtttattacgtagtcagtactaattataacgtagtacgtcggtacctccgtagttcgtacttcgtttacggccgtaagggaccaggtcgtaggacagtacaacgatggtgngtacg

SEQ ID NO: 242179 - DNA, 674 bp, Homo sapiens
  misc_feature: GYAE6OF01A3LFO.35.85.H08.1.454.CMB.1.raw
  modified_base (461)..(461): a, c, t, g, unknown or other
  misc_feature (461)..(461): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgcccaccctctcctgcgagggccagtcagagtgttagcagctaacttagcctggtaccagcaagtaaagttcggaccaggcctcccgaggtcctcctctacttcgtttggtcgtcgtacccgacggtacgggccgtcgttcgggtccgtccccaggttccgtagggtttcgaggtcgggactagggttcggcgttcggtagggactaggtacttccacttctaccacctatacacgcacgtcctgctagtcgtagtaagtntttacgacgttagtttacttacgtacgtacgtaacgtaactaaagttaactaaagttacggtaccgttaccgggcccgttaccggttacggtttcggtaccgtttaccggttttacgggaacccggtaaaccggggtaaccggtaaagggttacggtaaaacgtacccgtaaacggtaaccgttagggtacggtcgttacggaccgtaacccg

SEQ ID NO: 242180 - DNA, 660 bp, Homo sapiens
  misc_feature: GYAE6OF01AZ5LA.35.85.H08.1.454.CMB.1.raw
  modified_base (325)..(325): a, c, t, g, unknown or other
  misc_feature (325)..(325): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagtaaagttggccaggcctcccgaggcctcctcattcgtttggtgtcgtaccctacgtacggggcccncgttgggtcgtccccgaggtctagggtttccaggtcggactaggtcggtccttcggtggggaacctaggtacgtttccaaccgttcgtacccaaccacttcacggtccgaacgtcccgttcgacgtacggttcctaacggtaagttacgtttttgaccgtttaagttttacttacgttggtactaaggtaactaaattaattaaagttacgtaccgttacgggtacccttaccggtagtttcgacctttacggttttcgggaaccggtaacggggtaacctaggtccgtagggaagtaacgttaacgaaacggtaacgttggtacggtcgtacgg

SEQ ID NO: 242181 - DNA, 853 bp, Homo sapiens
  misc_feature: GYAE6OF01EO34L.35.85.H08.1.454.CMB.1.raw
  modified_base (200)..(200): a, c, t, g, unknown or other
  misc_feature (200)..(200): n is a, c, g, or t
tcagtacagatcgtcacgaccggtgctcgatttagtatcactcagtcggcggggggagaactgctcagttaggacccagacggaaccatggaagccccagcgcagcttctcttcctcctgtctattctggctccagatactcacgtaggaagaaatggtgatgacgctaagtcctaccaaccactcgttcgttcttggtntccgtaccggaaggggtacaaggaccgaccctaccctcttcctggaccgagggtccacggttacgaaggtaggttcggttacggacgtaacggtaccttaaacgttacggtacccgttacgggtaaccgtaggaaccgtaagggtaaacggttcgggaaccgtaaccgggtaccctaccggaacgggtccctacttacgttactttcgggtttggtcgttcggaccttacgggtacgggccgttggtacgggttccgtccgtaaggttaccgtagggttcacggggttaggcgtacgggtcggtcgtcgggaacgggtaactacgggttacttacccgtaccgtctaaccggaaccctgtacccggtacgaccgtacggttccgtacggtaaccgtacggttaacggtaacggtttattttaacggtttcggttaacttttaaggttttacgttaacgtttcgttaacgaacgttaacttaaactttaaacggtaacgttccggtaacgggttacccggttaccggtttaacgggagttttaccggaccctttaggggttaaccggaccggggttaaaccgggtagtaacggttcgggaacgttaactaacggtaacgttaaacggaccggtttggacccgtacgtaacccgg

SEQ ID NO: 242182 - DNA, 649 bp, Homo sapiens
  misc_feature: GYAE6OF01AUOAJ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgccagggccagtcagagtgttagcagcaacttagcctaggtaccagacgaagaaagttcggccgacggccgtcccgacggtctccgtctacttcgtttcggttggtcgtaccgacgtacgggacgtcgtggtcgtcccgtacggtcgtacggttcgaggtcgggcgaggttgggtcgtgggaacgtaggtaacgttcacgtctaccacctacgtcagctacgacctgctaggtctacggtattgttacttttacggtcttaagtttttaacttacgttcgtacgtatacgttagtttaatgtaaacgttacgttcggcccgttaccggttggtaaaccgggttccggaaccggaaacggggtacgtaaacgggtacggaacggtaacccgaacgtaaccgttaggttcggacttagacccgtaccttagtcccgg

SEQ ID NO: 242183 - DNA, 751 bp, Homo sapiens
  misc_feature: GYAE6OF01B5WQU.35.85.H08.1.454.CMB.1.raw
tcagtacagatcgtcacgaccggtgctcgatttagtatcactcagtcgcggggaggaactgctcagttaggacccagacggaaccatggaacgcccagcgcagcttctcttcctcctgctattctggcctccagatatcacgtaggaagaaatgtgagtgacgcagtcctaccaacctacttctgtcgtgtcgtccgtaccggaggggacacggaccgccctaccctctccgtacgcgacggccagtcaggtaggttgtacgacacgactaacgttacgtccgtacggtacacgacgtaaggtaacgttcggaccgtacggccgtcccgtacggtcccttccgttacgtacgttttcggtttcggtacgtcggtccgtaacgggtcgggtccgtcgttggtccgtaccgtagttcgtaacggttcgaggtcgacgtaggtcgcgtaggtacggacgtagtcgttcacgtctaccgactatcgacgactcgcgtacgtaccgtagtactaagtacttattcggtactacgtttactttacgacgttacgtacggtactaacgggttaccttaaagggtttaaccgtccggtacccggttcccgggtacccgtcgtttacccgggttacccggtttacgggggtacccggggtaaacggggtaccgggtaaacgggtagggttaaaccggaaacggttaaaccgtaaacggtaaacgggttcccggtagggtacgttacccggactaacccgg

SEQ ID NO: 242184 - DNA, 619 bp, Homo sapiens
  misc_feature: GYAE6OF01EYBMP.35.85.H08.1.454.CMB.1.raw
  modified_base (418)..(418): a, c, t, g, unknown or other
  misc_feature (418)..(418): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagagccaccctctcctgcaggccagtcagagtgtagcagctaacttagcctggtaccagcaagaagttgccaggctcccaggtctcctctacttcgtttggtgtcgtccacgtacgggccgtcgtggtcgtccagtcgaggttcaggtggcagtggtctcgtgggacaggtacgttcaccttcgtacaccgatcacgcagtcctgcacgtcgtagtaagtnttttcgacttagttttacttacgttcgtactaagtactaaattaataagttacgtaccgtggtaccccgttacggtacgtttacgtaccgtttaccggttttacggacccggtaaacgggggaccctaaacggtccggtacgggtaaacgtaaccgttaaccgtaaaaacggtaacccgttgggtacgggtccgttaacgg

SEQ ID NO: 242185 - DNA, 679 bp, Homo sapiens
  misc_feature: GYAE6OF01DZ8LQ.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgcccaccctctcctgccgaggccagtcagagtgttagtagactaacgttagccttaggtaccagaccaagtaaagttcggaccgaggcctcccgaggccttcctcattcgtttggtcgttcgtaccagttacgggccctgtcggtcgtcccaggttcgtaggttcacggtggtaccgtaggtcgccgttcgtcggggaactaggtacgtttccacgttccgtaccgaacctacgtaccgacgtcaacggtcccgtacggtacgtacggttcgttacgtaagtttagtttttacggactttagttttacttaacgttcgtaacgtaacggtaacttaaacttaagttaacgtacgtcgtaccggtacccgttaccggtaagtttcgtacgtttaccggttttcgggacccggtaacggggtactaacggtcggttacgggaagtaacgtaaccgtaaacggttaacgg

SEQ ID NO: 242186 - DNA, 600 bp, Homo sapiens
  misc_feature: GYAE6OF01BICVV.35.85.H08.1.454.CMB.1.raw
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagagcccaccctctcctgcgacgggccagtcgagagtgtagcagctaacttgcctggtaccagcaagaagttgacaggctcccgaggcctacctntattcgtttggntcgtccacgtcgggcctgtggtcgtccgagtcgtcggtcgagtcggcgtaggtggctcggtggacagtacgttcacgtctacacctatcgacgcacgtctgactaggttactaggtaagttntttcgtacgttaacgttttntacgtagtactaagacttaaagttactaagtacgtacgtcgtacccgtcgttaagttcgtacgttaaccggtttcggacccggtaagggtacccgaggtccggtacggaacggttaactaaccgaaacggttagtcgggtccggtaactacccgg

SEQ ID NO: 242187 - DNA, 801 bp, Homo sapiens
  misc_feature: GYAE6OF01EV0NI.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcgacgggccagtcagtgtgttagcaggacaacttacgcctagggtaacccaggacaaggtaaaaggttcgggaccccgtaagggccctacccccgaaggggtccccttacccttacctaactttccggtttttagggttcggttcggttacccgtaaccggttacggggccccggtccggttggggttacccgtacccccgtaaggttcccgtaaggggtttccaagggttcggaccgtagggttcgggccttaccgggtaggggaaccctaagggtacggtttcctaaccgtttcctaccctaaccctaacgttaccgaacggacctaacggtaccccgtcggtaccgtaacggttaccgttacgggtaaaggttacgtttttacggtaccgtttaaggttttaactttacttacggttacctaggttaacctaaattaattaaacgtacggtccgttacgggtccccgttacggtacggtttacgtacgtttacggttttaccggacccggtaacgggtaacccgtaacggtacggttacgggtaacgtaaacgtaaccggtaaaaacccggg

SEQ ID NO: 242188 - DNA, 757 bp, Homo sapiens
  misc_feature: GYAE6OF01DLMGP.35.85.H08.1.454.CMB.1.raw
  modified_base (230)..(230): a, c, t, g, unknown or other
  misc_feature (230)..(230): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgccagggccagtcagngtgttagcagacaacttacgcctaggtaccagacaagtaaacggttcggaccgacggcctaccccgaggtcccttccctactacgtttcgtttaggtcgtcgtaccgtacggtacgggcccgtcgtcgggtcgtccccgtaggtccgttagggtttcgaacggtgggtccgaggttcggtcccgttcgtaggggtaaccgagttaccggttcctaacccgttcttaccaacccgtagttacccgaacggtaccgtaccggtacccttacggtaaccgtaacggtttaccggtaaggtttaaacgtttaggtttttaccggtaacgttttaagttttttactttaaccggtttacgttaccgttaagtaccttaaaagtttaacttaacggttacggtaccttacgggtaccccttgggttacgttcgttacccgttaccggttttccggaaccgggtacggggtaaccaggttacccggtaggtaacgtaaccgtaaccgaaacgtacggttggtcggtacgtaccg

SEQ ID NO: 242189 - DNA, 794 bp, Homo sapiens
  misc_feature: GYAE6OF01D8519.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtcctccgaggggacagacgcccaccctctcctggccacgggccagtcaggtagtgttagcagactaaccgttagcccgtaggtaacccgaggaccaaaggtaaaacggttcggacccgaacgggcccttaccccgaacgggtcccttccccgttacgtaacgtttccggtttttcggggtcggttccgttacccggtaacggttaccgggggccccgtcggttcgggttccgttaccccgaaggttccgtaaggggtttccgaagggttcgggacgtacgggttcgggtcccgttaccgggtagggggaacctaacgggttacggttttacccaacccgttcccttacccgaacccctaagtacccgtaacggaccgtaaccggtccccgttaggacccgtaacgggttaccgttaacggtaaagtttacgttttttgaaccgttttaagttttactaacgtttgtacgtaagtacctaaagttaataacgttacggtccgttacggtaccgttaccggttgttccgtacgtttacggtttccggaccggtaacgggtacctaaggtcggtaaggtagaacgttacgaaacgagttacggtgccgtacg

SEQ ID NO: 242190 - DNA, 622 bp, Homo sapiens
  misc_feature: GYAE6OF01B0XZ5.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggcctcccaggctcctcattcgtttggtgtgtccacgtaggggccgtctgggtcgtccccagttcagggttcaggttcgggctaggtggccgtcgtaggggacaggtacgttccacttcctaccaccctatccagccacgccctgcctagtcctaggtaagtattttgacttagttttaacttacttgtacctagtactaaattaagttaagtacgtccgttcgggacccttaccggtacggtttcgtacccgtttacgttttacgggaccggtaacgggggtaacctaacggtcggtagggaacgtaacgtaacgaaaaccggtaacgttcgggtacgggtctaccggg

SEQ ID NO: 242191 - DNA, 763 bp, Homo sapiens
  misc_feature: GYAE6OF01CTFL0.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtcctaccaaccactctgtctgtcgtctccgaggggacagacgccctaccctctcctgcgagggaccaggtacaggagttgtacgcgaacgtacctaaacgttacgcccgtagggtaacccaggtaccgaaaggtaaaacggttcgggacccgaacgggtcccttacccgacgggtccccttacccgtaccgtagtttccgtttgggtacgttaccgtcccgaagttccgggggacctcggttcggtccgtaccctaacggttcgtacggttcgtagggtcgaccgaggttcggcttcgggtgggtaactaggtactttacgacttcctaccacgacttccgagtccgtaacgtccgttgacgtacgttaccgtaaggtaagtttacttttacgacgtttaacgtttacgtttacgtagttaccgtaaacgtacttaaattaacgttaacgtaggttcccgtacggttaccctaccggtacgtttacgtaaccgtttacgggtttccgggacccggtaacggggtaacccgtaaggtccggttaacggaacgtaacgttaaccggtaaaacgtacgggttacggtccggtacgttaacccgg

SEQ ID NO: 242192 - DNA, 533 bp, Homo sapiens
  misc_feature: GYAE6OF01EO7D8.35.85.H08.1.454.CMB.1.raw
  modified_base (305)..(305): a, c, t, g, unknown or other
  misc_feature (305)..(305): n is a, c, g, or t
  modified_base (525)..(525): a, c, t, g, unknown or other
  misc_feature (525)..(525): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgtagcagcaacttagcctggtaccagcaagaaagttggccaggcctcccgaggtctcctcattccgtttggngttcgtcctacgtacgggccgcgtggtctccagtcgaggttcagtgcagtcggctcggtggacagtagtcacgtctacgactatcacgcacgcctgcagtcgtagaagttgtttgcttagtttatactgtcagactaatataagtagctcggcctacgtagtcgtacttacgtttcggaccgtagggaaccagcgtaggatacgtacgaaacgattcggngtcgtacg

SEQ ID NO: 242193 - DNA, 795 bp, Homo sapiens
  misc_feature: GYAE6OF01CJ3CF.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggaagaaatagtgatgacgcagtctccaaccactctgtctgtgtctccgaggggacagagcccaccctcctcctgcagggccagtcagagtgtagcagctaacttagcctaggtaccagcaagaaagtcggccaggcctcccgaggcctcctctactttccgtttgggtcgtcgtaccgacggtacggggccccgtcgttcgggtccgtaccccgtaaggttccgtaaggggtttccgaaggggttccgggtacgtacgggttcgggtacccgttaccgggttacggggggtaacctacgggttaaccgggtttaccctacccgtttacccttacccgaaacccgtaacgttacccggaaaccggtccgaaccggtccccgttaggaccgttaacggttaccgttaacgggtaaaacgttttcgttttttacggaaccgtttttaacggtttttaacgtttaaccgttcggtttaacctaaacggttaccttaaaaagtttaagtaaacgttacggttaccgttacggtacccgttaccgtaggtttacgtaccgtttacggtttcgggaacccggtaacggggtaacccaaggtccggtaggtaaacgtaccgtaaacggtaaacggaactttcgggacgtcccgtaacgg

SEQ ID NO: 242194 - DNA, 685 bp, Homo sapiens
  misc_feature: GYAE6OF01DCRPX.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctaccaaccactctgtctgtgtctccgaggggacagacgccctaccctctccgtgcgagggccagtcagtgtgtagcagctaacttacgcctaggtaccagacaaggtaaacgttcggaccgaggtcctacccgaggtcctccgtactagttcgttttgggtcgttcgtacctacgtacggggcccgtcgtgggtcgtcccagtcgtaggttcaggtcggacgtaggtcgggcttcggtagggactacggtacgttaccgtacttttaccgaacctacgttacgaacgtcgtaacgtcccttaggacccgttagttacgtaaggtaagtttcttttacggactttaagttttacttaacggttcgtacgtagtaactaaagttattaagtacgtacgtcggtcccgttacggtacgtttcgtaccgtttacggttccgggaccgtaacggggtaacctagggtacgtagggaacgtactaaacggtaaaccggtagtcggtaccgggtctacggtaacccg

SEQ ID NO: 242195 - DNA, 596 bp, Homo sapiens
  misc_feature: GYAE6OF01BZMRR.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctgggtaccagacagaaagttgccgaggcctcccgaggcctcctcagtctttggtgtcgtccacgtagggcccgcgtggtcgtcccgtagtcctaggttccaggtggcagtggcttcgtaggacagtacgtctacgtctcaccactcagcacgcctcgctacgtacgtagtaagtacgtttcgagttagtttacttacgttcgtactaagctaatataatacgtacgttcgaccttaccgtagttcgtaccgttacgttttacggaccggtaacgggtaaccgaacggtcgttacgggaacgtaacgtaaccggtaaaaccgtaacggttacggtaggtccgttaccgg

SEQ ID NO: 242196 - DNA, 695 bp, Homo sapiens
  misc_feature: GYAE6OF01B14LW.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtcctccaaccactctgtctgtgtctccgaggggacagacgcccaccctctcctgcgagggccagtcaggagtgttagcagacaacgttacgccgtacggtaaccgagacgaaggtaaaggttcggaccgacggtcctaccccgaggtccttacccgtctacgtttcgtttggttcgttcgtaccgtacggtacgggtccgtcgttcgggtccgtaccccgtagttcgtaggttcgagggtcgcgtaggtcggtcgttacggtcgggaacgtaggtacgttacgtacctccgtaccaaccgacttaccgagtccgtacgccgtagcgtaacgttacgtaagtaacgtttgttttacgtacgtttaagttttaactttacgtcgttaacgagttaactaaagtttaagtaaagtcgtacgttccgggacccgttacggttacgttcggtaccgtttaccggttacgggaccggtaaacgggtacctaacggcgtaggaaactacgtaacgaaacggttagcggttagcgtaccg

SEQ ID NO: 242197 - DNA, 582 bp, Homo sapiens
  misc_feature: GYAE6OF01D352Y.35.85.H08.1.454.CMB.1.raw
  modified_base (551)..(551): a, c, t, g, unknown or other
  misc_feature (551)..(551): n is a, c, g, or t
  modified_base (576)..(576): a, c, t, g, unknown or other
  misc_feature (576)..(576): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcgagggccagtcagagtgttagcagcaattgcctggtaccagcaagaagttggccacggcctcccgacggctcctcagtttccgtttggtgtcgtcctacggtacgggccgtcgtggttcgtccccgtagtcgtacggttcagggttcggcgtaggtcggtctcggtagggacaggtcgttaccacgtcctaccacactcgacgcgacgtcgtcgctagtcgtagtacgtttagtttgactttagtttattcgtgtcaagactaaatataacgtagtcgtcgtcctcgtagttcgacttacgttcggacggtacgggaaccaggtcgacggtanaacgtaccgaaacgtacgtggtcgntaccgg

SEQ ID NO: 242198 - DNA, 620 bp, Homo sapiens
  misc_feature: GYAE6OF01CO6LZ.35.85.H08.1.454.CMB.1.raw
  modified_base (612)..(612): a, c, t, g, unknown or other
  misc_feature (612)..(612): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgagcagtctccaaccactctgtctgtgtctccgaggggacagagcccaccctctcctgcagggccagtcagagtgttagcagcaacttagcctggtaaccagaccgaaggtaaaacggttggacccgaagggtccctaccccgaagggcccttcccgtacctaatttccgttttgggtcggttcgttacccgaacggttacggggcccgtcgttcggggtcgtaccccgaggtcgtacgggtttcaggtcggctaggtcggtctcggtgggaacaggtacgttccacttcctacacctatccgaacgccgtacgcctagactagtcgtagtaagtatttgaccttagtttacttactgactagtactaatataactcgcgtcggtccctcgtagttcacgttacggtttggaccggtacgggactacggctagggactagtaacgtaacagtcgngtcgtacg

SEQ ID NO: 242199 - DNA, 542 bp, Homo sapiens
  misc_feature: GYAE6OF01EUIXT.35.85.H08.1.454.CMB.1.raw
  modified_base (296)..(296): a, c, t, g, unknown or other
  misc_feature (296)..(296): n is a, c, g, or t
  modified_base (371)..(371): a, c, t, g, unknown or other
  misc_feature (371)..(371): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggcaggctcccaggctcctcattctttggngtcgtccacgtagggcccgcgtggtcgtcccaggtctaggttcaggtggcaggtggctcgtgggacaggagttcnctctcaccatcagcacgcctgcagtctagaagtatttgactagtttattactgtacagtactaatattaagtagcgttacgccctccggtagttcgtacttacgttttcgggaccgacggggaaccaaggtcgtagggaagacgtaacgaaacgtaagtcggtggcgtacg

SEQ ID NO: 242200 - DNA, 576 bp, Homo sapiens
  misc_feature: GYAE6OF01EC19Q.35.85.H08.1.454.CMB.1.raw
  modified_base (363)..(363): a, c, t, g, unknown or other
  misc_feature (363)..(363): n is a, c, g, or t
tcagtacagatcgtcacgaccggtgctcgatttagtatcactcagtcgcgggggagagctctggggaggaactgctcagttaggacccagacggaaccatggaagccccagcgcagcttctcttcctcctgctattctggctcccagatatcactggagaaatagtgatgacgcagtctaccaaccactctgtctgtgtctccgaggggacagacgcccaccctctcctgcagggccagtcagagtgttagcagcaacgtagccgtaggtaccagacaaggaaagttcggaccagggcctcccgagggtcctccgtcattcgtttggtcgtcgtccgacgtacgggcctcgtggtcgtacccnggtcaggttcaggtggcaggtcggctcgtagggactagtacgttcactctaccacactcagacagccctgctagtctagtaagttgtttacgtattagtttattacgtagtacgtagtactaattaataatacgtcgtacggtccgtcgtacgttcgtacgttacgtttcggaccggtagggaccgtaagtcgtaggacgtatacggtaaacg

SEQ ID NO: 242201 - DNA, 687 bp, Homo sapiens
  misc_feature: GYAE6OF01A2PIC.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtcgtctccgaggggacagacgcccaccctctcctgcagggccagtcagtagttgtagcagactaacgttagcctaggtaccagacaagtaaagttcggccaggcctacccgaggccttccgtacagtttcgtttgggtcgttggtccctacggtacggggccgtcgttcgggttcgtccccgtaaggttcgtaacggtttcacgggttgggaccgtaggtcgggtccttcggttacgggggaactacgggtacgtttccaaccgtttccgtaccaaccgtagtaccgtaacgcctacggtccgttcgaaccgtacggttaccgtaaggtaaccgtttagttttacggtacctttaaggtttttaacttacgtttcgtaacctaagtaactaacttaattaacgtagttcgttacggtacctacgttagttcggtacgtttcgtttacgggccggtaacgggacctaggcggtaggactaacgtacgaacgtacgtggtcgctcg

SEQ ID NO: 242202 - DNA, 751 bp, Homo sapiens
  misc_feature: GYAE6OF01D1VEL.35.85.H08.1.454.CMB.1.raw
  modified_base (233)..(233): a, c, t, g, unknown or other
  misc_feature (233)..(233): n is a, c, g, or t
tcagtacagatcgtcacgaccggtgctcgatttagtatcactcagtcgcgggggaggaactgctcagttaggacccagacggaaccatggaagccccagcgcagcttctcttcctcctgttattctggctcccagatatcactggagaaatagtgatgacgcagtctccaaccactctgtctgtcgtctccgagggacagacgcccaccctctcctgcgacgggccagtcagngtgtagcacgactaacttgccgtaggtaaccagacgtaaggtaaacgttcggaccgtaggcctacccgaggtcctcctactacgttcgtttggtcgtcgtccgacgtacgggcctcgtcggtctccgtagtcgtaggttaccgaggtcggacgtaggtcggtccgttcggtacgggaacctaggttaaccgtttccaaccttccgtaccctacctaacgtaccgaaccgccgtaaccggtcctacggtacgttaacggttacgttaacggtaaagtttacgttttcgtaacgttttaagtttttacgttaaccgttagtacctaagttaactaaagtttaattaaacggttacggttaccgttaccgggtacccgtttacgggtacgttccgttacgtttaccgggtttaccgggaacccgggtaacggggaaccctaagggtacggttaaacggaaccgttaactaaaccggtaaaaccggttcggttagggtaccggtacgtacccggtaacccgg

SEQ ID NO: 242203 - DNA, 618 bp, Homo sapiens
  misc_feature: GYAE6OF01AKCAO.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcgacgggccagtcagtagtgtagcagctaacttagcctggtaccagcaggaaagttcggaccaggtcctcccgaggtcctcctctagttccgtttgggtgtcgtccgacggtacgggtcccgtcgtgggtcgtcccgagtcgtaggttcgaggtcgggcgtaggttcggcgttcggtgggactaggtacgttcgacctccgtacacctatcgacgctacgtcctcgctagtcgtagtaagttagtttgacgttagtttacttacgtgttacctagtaactaattaacgtaagttacgtcgtacggtcctacggttgtcgtacgttacggtttccggaccggtacggggtaccacggttcgtacggtagtacgtaaccgaaacggtacgtggtagcgtaccgg

SEQ ID NO: 242204 - DNA, 559 bp, Homo sapiens
  misc_feature: GYAE6OF01B3XK5.35.85.H08.1.454.CMB.1.raw
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgttagcagcaacttagcctggtaccagcagaaagttggccaggctcccaggctcctnatctttggtgtgtcccacgtagggcccgtntgggtcgtcccagtcgaggttcaggtggcagtggctcgtggacagtacgttcactctccaccatcagcacgcctgcgagtctaggtaattatttgacttagttttacttacgtcgtacagtactaattaagtaactagtcgtcgtcccgtacgtagttcgtcttaccgtttgggacccgtacggggtaacccaggtcgaggtaacgaacgtacgaaacggtaacgtggtcggcgtacgg

SEQ ID NO: 242205 - DNA, 741 bp, Homo sapiens
  misc_feature: GYAE6OF01BHVMY.35.85.H08.1.454.CMB.1.raw
tcagtacagatcgtcacgaccggtgctcgatttagtatcactcagtcgcgggggaggaactgctcagttaggatccagacggaaccatggaagccccagcgcagcttctcttcctcctgctattctggctcccagatatcactggagaaatagtgatgacgcagtctccaaccactctgtctgtgtcctcgaggggacagacgccaccctctcctgcgacggccagtcagagtgttagcagacaacttagccgtaggtaccagacgaagaaacggttcggaccgacggtcctacccgacggtcctcctctacgttcggtttgggtcgtcgtccgtaacggtacgggcccgtcgttcgggtccgttacccgaggttccggtaacgggtttcaaggggttcggtacgtacgggttcggtaccgtcggtacgggaaccgtaggttacggttacctaccgtccctacgacctaacgtccgacgtacgaccgtccctgacgttaacgtccgtaaggtaagtttacggttttacgtacgtttaacgttttagtttacgtcgtactaaggtacttaaacgttaaagttaagttaccgtacggttacccgtaccgttaccggtaaggtttaccgtaccgtttacgggtttacccggaaccgggtaccggggtaacctaagggtcccggttaagggtaacggtaaacccgtaacggtaaaccggttaacgttgggtaacccggtacccgg

SEQ ID NO: 242206 - DNA, 726 bp, Homo sapiens
  misc_feature: GYAE6OF01BC4XL.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggactcccagatatcactggagaaatagtgatgacgcagtctccaacactctgtctgtgtctccgaggggacaggacgcccaccctctcctgcgagggccagtcagagtgtagcagactaacttgcctggtaccagcagaagttcgccagcctaccaggcctacctctattcgtttggtcgtcgtaccgtacgtacgggccgtcgttgggtcgtcccgagtccgtaggttacacggttggacgtaggtcggcgttacggtgggaccgtaggtacgtttcacgttcctacgacctactacgacgtacgtacgtccgtacgtacgtacgtacgtaggtaacgttacgttttacggtaacgtttaacggttttaacgttaccgttacgtaaccgtaagtaaccgtaaacgtttaacgttaacgttaacggttaccgttaccggttacccgttaccggttacggttaccggttaccgtttaccggttttacgggacccggttaaacggggtaacccgtaacgggttaccggttaaacgggtaacgtaaaccggttaaccgtaaaaccgggttaacgttaccgggttacgggacccgttaaccggg

SEQ ID NO: 242207 - DNA, 596 bp, Homo sapiens
  misc_feature: GYAE6OF01EDQM2.35.85.H08.1.454.CMB.1.raw
  modified_base (328)..(328): a, c, t, g, unknown or other
  misc_feature (328)..(328): n is a, c, g, or t
  modified_base (386)..(386): a, c, t, g, unknown or other
  misc_feature (386)..(386): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtcctccaaccactctgtctgtgtctccgaggggacagacgcccaccctctcctgcgagggccagtcagagtgtagcagcaacttagcctggtaccagcaaggaaagttggccaggctcccgaggtctcctcattcgtttgggtgtcgtccacgtaggggccgngttcggtcgtccctagtcgtaggttcgaggtggacaggtggcttcggtggggacaggngttccacgtcctacaccatcacgcagcctgcagtcgtagtaatagttttgctagtttacttacgttgtcgtaagactaaattaataagtagtacgtcggtacccttaccggtagttacgtccgtacggttttcggaccggtaacggggtaacctaaggtccgtagggtacgtaacgtacgaaaaccgtaaggttcgtcgggtcgtaccgg

SEQ ID NO: 242208 - DNA, 727 bp, Homo sapiens
  misc_feature: GYAE6OF01A585B.35.85.H08.1.454.CMB.1.raw
  modified_base (177)..(177): a, c, t, g, unknown or other
  misc_feature (177)..(177): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctccagatatcactgggagaaatagtgactggacgcagtctccaaccnctctgtctgtgtctaccgaggggacaggagcccaccctctccgtgcgagggccagtcagtcgtgtacgcagctaactgcctggtaccagcaagtaagttcgcacggctaccgnggtcctcncgtatcgttggtcgtctcacggtcgggcgtcgttggtccgtccgagtccgtagggtttacgaggttcgggactggtcggtccgttacgtacggggacctaggtacgtttccgaccgttctacccaacgtcgtacgacgtccgtacgtccgttcgacgttacgttacgtaagggtaagtttacgtttacggtaccggtttaatttaaccggtttcgttaccgttaagggtaactaaccggtttaaattaaaccgtttaacgtacggttaaccggttcggtaaccccggtacggtttaacggtccgttaaccgtttacgggtttacccggaccgggtaaccgggggtaacccttaacggggtacgttaccgggtaacttaaacggtacccgttaaaacggtacgttacgggtccggggtacttaacccggg

SEQ ID NO: 242209 - DNA, 822 bp, Homo sapiens
  misc_feature: GYAE6OF01B51II.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcgagggccagtcagagtgttagcagcaacttagcctggtaccagcaagaagttcggccaggcctcccgaggctccgtctagttcgtttgggtgtcgtacccgacgtacggggcccgtcgttgggtcgtccccgaggttccgtacgggtttcgaagggttcgggacgtacgggttcgggtccgttcggtacgggggaacctaggttaaccggtttccgaaccgtttccgttacccaacccgtacgttacccgaacggtaccgaacggtccccgttcggtaccgtacgggttaccgtaaggttaaacggtttacgtttttacggtaacgttttaaacggtttttaacgttttaccgtttacggttaccgttaacggtaaccttaaaagtttaaacgttaaacgtttaacggtaccggtttaccgggtaccccgttacccgggttaacggtttccggtaccgttttaccggtttttaccgggggaaccccggtaaaccgggggggttaaaccctaaacgggttccgggttaacggggtaaacgttaaaccgttaaacccggtaaaaaccgggttaacggtttaccggggttaccggtcccggttaacccgg

SEQ ID NO: 242210 - DNA, 787 bp, Homo sapiens
  misc_feature: GYAE6OF01D9I12.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcgacgggccagtcagtagtgttagcagactaacgttagccgtaggtaaccagacaaggtaaacgttcggccaacggcctacccgacggtcctcctctagttcgtttggtcgtcgtaccgtacggtacgggccgtcgtcgggtcgtcccgaggtcgtaggttcgaggtcggacgtaggtcggtcttcgggtagggactaggtacgttccaaccgttcctaccgacctacgtaccgtaacgaccgtaccggtcccgttacgaccgtaacggttacgtaacgggttaaacgttttacgtttttacggtaacgttttaacggtttttaactttacccggttagttaaccgtaacgggtaaaccttaaaagtttaaacgttaaacggttaccgggttaccgttacccggggttaccccgtttaccggttaacggtttccgttaacccggtttaccgggttttaccggggaaccccgggtaaacgggggtaacccgtaagggttccggtaagggtaacgtaaaccggtaaaccggtaaaaacccggtacgtttacggggtcggtccgttaaccggg

SEQ ID NO: 242211 - DNA, 651 bp, Homo sapiens
  misc_feature: GYAE6OF01BPYT5.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgtagcagctaacttagcctggtaccagcaagtaaagttggccaggcctcccgaggtcctcctctacttccgtttgggtcgttcgtaccgacggtacggggcccgtcgtgggtcgtcccaggtcctaggttcaggtggctaggtcggctcgtgggacctagggtacgttccactccgtaccaaccgtactccgacgtccgtacgtcccgtgaccgtagttaccgtagtaacgttattttcggatttagtttactacgttgtacagtactaagtaataacgtagtacgttcggtccgtacgtagttcgaccgtttacggtttaccgggaccggtaacggggtaaccctaagggtccgtacggggtaacctaaccgtaaccggtaaaaccggtaaccgtttcgggtacggtcgttaccccggg

SEQ ID NO: 242212 - DNA, 677 bp, Homo sapiens
  misc_feature: GYAE6OF01BRQ3E.35.85.H08.1.454.CMB.1.raw
  modified_base (180)..(180): a, c, t, g, unknown or other
  misc_feature (180)..(180): n is a, c, g, or t
  modified_base (231)..(231): a, c, t, g, unknown or other
  misc_feature (231)..(231): n is a, c, g, or t
  modified_base (557)..(557): a, c, t, g, unknown or other
  misc_feature (557)..(557): n is a, c, g, or t
  modified_base (648)..(648): a, c, t, g, unknown or other
  misc_feature (648)..(648): n is a, c, g, or t
  modified_base (665)..(665): a, c, t, g, unknown or other
  misc_feature (665)..(665): n is a, c, g, or t
  modified_base (672)..(672): a, c, t, g, unknown or other
  misc_feature (672)..(672): n is a, c, g, or t
tcagtacagatcgtcacgaccggtgctcgatttagtatcactcagtcggcgggggaggaactgctcagttaggacccagacggaaccatggaacgccccagcgcagcttctcttcctcctgctattctggctccagatactcacgtggaagaaatagtgatgacgcagtcctacccaacnctctgtctgtcgtcgtaccggaggggtacagaccgccctaccctcgtccgngcgacgggcctagtcagtgttagtagcagtactaacgttcgccgtaggaccaggacgtaaagtaacggtcggaccgtacggtccctacccggagtccctacccgtcgtacgtttccggtttggtcgtaccgtcctaacgggtccgggtccgtcgttacgggtcctaccgtaggtcggtacggttcgagggtcggattacggtcggtctcgggaggtaaccaggttcgtaacctcctcgtaccactctacggacgaccgtcgcctcggacgttaggtaccgtagtaagtttcgtttagtactttaaggtttaactcgtatacgtaanaacttaaattacgtacgtatccggtacgtccttacggatttccgagtttacccggttggaacccgggtaacggactagggtacgaggtaanaacgtaccgaagtacgngggtacnctacg

SEQ ID NO: 242213 - DNA, 670 bp, Homo sapiens
  misc_feature: GYAE6OF01EE82M.35.85.H08.1.454.CMB.1.raw
  modified_base (322)..(322): a, c, t, g, unknown or other
  misc_feature (322)..(322): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctcgaggggacagacgcccaccctctcctgcaggccagtcagtagtgtagcagcaacttgcctggaccagcaagtaagtgccaggcctcccgaggtcctccgtctattcgtttggtgtcgtccacgtagggcccgngttggtcgtcccaggtcgtaggttcgaggtcggactgggtcggtcgtcggtggacgtagtacgttccactcctacacctatcgacgccgagtccctagcgtagttacgtagtaagttgttttacgactttagtttttaactttcgttacgttatacgtactttaattaagtacgttaaccgttaacggttccgggtaccccgttccgggttagggtaacccggtttaccgggacccggtaaacggggtaaccggtaaaggggttaacccgggtaaaccggttaaccccgtaaaaccggtaccggttagggttaccggtaccgtaggacccttacccgtaagttcccgg

SEQ ID NO: 242214 - DNA, 827 bp, Homo sapiens
  misc_feature: GYAE6OF01AGDOA.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtcgtctccgaggggacagacgcccacccgtctccgtgccgacgggccagtcagtagtgtagcagactaacttcgaccgtcggtaccagacgaaggtaaacggttcggaccgaacggccgtaccccgacggtccctccttactacttcgttcgggttgtccgttaccgacggtacggggtccgtcgttcgggtcctcccggtaacgtccgtaggttccagggtcggtcgtacggttggtcgtcgttacggggaactacggtcgtttaccaccgttaccgtaccgtaaccacgtaccgacggtaccgaccgtccgttacggtacgtaacggttacggtttaagtaacggttttacgttttaccgggtacctttttaacggtttttaacctttacggttaaccggtacgttaaacggtaacctttaaagttaaaccggttaacgttacgggtttaccccggtttaccgggtaaccccgtttaccgggtttacggtttccgggttaacctttttaccggggttaaccccggggacgggttaaccccggggtaaacccggttaacgggtccggttaaacgggtaaacggaaccgtttaaaccccggaaacggttaacgggttaccgggtttcggtaacccgtaaccccggg

SEQ ID NO: 242215 - DNA, 664 bp, Homo sapiens
  misc_feature: GYAE6OF01EM3XC.35.85.H08.1.454.CMB.1.raw
  modified_base (173)..(173): a, c, t, g, unknown or other
  misc_feature (173)..(173): n is a, c, g, or t
  modified_base (230)..(230): a, c, t, g, unknown or other
  misc_feature (230)..(230): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccntctgtctgtgtctccgaggggacagacgcccacctctcctgcgacgggccagtcagngtgtagcacgacaacgttgccgtaggtaccagacaagtaagtcggcaggcctccgaggtctccgtactacgtttcgtttggtcgtcgtccacggtacggccgtcgtcggtcgtcctaggtccgtaggttcagggtcgacgtggtcggtctggcgggaactaggtacgtttccacgttcctacaacctacgtacgacgctaacgtcgacgtacgtaaccggttgtaacgttaaggtttcgtttaacgtccttttaaaggttttacttaccgtagtaccgtaagaacgtttaattaacgttaagtacgtccggttccggttaccctacgggttagttcccgttaccgtttaccggttacgggacccggtaaccgggaacgtaggtcggtaaacggacgtaactaaaccgggaacttagggtcgtggtcctaaccgg

SEQ ID NO: 242216 - DNA, 738 bp, Homo sapiens
  misc_feature: GYAE6OF01DC6S2.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgcttattctggcctcccagatatcactggagaaatagtgatgacgcagtcctaccaaccactctgtctgtgtcctccgaggggacaggacgcccaccctctcctgccgagggccagtcagagttgtagcagcctaacttagccgtagtaccagcgaagtaacgtcggccgacggtcctccggacggtcctccctgtacgtttcgtttggtcgtcgtccgacggtacgggccgtcgttcgggtccgtaccgagtacgtacgggttcagggtcggacgtaggttcggtacctcgggtagggactaggtccttaccgtaccttaccgtaccaccgtacgtaccgacgtaccgacggtcgttacgacgttacggttacgtaacgtttaagtttagtttccgttaacgtttacgttttttaacttacgttacggttaacctaacggtaacttaaacgttaagttaacggttcgttacccggtttagtaccccggttttagtaccggtttacgttacccgttacgggttttacccgggaaacggtaccgggtaaccgttaggtacgggttaacgacggttaaactaaaccgggtaacggttaacgtcgggttaccgccggttaaccg

SEQ ID NO: 242217 - DNA, 618 bp, Homo sapiens
  misc_feature: GYAE6OF01BA05U.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgtagcagcaacttagcctaggtaccagacaagaaagttggccaggcctcccgaggcctcctcattcgtttggtgttcgtacccacggttacgggcccgtcgttcgggttcgtccccgaggttccaacggggtttccaagggttcgggaccgtagggttcgggccgttccggtagggggaactaggtacgtttccacgttccgtaccacctatcgacgccacgtcctgacgtagtcgtagaagttatttgacgttagttttacttactgtacagtactaattaataagttacgtcttcggtaccttcggagttcgtacgttacgtttacgggaccgacgggtacaaggtcgtaggagtacgtaacgaaacgtactggtcggctacgg

SEQ ID NO: 242218 - DNA, 710 bp, Homo sapiens
  misc_feature: GYAE6OF01C64BW.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatgtgatgacgcagtcctaccaaccactctgtctgtgtcctccgaaggggacagacgccctaccctctccgtgaccgaggggaccaggtcaggagttgtagcaagctaacttacgcctaggtaccagacaagtaacgttcggccgtaggcctacccgaggtcctacctctactttcgtttcggtcgtcggtccaacggttacgggcccgtcgtgggttccgtacccgaggtcgtaacgggtttccaaggttcgggaccgaggttcgggtcgttaccggtaggggactaaggtacgttccaacgttccgtaccaaccgtataccgacgacgtaacgtcccgtacgtacgtaacggttctaaggtaacgtttagttttcgaacctttagttttaacttacgtacgtactaacgtactaaattataaacgtacggtcgttacggtcctaccggtagttaccgtcgttaccggtttacgggacccggtaacggggtacctaacggtcggtaaggtaaccggaaacgttaaccgaaaacggtaacgtttcggtcggtccgtaacgg

SEQ ID NO: 242219 - DNA, 268 bp, Homo sapiens
  misc_feature: GYAE6OF01BGA8G.35.85.H08.1.454.CMB.1.raw
  modified_base (186)..(186): a, c, t, g, unknown or other
  misc_feature (186)..(186): n is a, c, g, or t
  modified_base (218)..(218): a, c, t, g, unknown or other
  misc_feature (218)..(218): n is a, c, g, or t
  modified_base (220)..(223): a, c, t, g, unknown or other
  misc_feature (220)..(223): n is a, c, g, or t
  modified_base (225)..(225): a, c, t, g, unknown or other
  misc_feature (225)..(225): n is a, c, g, or t
  modified_base (227)..(227): a, c, t, g, unknown or other
  misc_feature (227)..(227): n is a, c, g, or t
  modified_base (229)..(268): a, c, t, g, unknown or other
  misc_feature (229)..(268): n is a, c, g, or t
tcagtacagatcgtcacgaccggtgctcgattttagtatcactcagtcgcgggggagaaactgctcagttaggacccaagaacggaacccagtggaagccccagcgcagcttctcttcctcctgctattctggcttcccaggaactgtggctgcaccatctgtcttcatcttccgcatctgaacgntctgtactgagcgggctggcaaggcgcatagnannnngntnannnnnnnnnnnnnnnnnnnnnnnnnnnnnnnnnnnnnnnn

SEQ ID NO: 242220 - DNA, 680 bp, Homo sapiens
  misc_feature: GYAE6OF01ASQOO.35.85.H08.1.454.CMB.1.raw
  modified_base (175)..(175): a, c, t, g, unknown or other
  misc_feature (175)..(175): n is a, c, g, or t
tcagtacagatcgtcacgaccggtgctcgatttagtatcactcagtcggcgggggaggaactgctcagttaggacccagacggaaccatggaacgccccagcgcagcttctcttcctcctgccttattctggctccagatatcactggagaaatgtgatgacgcagtctccaacntctgtctgtgctccgaggggacagagcccacccgtctccgtgaccagggccagtcaggagttgtagcagactaacgttgccgtaggtaccacgacgagtaaacgttcggacccgagggtcctacccgaggtcctaccccgtcgtagttccgtttgggtacggttcggtacccgtacggtttaccgggccgtcgttcgggtccgttcccgaggttccctaggtttccgaggttcgggactggtcgtcttcggtgggaacctagttacttacgtaccgtcttaccgaaccgacgtacgtacgccgacgtccgtcgaccgtagtccgtaggtaaacttagtttcggattacgttttacgttacgtgtacctagtacctaagttaactaagttacgcgttcggtcccgtacggttacgttcgtacgttaccgtttacgggaccggtacgggtacctacggtccgtaggtaccgacgtttaccgaaacggtacgtcgtcggtcgtaccgg

SEQ ID NO: 242221 - DNA, 698 bp, Homo sapiens
  misc_feature: GYAE6OF01BLHXU.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgcccaccctctcctgcacgggccagtcagagttgtagcagactaacttagccctggtaccagcaggaaagttcggaccaggcctcccgaggtcctcctctagttcgtttggtcgtcgtccacggtacgggccgcgttcgggtcgtcccgagttccgacgggttcaggtcgggctacggtggtcgtcggtggggaccaggtacggtttccaccttccgtaccaaccctacgtaccgacggtaccgacggtcccgtaggacctacgggttacgtaggtaagtttacgttttcggactttaggttttacttacgttgtaccaaggtactaaaattaagtaacgttacggtacgttccggaaccgttcccggttaaaggttccggttaacgttaccggttttacggggacccgtaacggggggttaacccaacgggttcgtaccggggtaagtaaacgtaacccggaaaacggttaccggtagggttccggaccgttaccgg

SEQ ID NO: 242222 - DNA, 636 bp, Homo sapiens
  misc_feature: GYAE6OF01DFKDC.35.85.H08.1.454.CMB.1.raw
  modified_base (202)..(202): a, c, t, g, unknown or other
  misc_feature (202)..(202): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
tcagtacagatcgtcacgaccggtgctcgatttagtatcactcagtcgcgggggagagctctgggggaggaactgctcagttaggacccagacggaaccatggaagccccagcgcagcttctcttcctcctgctattctggctcccagatatcactggagaaatagtgatgacgcagtctaccaaccactctgtctgtgtcnccgaggggacaggactccaccctcgtcctaggccgagggccagtccagagttgttagcagcaacttagcctaggtaccagacaaggaagttggccaggcctccaggtcctcctnattctttggntcgacctactagggccgtntggtctacccgagtcgaggttcaaggtggctagtcggtctcggtgggactagtagttctactctaccgaccatacgacgtacacgcctacgctaacgttcgtagtaacgttattttagacgttagttttattacgttagtacgtacgtactaaagttaataactacgtacgttacggacccgttaccggtacgtttcggaccgtttaacggttttcgggaacccggtaacgggggtaaaccctaaacggttaacgggaagttaacgtaaaccgtaaaacggttaaaccggg

SEQ ID NO: 242223 - DNA, 771 bp, Homo sapiens
  misc_feature: GYAE6OF01EPOIE.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgtagcagcaacttagcctggtaccagcagaagttggccaggctcccaggctcctcagttcgtttggtgtcgtcccacggtacgggcccgtcgttggtcgtcccaggttccgaagggtttccgaaggttcggctaggtcggcgttcgtggggactaggtacgtttccaacgttcttaccaacccgtagttaccgaacgccgtaacgtcccgtcgacgtaacggttcgtaggtaacgtttacgggttaacgttttttcggacgttttaacggttttaactttaaccgttacgtttacgaagttaccttaacgttttaagttacgttaaacgtttaaaccggttccgggttaccccggttacccgggttacgggttaacccgggtttaacccggggtaacccggtaaaccgggggtaaacccggttaaagggggttaaccgggttaaaacccgggttaacccccgtaaaaaccggggttaaaccggtttaccggggttaacggtacccggttaaccggttaccccgtaacccggtttaacccgg

SEQ ID NO: 242224 - DNA, 645 bp, Homo sapiens
  misc_feature: GYAE6OF01DPOJ7.35.85.H08.1.454.CMB.1.raw
tcagtacagatcgtcacgaccggtgctcgatttagtatcactcagtcggcgggggaggaactgctcagttaggaccagacggaaccatggaagccccagcgcagcttctcttcctcctcgctatctggctcccagatatcactggagaaatagtgatgacgcagtctccaaccactctgtctgtgtctccgaggggaccagacgccaccctctcctgctagggccaggtcagagtgttagcagacaacttgcctaggtaccagcaagaaagtcggccaggcctcccaggcctcctcattcgtttggtgtcgtccgacgtacgggccgtcgtcggtcgtaccccgagtccgaggttcaggtggacaggttcggcttcgtgggacaggtacgttccgacctcgtacacctatcgagcgacgccgtgacgacgtacgtagtaacgttagtttacgacttagtttattacgtacgttcgtacggtaactaattaagtaagttacggtacgttacggtacccgttaccggtaggttccgtacgttaccgtttacggggacccgtaaacgggggtaaccctaagggtccggttaagggtacgaaacgttaacccgaaaacggtaccgttacggtccgggtacgtaacccgg

SEQ ID NO: 242225 - DNA, 614 bp, Homo sapiens
  misc_feature: GYAE6OF01BWTFQ.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggagaaatagtgatgacgcagtctccaaccactctgtctgtgtctccgaggggacagacgcccaccctctcctgcgagggccagtcagagtgttagcagacaacttagcctggtaccagacaaggtaaagttcggccaggcctccccgaggccttcctcgtacttcgtttggtcgtcgtcctacgtacgggcccgtcgttgggtcgtccccaggtccgtaggttcgaggtcggcgtaggtcggccgttcggtaggggactaggtacgttcaccttctaccactactcgacgccgacgcctgacgtagtcgtagtaagttgtttacgacgttagtttactttacgttgtacagtactaataataagtcgtcgttcggtcctaccgtagttcgtcgttacggtttcggaccggtacgggtacctaaggtcgtaggaacgtacgtaaccgaaacggtacgtggtcggtcgtacg

SEQ ID NO: 242226 - DNA, 788 bp, Homo sapiens
  misc_feature: GYAE6OF01B8B0A.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccacctctcctgccgaggccagtcgaggtagtagttacgcagctaacttagccctacggtaccagacgaaggtaaaacggttcggaccctaacgggccctacccgaaggtcccttaccgtactacgtttcgtttgggtacgttcgtcccgacgtacggggtcccgtcgttcggtccgtcccgtacggtacgtacgggtttcagggttcggtacgtacgggtcggtccgttcggtacggggtaacgtacgtacgtttccgaccgttcctacgacctactaccgtacgcgtacggtccgttcgaccgtaggttacgtaacggttaacgtttacgtttttaccgacgtttaacgttttacgtttaacgttcggttaacgtaacgtaacttaaaacgttaacgttaacgttacggtacccggttccgggttacccgttaccggttaaacggtttcgtttaccgggttaaccggttttaccggggaacccggtaaccgggggtacccgtaacgggtcggttaccgggaacgttaaccgttaaacccgaaacgggtaaaccggtttgggttaacccggtcggttaacccgg

SEQ ID NO: 242227 - DNA, 838 bp, Homo sapiens
  misc_feature: GYAE6OF01BNNCZ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcacgtggaagtaaatagtgatgacgcagtcctaccaaccactctgtctgtgtctcggagggcagacgcccacctctcctgccgaggccagtcaggtagttgtagcagactaacgttagccgtagtaaccgagacgtaaagggtaaacggttggacccgaacgggtccctaaccccggtacgggtaccccttaccccgtacttacgtttccggttttacgggttcggttcccggtaacccgtaccgggggtaaccgggttccccggtggtttaacgggtcccgttaccccgtaaggtttccggtaacgggtttcgaagggttcgggcgtacggggttcgttccggtacgggttacggggactagggttaaccgttcctacgtaccctaccaccgtaacgaccgtacgtaccgtaccgtccgtacgtaccgtacggttacgttaacggttaagtttacgttttaacgttacgtttaacgtttttacgtttacggtttacttacgtaacggtaattaaacgttaacgttaacgttacgtaaccggttccggttaacccgttaccggttaccgttcggttaccgtttaccgggtttaccgggaccgggttaacgggtaaacccgggacggttaacggtacggtaaacgaacggttaaccggtaaaccggttaacggttcgggtaaaccggtcggtaacccgg

SEQ ID NO: 242228 - DNA, 697 bp, Homo sapiens
  misc_feature: GYAE6OF01ENE2U.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgccaggccagtcagagtgtagcagcaacttagcctggtaccagacaagtaaagttcggccaggcctcccgaggtcctcctcagttccgtttggtgttcgtccacgtacgggccgcgttgggtcgtccccgtagtccgagggtttcaggtcggctaggtcggacttcgtaggggaactacggtacgttccgaaccgttcctaccacctagtaccgacgccacgtcccgtgccgtaggtaccgtaggtaacgttagttttcgacgtttaagttttacgttaacgtttcgtacgtaacgtacttaaacttaagttaaacgtaacggttccgttacggtacccgttaccggttaacgttcgttaccggttaccgttttaccgggaccggttaaacgggggtacccgtaacgggtccggtaacgggtaaacgtaaaccgttaaacggaaaaccggttaaccggttacgggtacggtccgttaaccgg

SEQ ID NO: 242229 - DNA, 538 bp, Homo sapiens
  misc_feature: GYAE6OF01EMRTL.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccacgtagggccgctggtcgtcccagtcaggttcagtggcagtggctcgtggggacaggacgttcacgtctcaccatcagcagcctgactagtctggaatatttgctagtttatctgtcagactaatataatacgcttcggccttaccgtgttcgtaccttacgtttcggacccgtaaggggaccctaaggtcgttaggacgtaacgtaccgaaaacggtaactacggtcggcgtaccgg

SEQ ID NO: 242230 - DNA, 710 bp, Homo sapiens
  misc_feature: GYAE6OF01ETPJL.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggagaaatagtgatgacgcagtctccaaccactctgtctgtcgtcctccgaggggacagcgcccaccctctccgtgcgacgggccagtcaggtagtgttcgcagctaacgttagcccgttaggtaacccaggacctaaagggtaaacggttcgggacccgtagggacccttaccccggacggttccctaccgtactacgtttcgtttaggggtcgttacgtacccgtacggtaccggggcctcggttaggtccgtaccccgtacggttcgtacggggttccgaaggtcgggacgttaagggttcgggtcctcgggtacgggtaacgtacggtacggtttccaccttccgtaccgaacctagtccacggccacggtacccgtgaacgttacgtacgtacgtaagttactttcgacgtttaagtttctacgtgtacagtaacctaagttaacagttagtcgtccggtacgtaccggtagttcggtaccttcgggttcgaccgggtacggaccgacggtacgtagggaactacgtaaaccgaaacggttagtcgggtcgccgttaaccgg

SEQ ID NO: 242231 - DNA, 705 bp, Homo sapiens
  misc_feature: GYAE6OF01EIC19.35.85.H08.1.454.CMB.1.raw
  modified_base (147)..(147): a, c, t, g, unknown or other
  misc_feature (147)..(147): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggcctccagatatcacgtgganaaatgtgatgacgcagtcctaccaacctactctgtctgtcgtcgtccgaggggacagacgcccaccctctcctgcgacgggccagtcaagtgtgtacgcacgtacctaacttcgccgtacggtaaccgagtaccgaaaggtaacggttcggaccgtacggtaccctcccggaacggtcccttcctacgttacgttcggttttggcgttccggtaaccgtacgggtacggccgttcggttcgggtccgtacccgtaggttccgtaaggttccgacggttcggacgttacggtcggtacgttacggtacgggatacggttcgttcaacgttcccaactacccgtagtccgaacgtcgacgtccgtcgtacgtaacgttcgtaaggttacgtttagtttcgtacgtttaagttacgtctacgtacaacgtaattaatagtacgtacgtcgtccgtacgtacggttactcgtaccgtttacggtaccggacggttaacggaccgtacggtaggacgtaacgttaaccgaacgttaacggtacgttgggttaccgcgtaaccg

SEQ ID NO: 242232 - DNA, 605 bp, Homo sapiens
  misc_feature: GYAE6OF01EGCTC.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgtagcagcaacttagcctaggtaccagcaagaaaggttgaccaggcctcccgaggcctcctctattcgttttggtgtcgtccacgtacgggccgtcgtgggtcgtcccaggtcctagggttcaggtcggcaggtcggctcgtgggacagtagttcactcacaccatcagacacgccctagcgtacgtcgtagtaacgttattttggacttagttttattacgtcgtacagtactaaattataaacgttagtccgtacggtcccgttacggtacggtttacgtaccgttaccgttttcgggaccggtaacgggggtacctaaggtcgtaaggagtaaccgttaaccgaaacgtaacgttggtaggtcgtaccgg

SEQ ID NO: 242233 - DNA, 795 bp, Homo sapiens
  misc_feature: GYAE6OF01BJGS9.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagctaacttacgcctaggtaccagtaccaagtaaacgttcggaccctaggccttacccgaggcccttaccccgtatacgttcgttttgggcgttacggtacccaacggttacggggccccggtcgttcggggtcgttccccgaaggttccgtaaggggtttcaacggttcgggactagggttcggtcgttcgtacggggaactagggtacgtttccaaccgttccgtaccgtaaccgtacttaccgaaccgacgtaaccggtccccgttacggtacgtaaccggtttccgttaaggtaaacgggtttacgttttttaccggaccgttttaaacgggtttttaacttttaaccccggtttgggtttaacctaacgggttaacccttaaaagtttaacgttaaacggttaaccggttacccgtttaccgggtaaccctttacccggtaacggtttccggtaaccgtttaccggttttccgggaccggtaacggggtaaccctaaacggtcgttacggaagttaactaaccggaaacgtagttacggttggaccttacgg

SEQ ID NO: 242234 - DNA, 619 bp, Homo sapiens
  misc_feature: GYAE6OF01BB354.35.85.H08.1.454.CMB.1.raw
  modified_base (405)..(405): a, c, t, g, unknown or other
  misc_feature (405)..(405): n is a, c, g, or t
tcagtacagatcgtcacgaccggtgctcgatttagtatcactcagtcgcggggagagctctgggggaggaactgctcagttaggacccagacggaaccatggaagccccagcgcagcttctcttcctcctgctattctggcctcccagatatcactggaagaaatagtgatgacgcagtcctcccaaccactctcgtctgtgtctccgaggggacagacgcccaccctcctcctgcgacgggccagtcaggagtgttagcagctaactgcctgtaccagcagtaagtgccaggctcccgaggcctcctctattcgtttggtgtcgtccacgtacgggccgtcgtggtcgtcccgagtcgtaggtcaggtcggactggtggcttcggtagggacctagggcgttcnccttccaccgtacctactaccgacgcgaacgtcccgtgaccgtcggtacgtaggtaagttgttttacgacgttagtttgtaactttcgtagtaccgtagtacgtagttagttagggttacttccggtaccgttaccgtacggttttccgggaccgggacggggtaccgtcggggtaggtagtaccgtaacgtaaacggacgttggtacggtacg

SEQ ID NO: 242235 - DNA, 580 bp, Homo sapiens
  misc_feature: GYAE6OF01D061Z.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaaccatctgtctgtgtctccgaggggacaggagccaccctctcctgcagggccagtcagagtgttagcagcaaacttagcctaggtaccagcaagaaagttgaccaggcctccgaggctcctcattcgtttggtcgtcgtccctacgtagggccctcgttggtcgtccccagttcgaaggttcagttggctaggtcgctacgtgggacagagttcactctacaccatacagacagccgtgacagtcagaagtatttagactagtttacgttactgtcgagtactaatattaatagtcctaggcctaccgtagttcgtacttaccgtttacgggacccggtaaggggtaaccctacggtacgtagggtaacgtaacgtacgaaaacgtaccgttaggtcggccgttaacgg

SEQ ID NO: 242236 - DNA, 527 bp, Homo sapiens
  misc_feature: GYAE6OF01CPDCG.35.85.H08.1.454.CMB.1.raw
  modified_base (298)..(298): a, c, t, g, unknown or other
  misc_feature (298)..(298): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagtcaagaaagttggccaggctcccaggctcctcattctttggngtgtccagtacgggcctcgtcggtcgtccccaggtcagggtttcaggtggcaggtcgctcgtgggactagtacggttcactcgtacacatcagtcacgcctgcagtctgaagtatttgctagtttacttctgtcagtacaatataatagctggcctcgtagtgtactgtttcgaccgtagggtaccaaggtctagggaactacgtaacgaaacgataggtgtcgtacgg

SEQ ID NO: 242237 - DNA, 659 bp, Homo sapiens
  misc_feature: GYAE6OF01DKRBI.35.85.H08.1.454.CMB.1.raw
  modified_base (175)..(175): a, c, t, g, unknown or other
  misc_feature (175)..(175): n is a, c, g, or t
  modified_base (204)..(204): a, c, t, g, unknown or other
  misc_feature (204)..(204): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctaccaaccnctctgtctgtgtctccgaggggacagacncccaccttctccgtgcgacgggcagtcaggtagtgttagcagcaacttagcctggtaccagacaagtaaaggttcggaccacggtctacccgacggtcctccgtactagttcctttgggtcgtcgtcctacgtcgggtcctcgttcgggtcgaccccgtagtccgtaggttcgaggtggacgtagtcggtctcggngggtacngtacgttcactcgtacacatcgagctacgccttgctacgtacgtgaacgtttagtttcgacgttattttacgttacgttcgtagacgttaacgtaaattaagtaacgtagtcgttacgggcctaccgggttaagttccgtacgttaccggtttacggacccgggttaacggggaaccgtaacgggtccggtaacgggtaaccaacgttaaaccgaaaacggttaccgttacgggtacggtaccgttaaccgg

SEQ ID NO: 242238 - DNA, 1027 bp, Homo sapiens
  misc_feature: GYAE6OF01BX79A.35.85.H08.1.454.CMB.1.raw
  modified_base (181)..(181): a, c, t, g, unknown or other
  misc_feature (181)..(181): n is a, c, g, or t
tcagtacagatcgtcacgaccggtgctcgatttagtatcactcagtacgcggggaggaacggtgctcagttaggacccagacggaaccgatggaaggccccagcgcagcttctcttcctcctgctattctggctcccagatactcacgtaggagtaatgtgatgacgcagtctaccaaccncttcttgttctgtcgtacgtaccgaggggaccacgacgcccacctcgtccgcgacgacgggcctagttcgaggagttcggttacggcgagtacctaaacttacgaccgttacggtaccgagtacgtaacgtaacggttcggccctaacggtccttacccgtaggtccttccttacgttaacgtttccggttacgggtccggtaccgtacccgtaaccggttaccggggccgttcggtttccgggttaccgtaccccgtagggttacccggtagggggtttacgaacggggttcgggaacggttaccggtttccggtacccgtttacgggtaacggggtaaccctacgggtttaaccgtttacccgaacccgtttaccgttaaccccgtaaaccggttacggtacccggtaaaccggttccgttaacccgggtttacccgttacgggttaacccggttttaaacggttttaacccgggtaagggttttaaaccggtttttaccggtttttaacccgggtaaccggttttttaaaccgggttttttaaaccgtttacccgggtttaccgggtttaaacccggtaacggtttaaaaccggtttaaacccgttttaaacggttaaaaccggtttcccggggtttaaaccgggttaaccccggggttaacccgtttaaaccggggttaaacggttttcccgggttaaaccgtttaacccggggtttaaccggggaaacccgggttaaccggggggttaaacctacgggttaccgggtaaaccgggtaaacgtaaccgtttaaaacccgggtaacggttaaccgttacggggtccccgttaacgttacccgg

SEQ ID NO: 242239 - DNA, 847 bp, Homo sapiens
  misc_feature: GYAE6OF01EW1WP.35.85.H08.1.454.CMB.1.raw
  modified_base (232)..(232): a, c, t, g, unknown or other
  misc_feature (232)..(232): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtcgtctccgaggggacagacgccacccttctcctgcgagggccagtcagngtgtacgcagactaacttagccttaggaccagacgaagtaaacgttcggaccacggcctcccgacggtcctacctctacgttcgttttagggcgttaccgtcctacggtacgggccgtcggttcggtacctccggtacgtccgttaacggggtttcaacgggttcggaccgtaaggttcgggtaccgttccggtaggggaaccttaggacggttttaccaacccggtttcctaccgtaaccgtatcccgtaacggaccgtaccgttacccggtacgttaccggtaacgggtttaccgttaacgggtaaacgtttttacggttttccggtaacgtttttaaccggttttttaatccgggtttaaccgtttaaccgaggttaaaccttaaaagtttaaagttaacggttaccgggtttaccgttaacccgggtttccccggttaccgggttaaggttttcccgtttaaccggtttaaacccgggttttccggggggtaaaacccgggtaaccgggggtaaacccgttacggggttaccgtaaacgggggttaaccgttaaacgtaaaacccggttaaaccggtaaacgttttcggggaaccggttcgtaaccccggg

SEQ ID NO: 242240 - DNA, 759 bp, Homo sapiens
  misc_feature: GYAE6OF01DF7NM.35.85.H08.1.454.CMB.1.raw
  modified_base (177)..(177): a, c, t, g, unknown or other
  misc_feature (177)..(177): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtctaccaaaccnctctttcgtgtgtcctccgaggggacagacgcccaccctctcctgccagggccagtcagagtgtagcagctaactagcctggtaccagacaagtaaagttcggacctacggcctacccgaggtccctcctacgtacttcgtttgggtgtccgtaccgtaccggtgggcccgtgttcgggtcgtccccgacggtccgtaggttccgaggttcgggcgtagtcgggcttacgtaggggactaaggtcgtttccacttactccaacctagtaccgagccgacgtcctacggctacgtacgtaggtaacgtttagttttcgtacgtttaaagtttacttacccgttaggtaccgtaacgtaattaaaccgtttaataaacgtttaaccggtcgttaaccgggtccccgttaacggttacggttaccggtaacccgttttaccgggttttcccgggaacccggttaaaccgggggaaacccgttaaccgggtacggttaagggggaaaccgtttaaacggaaaacccggttaaaaccgggttaaccgttaccggggtttaacgggccccgttaccgggtaaaccccg

SEQ ID NO: 242241 - DNA, 680 bp, Homo sapiens
  misc_feature: GYAE6OF01DJK2F.35.85.H08.1.454.CMB.1.raw
  modified_base (214)..(214): a, c, t, g, unknown or other
  misc_feature (214)..(214): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
tcagtacagatcgtcacgaccggtgctcgatttagtatcactcaggtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccaccctctcngcagggccagtcagagtgtagcagacaacttagcctggaccagcaagtaagttggccaggcctccgaggccctcctnagttcctttggngtcgtctaacggtgggccgtcgtaggtcgtcccagtcgtaggttcaggttcggactaggttcggctacggtgggaacgtagtacgtttacaaccgtctaccaacctactacgaacgccgtaacggtccgtacgttacgaacggttaccgttaaggtaaacgttacgtttttacggacctttaaggtttttattaacccggttaggtacctaaggtaccttaaagttaacgttaacgttacggtacgttaccggtacccttacgggtacgtttacgtaccgtttaccgttttacgggaccggtaaacgggtacccgaaggtttccggaaggtaagtaacgtaacggaaacggtaacgtcggtcggtaccgttaaccgg

SEQ ID NO: 242242 - DNA, 728 bp, Homo sapiens
  misc_feature: GYAE6OF01CIN62.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatagtcactggagaaatagtgatgacgcagtctccaaccactctgtctgtgtctccgaggggacagacgcccaccctctcctgcagggccagtcagagtgtagcagcaacttagcctggtaccagcaagaagttcggccaggcctcccgaggcctccgtctattcgtttggtgtcgtcccgaacgttacggggccgtcgtcgggtcgtccccaggtcgtacggttcagggtggcgtacggtcggtccttcggtacggggactaggtaccgtttacgacccttaccgtccaaccctacgttaccgaaacggtcctaaccggtcccgtaggtaccgtacgttaccgtaaggtaacgtttacgtttttacgtaccgtttaaggtttttaactttaccgttacgttaacgtaacgtaaccgtttaaattaacgttaaagttacggtacgttacgggtacccgttaccggttaaggtttccgtacccgtttacggttttaccggaacccgggtaaccggggtaacccgtaacgggtaccgtacgggtaacgaaccgttaacgaaaaccggtacggtacggttcggtcgttaacccggg

SEQ ID NO: 242243 - DNA, 691 bp, Homo sapiens
  misc_feature: GYAE6OF01C54E4.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtcctccgaggggacagacgcccaccctctcctgcagggccagtcagtagtgttagcagctaacttacgcctggtaccagaccaaggtaaagttcggaccaggcctacccgaggtcctcctactattcgtttggtcgtcgtccgtaacggtcggggccgtcgtcggtcgtccccgagtccgtacggtttcgacggtcggcgtacggttcgggcttcggacgggtacagggtacgttcctaaccgttctaccaccgtacttccgacggtaccacggtcccgtcgtacgtacgtacgtaggtaacgttgttttacggacgtttaagttttactttacgtacgttacgtaagtaacttaattaagttaaacgtgtacccgttacgggtacccgtacggttaagttccgtaccgtttaacggtttccgggaacccgggtaacgggtaacccgtaggtccgtagggtaactaaccgttaacgaaaccgtacggttacggcggttacctacgg

SEQ ID NO: 242244 - DNA, 649 bp, Homo sapiens
  misc_feature: GYAE6OF01DH59X.35.85.H08.1.454.CMB.1.raw
  modified_base (215)..(215): a, c, t, g, unknown or other
  misc_feature (215)..(215): n is a, c, g, or t
  modified_base (306)..(306): a, c, t, g, unknown or other
  misc_feature (306)..(306): n is a, c, g, or t
  modified_base (330)..(330): a, c, t, g, unknown or other
  misc_feature (330)..(330): n is a, c, g, or t
  modified_base (378)..(378): a, c, t, g, unknown or other
  misc_feature (378)..(378): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtcgtctccgaggggacagacgcccacctctccngcgacgggccagtcagagtgtagcagcaacttcgcctggtaccagacaagaagttggccaggcctccaggcctccgtctacttcgtttggngtcgtccgtacgtacgggcccgtnttgggtctcccgagttccgaaggttcgaggttcggcgaggtgcgttgngggaactaggtacgttcaccgttctaccgaacctactacgaacgtccgtaacgtcccttagcgtacgtacgttaaggtaacgtttagttttagaccgtttaagttttacttacttgtacgtaagtactaaattaacgtaagtacggtcgttaccgggtccttacggttacggttagttccgttaccggtttcggacccggtaacggggttacccaagggtcgtaacgggagtaacgtaaccggaaacgttacggtacggtcggacgtacgg

SEQ ID NO: 242245 - DNA, 715 bp, Homo sapiens
  misc_feature: GYAE6OF01BZNU3.35.85.H08.1.454.CMB.1.raw
  modified_base (387)..(387): a, c, t, g, unknown or other
  misc_feature (387)..(387): n is a, c, g, or t
tcagtacagatcgtcacgaccggtgctcgatttagtatcactcagtcgcggggaggaactgctcagttaggacccagacggaaccatggaacgccccagcgcagcttctcttcctcctgctattctggctcccagatatcactggaagaaatgtgatgacgcagtctccaaccactctgtctgtgtctccgaggggacagaccgccctacccttctccgtgcgacggggccagtcaggtagtgttacgcagtacaacgttcgcctaggtaaccagacaaggtaaacggttcggaccacgggtcctcccgaggtcctcctctattcgtttggtgtcgtacctacggtggccgcgttcggtcgtcccagtcgtaggttcgagtcggtanaggtcgtctcggtggtaagtacgtacgttacgaaccttcgacctactacgtacgacgcgtaacgtccgtacgtacgtacggtacgttacggtaaggttacgttttacggtaccgtttaagtttaacgtttaacgttcggttaacgttacgtaactaaagtttaacgttaaaagttacgtaaccggttcggtacccgttcggttaacgttccggtacgtttaccggttttacggggaacccggttaacggggtacccgtaaaggtccggtaagggtaacggtaaacgttaacccggaaacgtaaccggtaggtacgggtccgtaaccgg

SEQ ID NO: 242246 - DNA, 749 bp, Homo sapiens
  misc_feature: GYAE6OF01DGX9W.35.85.H08.1.454.CMB.1.raw
  modified_base (95)..(95): a, c, t, g, unknown or other
  misc_feature (95)..(95): n is a, c, g, or t
  modified_base (116)..(116): a, c, t, g, unknown or other
  misc_feature (116)..(116): n is a, c, g, or t
  modified_base (166)..(166): a, c, t, g, unknown or other
  misc_feature (166)..(166): n is a, c, g, or t
  modified_base (179)..(179): a, c, t, g, unknown or other
  misc_feature (179)..(179): n is a, c, g, or t
  modified_base (223)..(223): a, c, t, g, unknown or other
  misc_feature (223)..(223): n is a, c, g, or t
  modified_base (249)..(249): a, c, t, g, unknown or other
  misc_feature (249)..(249): n is a, c, g, or t
  modified_base (524)..(524): a, c, t, g, unknown or other
  misc_feature (524)..(524): n is a, c, g, or t
  modified_base (530)..(530): a, c, t, g, unknown or other
  misc_feature (530)..(530): n is a, c, g, or t
  modified_base (559)..(559): a, c, t, g, unknown or other
  misc_feature (559)..(559): n is a, c, g, or t
  modified_base (581)..(581): a, c, t, g, unknown or other
  misc_feature (581)..(581): n is a, c, g, or t
  modified_base (695)..(695): a, c, t, g, unknown or other
  misc_feature (695)..(695): n is a, c, g, or t
tcagtacagatcgtcacgaccggtgctcgatttagtatcactcagtcggcggggaggaactgctcagttaggacccagacggaaccagtggaacnccccagcgcagcttctcttcnctgctatctgcctaccagatatcacgtggaataaagtgtagatgaaccgntatccaccaactntctgtctgtactaccgccggaagggacagtaccaccctacctcncgtagccgacgggccagtcgaaggtnttagacgacgtaagtaccttaaacggttccgtaccgtacggaaccgacgtaaacggtaaacggttaacgggttccgaaccgtaaccgggtcccctaccggtaacggttcccttacctaacgttccggtttttccggttaggtccgtttaccgacccgggttaacgtccggggtccgttccgggttcggtacccgtacgtacggttacggtaggttcgaggtcggacgtgtcggactcgggtaggaactacgtacgttcacgttcaactacagtcncgtacncgtcacgtatagtacgttaagtacgtttnttaggactttaagtccgtacgnggtaacaagtaactaaagtagtaccgtcggtacgtcggtaccttaggtcggtttccgtacgttacccgggtagggaacccggtaaggtcccggaaggttcggaacgggttaaanaaacccggggttaactaacggggtaaccgtgggtaaacccgtggttaaaccccc

SEQ ID NO: 242247 - DNA, 552 bp, Homo sapiens
  misc_feature: GYAE6OF01D80ZN.35.85.H08.1.454.CMB.1.raw
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (403)..(403): a, c, t, g, unknown or other
  misc_feature (403)..(403): n is a, c, g, or t
  modified_base (431)..(431): a, c, t, g, unknown or other
  misc_feature (431)..(431): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgtagcagcaacttagcctggtaccagcagaagttggccaggctcccgaggctcctcattcgtttggtgtcgtccacgtagggcctgtggtctccgagtcgaggttcagtggctaggtgctgnggacagngttcactctacactatacagcacgcctgacagtctagaagttntttgacttagtttattactgtacagtanaaattagtaatagtctgtccctacgtagttcgacttacgtttcgggaccggtaacggggtaactaacggtcgtacgggaagtaacgtaaccgaaaacggaacgttcggttcggccgtaacg

SEQ ID NO: 242248 - DNA, 863 bp, Homo sapiens
  misc_feature: GYAE6OF01E4BSZ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaacactctgtctgtgtcctccgaggggacagacgcccaccctctccgtgcgacgggcctagtcgaaggtagttgtacgacgtacgtacctaacgttacggccgttacgggtacccgaagcgtaaaggtaaacggttcggacccgaggtcccgtaccccgacggtccctccgttacgtacgtttcggttttacgggtcgtttaccgtacccgtaaccggttaccgggggtccccgttacggtttcggggttacccgttaccccggtacgggtttaccggttacggggtttaccggtacggggttcggggtaccgtaaggggttccgggtacccggttacggtaaacgggtaaacgttaacgggttacccgtttaccgtaacccttacccgttaaccctaaccggttactacccggaaacggtccctaaccgggttcccgtaacggtaccgttacgggttaaccggttaacgggttaacgttttacgttttaccggttaagttttaacggttttttaacgttacgttacggttaacctaacggtaaactaaaggtttaacttaaggtaaccggtccgttcgggtacccttcgggttacgttctaccggttttaccggtacgggtacccggaacgggtacaacggtcgaagggtaactaacgtaaaccgtaaacggtacggttcggagtccgtacccg

SEQ ID NO: 242249 - DNA, 732 bp, Homo sapiens
  misc_feature: GYAE6OF01BAJ5C.35.85.H08.1.454.CMB.1.raw
  modified_base (214)..(214): a, c, t, g, unknown or other
  misc_feature (214)..(214): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctccagatatcactggagaaatagtgatgacgcagtctccaaccactctgtctgtgtctccgagggacagcgccaccctctccgngacgacggccagtccgagtagtgttacgcagctaaacgttgccgtcggtaaccagacgaagtaaagtcggaccaggcctacccaggtccttaccgtctactttcgtttcggtacgttccgtaccgtacggtcggcccgtcgttcgggttccgtacccgagttccgaggtttacgagtcggcgtacggtggtcctcggttacggactaagggttcgttaccacgttccgtacaccgtacgtaccgacggtcgtaaccgcgtacgacgtacggttcgtaaggttaacgttacgtttcggtactttaagttttactacgtacgttactaagtaacttaaagttaactaacgttacggtccgttaccggtacccgttacggtacggtttacgttacccggtttaccgtttaccggggaacccggtaaccggggtaaacccgtaacggtcggttaaacggggtaacctaaacggttaaacccgaaaacggttaccgttcggggtaaccgttcggtaaaccccg

SEQ ID NO: 242250 - DNA, 780 bp, Homo sapiens
  misc_feature: GYAE6OF01AIXL5.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggaagaaatagtgatgacgcagtcctaccaaccactctgtctgtcgtcctccgaggggacagacgcccaccctctcctgccgacgggccagtcaggtagtgttacgcgagacctaacgttacgccgtacggtaccagacgaaggtaacgttcggaccgtaggtccctcccggagtcccttaccgtacttacgttcgtttggtcgtcgtaccgtaacggtcgggtccgtgtcggtcgtcccgtagtcgtacggttcgagttcggacgtacggtcggtccgttccgggtacggggtaacgtacggttaccgtttaccgtaccgtttccctacccgtaccttaccggttccgaccgtaccgtaccggtccgttacgggaccgtttaacggttccgttaaagggtaaccttttaggtttacccgtaacgttttaacggttttaaccgttcgttaacgttactaacggtaactttaaacgttaacttaacgtccggttacggttccccggttacccggttaacggttcggtttaccgtaccggttttaccggggtcgggtaaacccggtccggggtaaacctacgggtcggtaacggtaacgtaacgtaaaccggtaacgttcggaggttccgtcgtaaccg

SEQ ID NO: 242251 - DNA, 625 bp, Homo sapiens
  misc_feature: GYAE6OF01A0325.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagccgtggtaccagacaagaaagttcggaccaggcctccccgaggccctcctctacttccgttttgggtcgttcgtacccgacggttacggggcccgtcgttgggttcttcccgaggttccgtagggtttcaaggttggcctaggtcggccttcggtgggaactaggtacgtttcaccttcgtaccaccatcgacgcacgcctgctacgtcgtagtaacttagttttcggacgtttaagttttacttacgttgtactaggaactaagttataagtacggtctacggtcccgtacggttagttcgtcgttacgttacgggaccggtacgggacctaaggtcgtaggaactacgtaaccgaacgtacgtggtcggccgtacg

SEQ ID NO: 242252 - DNA, 731 bp, Homo sapiens
  misc_feature: GYAE6OF01BMOG8.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggaagaaatagtgatgacgcagtctaccaaccactctgtctgtgtctccgaggggacagacgccctacctctcctgccgacgggccagtcgagtagttgtacgcacgactaacgttacgccgtacggtaaccaggtacgaaaggtaaacggttcggaccgacgggtcctaccccgaggtcccttcctacgtacgtttcggtttgggtacgttcgtacccgtacgggtaccgggcccgttcgttgggtcctaccccgtaggtccgtaagggtttcagggttcggacgtaggtcggtcgtcggtacggggaactaggttaccgttccaacgttcaaccgtacctagtccgacggacgtacgtcctagaccgttacggttacgtaaggtaacgtttgtttaacggacgttttaacgtttacgttacgttacgttacgaagtaacttaaagttaacgtaacgtacggttcctacgggtacccttacggttacgttcggttaccgtttacgggttacgggaccggtaacgggtaccacgggtacggacggtaagtaaccgtaaacgtaaaccggtagtccggtaggtcgtaccg

SEQ ID NO: 242253 - DNA, 708 bp, Homo sapiens
  misc_feature: GYAE6OF01BVLYT.35.85.H08.1.454.CMB.1.raw
  modified_base (229)..(229): a, c, t, g, unknown or other
  misc_feature (229)..(229): n is a, c, g, or t
  modified_base (313)..(313): a, c, t, g, unknown or other
  misc_feature (313)..(313): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccacctctcctgcacgggccagtcagngtgttagcagcaacttagcctggtaccagcaaggaaagttcggccaggcctacccgaggcctcccgtctagttccgttttgggngttcgtacccgtacggttacggggcccgtcgttcgggttacgtccccgtaggtaccgtaggtttaccgaggtcggacgagggttggccgttcggcgggactacggtacgtttccgaccgtcctaccgaacccgtacttaccgtacgaccgacggtcccgttcggaccgtaacgttcgtaggtaacgttacgttttcggtactttaaggttttaacttacgttcgttacctaaggtactaaagttaacgttaagttacgtacgttaccggtcccgttaccggtacgtttggacccgtttacgttttccgggaacccgggtacggggaccgtaagggtccgtaagggtacggtaacgtaacggtaaaacccggttagttacggttcggccgtaccgg

SEQ ID NO: 242254 - DNA, 643 bp, Homo sapiens
  misc_feature: GYAE6OF01BT826.35.85.H08.1.454.CMB.1.raw
  modified_base (400)..(400): a, c, t, g, unknown or other
  misc_feature (400)..(400): n is a, c, g, or t
  modified_base (455)..(455): a, c, t, g, unknown or other
  misc_feature (455)..(455): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccacctctcctgcagggccagcaggagtgttagcagactaacttacgcctggtaaccaggaccaaggtaaacggttcggacccgacggtcccgtccccgacggtcctcctctacttcgttttggtcgttcgtccaacgttacgggccgtcgtgggtcgtccctagtcgtaggttcagtggcagtggcgtcgtcgganaggtattcactcgtacacctatcaacgcacggccttagctagtcgtagtaagttnttttacgactttacgttttattacgttcgtacgtaacgtaccttaaaattacgtaaacgttcgtaccggttcgtacccgttacgtagtttaccgtacgtttaaccggtttcgggacccgtaacgggggaaccctaaggtccgttaagggacaaacgttacccgaaacgtacggtagttcggagtaccg

SEQ ID NO: 242255 - DNA, 727 bp, Homo sapiens
  misc_feature: GYAE6OF01ALW45.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccaggggacagacgcccaccctctcctgcgagggccagtcagagtgttagcagcaacttagcctggtaccagcaagaagttcggccacggctacccgaggcctcctcattctttgggtcgtcgtaccacggttacgggcccgtcgttgggtccgttccccaggttccgtacgggtttccgaaggttcgggactaggttcgggcccgttcggttacggggaactacgggtacgtttccaccgttcccgttaccacctagttccgaacggccgaccggtcccgttgaccgtacggttaccgtaaggtaacgtttagtttttacggaacgttttaacggtttttaactttacgtttacggtacgtaacgtaaccttaaagttaacgttaaagttacggttaccgttaccgggtaccccgtttacggtacggtttcggtacccgtttacgggttttccgggaaccggtaacggggtaacccgtaggtccggtagggaacgtaacgtaaccggaaaacgttacggtcggttcggtcgttacccgg

SEQ ID NO: 242256 - DNA, 707 bp, Homo sapiens
  misc_feature: GYAE6OF01EN03F.35.85.H08.1.454.CMB.1.raw
  modified_base (699)..(699): a, c, t, g, unknown or other
  misc_feature (699)..(699): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccctacccttctccgtgaccgacggccctagtccgagtagttgtagcgaagcctaaacgttacgacccgttacggtaaccaggaccaaaggtaaacggttcggaccgtaacggtccctacccgacggtccctcctacgtacttcggtttggtcgttccgtaccgtacggtacgggccgtcgttcggtcgtaccgtagtcgtacggtcgtagtggcgtaggtcgacgtcggaggtactacgtcgttaccgacttccaccgtacgtactacgacgtacgtaccgtccgtagtcgtagtcgtacgttaaaggtttcgtttacgtagtttaacgtttactttacgttactacgaacgtaacttaaagttaacgtaacgttacgtaccgttacggtcccgttaccggttagttaccgttccgtttaccgtttcgggaaccggtaacgggtaaccctagggtcgtaacggtaacaacgttaaccgaaacgtaggttcggtcgngtaacccg

SEQ ID NO: 242257 - DNA, 577 bp, Homo sapiens
  misc_feature: GYAE6OF01AQO2P.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagacagaagttggcaggctcccaggcctcctcactcgtttggtgtcgtaccacgtacgggccgtctgggtcgtcccgagtccgtaggttccgaggtgcgagtggcttcgtagggacagtagttccacgtcctacacctatcacgcagcctgcgtagtctaggtaagttatttagacgttagtttacttatgtacagataaattataagtacgcgtcggtaccctcggtacgttctccgttacgtttcgggacccgtacggggtaccacggtcgtagggaactaactaacccggtaaacggtagtcgggtggtcccgtacgg

SEQ ID NO: 242258 - DNA, 750 bp, Homo sapiens
  misc_feature: GYAE6OF01D4QIP.35.85.H08.1.454.CMB.1.raw
tcagtacagatcgtcacgaccggtgctcgatttagtatcactcagtcgcggggactgcttcgaggcagttggtagatcgcccctcgtgggagagactccccgagggtgacagccagtcggacccgtggaacgggccgtgggcgtagggacgacgggaccgagacgccagtccgagggagaggacgagacgaccaagtggacgtgggtagtacgtagtaacgacgccctgcgtggcggagacgggaccgaggccgacccgtccgtccgaggacgcccagtcgctgacgaacggtccggaccgaggacggtccgaccccgtacggaaccgtacggaacggaccgtaagacggaaccgaaccccgaaacgaccgacggaccgtaaggttacgggttcgtacgaccggtacccgtaggacgacggtcggtccggtcccgtcggacccgacggaccgacggccggtccgtccggcccgtcgacgtcgtcgtcggtcgtggtccgcgccgttgtccgtccgacgtacgtccggtcgtcgccgtaccggccgacgtacgtcggtccgaccgtaccggaccgaaaccgggtcccggacccgtaaccgaccgtacgggtacccgaccgtacgtacggttacggaaccgcggaccgacccgtacgtaccccggagtccccggcggacccggtacgtcccgggtacgggacgggtacgtaccggacccgtaacccggaccccaaccggaccccgtaacccg

SEQ ID NO: 242259 - DNA, 751 bp, Homo sapiens
  misc_feature: GYAE6OF01C2TV3.35.85.H08.1.454.CMB.1.raw
  modified_base (121)..(121): a, c, t, g, unknown or other
  misc_feature (121)..(121): n is a, c, g, or t
  modified_base (746)..(746): a, c, t, g, unknown or other
  misc_feature (746)..(746): n is a, c, g, or t
tcagtacagatcgtcacgaccggtgctcgatttagtatcactcagtcgcgggggaggaactgctcagttaggacccagacggaaccatggaagccccagcgcagcttctcttcctctgctnttctggctccagatatcactggaagaaatgtgatgacgcacgtctacccaaccacttcgtgtctgtgttcctaccggaggggaccagacgaccctacctcctccgtgacggacggcctagtcgaagtaggttacggtacgccgtaaggaccttaaaccgttacggacccgttacggtaccaacggtaacgtaaggtaaacggttccggaccggtaccgtacccgtaccccgaccggttcccttccttaaccgttacgtttccgtttggtaccgttccgtaacccgtacggttacgggccgtcggttcggtccgttaccgtacggttcgacggttcggaggtccggtacgtaggttggccgtcgggtaacggaacgtacgggttaccttccgtaccgttacctaccgttaacccacgttaccggaacgcccgtaccgtacgtaccgtaacgtacgttacgtaacggttacgtttagttttacgtacgttttaacgtttacttacgtagtactaacgtataaacgttagtagtaccgtacgttcggtacccgtgtacttaccgttcgttacggttccggaacggtacggaacgtacgacgtagacgacgtaaagaccgtagcgtcgngtacg

SEQ ID NO: 242260 - DNA, 793 bp, Homo sapiens
  misc_feature: GYAE6OF01EOAV2.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccacactctgtctgtgtctccgaggggacagacgcccaccctctcctgccgagggccaggtccaggtagttgttacgctagacctaacgtttacgcctggtacccagtaccgaaggtaaaggttcgggacccagggccctaccccgaggccttcctcgattcgttttaggtggttcggaccttacgggtccggtacggtccggtgttacccggacgtcctaaggttcggtacgtagggtcggtacggtcgggtacgggtccgtcgggtacggtaacgggagtttaccgttaacggttacctaccgttacccgaccttacgaccgttacgacgacccgtcgtccgaacgttacgtacgttaacgtacgtttacggttacttacgttaacggtttaactttcggttaccgtaacggtactaacgtaaagttactttaaaacggtaccttaccgggttaccgttacccgggttaccgtttacgggtttacgtaccccggttttacgggtttaacccccgggtacgggggtcccgggtaaaaaccggggtacttccgggtaaacgggtaacggttaccgaaaaacccgttaccggtaaaacggttccgggttcggtaacccgggtacccg

SEQ ID NO: 242261 - DNA, 810 bp, Homo sapiens
  misc_feature: GYAE6OF01BV389.35.85.H08.1.454.CMB.1.raw
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcacccgtcctccagggacgcccatgctgcaaggtcgggccaggacggttcgccccgtcgaaccgtggaacggaccaaagtcggaacgaaccccaaagaccgaacggaccgtaaagggttcgggttaggtaggaccgtaccccgtggacggacggccgtcgggcccgtcggtcccgacggcgacggccgtcgtccggcccgtcgccgtggccgtcggtccgttcgggtccgtcgggtccctacggttccggtccgcccgtacggttccggtacccgttcggccgttccggacccgttacccggtaacggtttcgggttaccgacccgtaacccgggaacgtaaacccggggccccggggaaaccccgacgggtaacccccggtcgggaacccggttcccggtaaccgttaacgggttaccgggaacggtacccgacgggtaccccgtaaccgtcccggacggttccccggtacgggacccggggttaccgggtccccgggttggggtacccgggggaccgttaccggggtaccccgaaacccgggtacccccggaaacccgggtacccccccgtaaaacccccgg

SEQ ID NO: 242262 - DNA, 881 bp, Homo sapiens
  misc_feature: GYAE6OF01A0A6Q.35.85.H08.1.454.CMB.1.raw
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
tcagtacagatcgtcacgaccggtgctcgatttagtatcactcagtcgcgggggaggaactgctcagttaggacccagacggaaccatggaacgccccagcgcagcttctcttcctcctgctattctggcctcccagatatcactggagaaatagtgatgacgcagtctccaacnctntgtctgtactcgtccgaggggacaggacgccctacccgtctccgtgacgacgggcctagtcgaggacggttgtacgctacgacctaaccgttacgccgttacgggtaaccaggtaccgtaaaggttaaacggttcggttaccgaacggtccccgttacccggacggtcccttccccgttacgttacgttttccggtttgggtcgtttccggtacccgtaacggtaccggggtccgttacggttccgggttaccgttacccggtacggttccgtaaggggttccgtggggtaccgggtacgtacgggttccgggtcgtttaccgggtaagggaacgtacggttacgttacccgtacgtttaccctaccgaaccttacgtaccgacggtaccgtacggtccctaggtaccgtacgttaacggttacggttaaagttttcgtttacggtaaccgttttaagttttaccgttaggttaccggtaacctaagtttaaaccgttaagtaaccgtttaacgggtttaccggtaccgtttccccgggtaaccggtttaccgtacgggtttcccttaaccggggttttacccggtttacggggaaaccccgggtaacgggttacccgtaagggttccggttaaagggtaaacgttaacccgttaaaccgggaaaaccggtttaggttaccgggtcgttacccggtaaacccg

SEQ ID NO: 242263 - DNA, 748 bp, Homo sapiens
  misc_feature: GYAE6OF01B1IZL.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtcctaccaaccacttctttctgtgtctccgaggggacagacgcccaccctctcctgcgagggccagtcagagtgtagcagctaactagcctaggtaccagcaaggtaaacgttcggaccgaggtcctcccgacggtcctcctactagtttccgtttaggtcgttccgtacccgtaacggtacggggcccgtcgtcgggttccgtacccgaggttaccggtaacgggtttcgaacgggttcggtaccgtagggttcggtccttacgggtagggaactagggttaccgtttccaaccgttccgtaaccacctagtaccgacggtacccgtacggtccccgtagaccctaacggttacgtacggtaagtttacgttttcgaacgtttacgttttaacgttacgttcgtactaacgtacttaaattaacgttaacgtacggttaccgtacggtcccttacggtacggttacgtccgtttaacgtttcgggaaccggtaacgggtaccgtaaggttccggtaacgggtaacggtaaaccttaaaccgggtaaacgtaacgggttaggtaccggtaccgtcggtaacccg

SEQ ID NO: 242264 - DNA, 861 bp, Homo sapiens
  misc_feature: GYAE6OF01BVQJ1.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctaccaaccactctgtctgtctctcgaggggacagacgcccaccctctcctgcgacgggccagtcagagtgttagcgagactaacgttacgccgttacggaaccacgacgtaaggtaaacggttcggacccgtacgggtccctaccccggaggtcccctttaccctacgttacgttttccggttttacggtcggttaccggtacccgtaacggtacgggggtcccgttccggttacgggttacccggttaccccgtagggttaccgtaaggggtttccgaggggttcggacgtagggtcggtccgtacggtgggaaccttagggtaacctttccacgttacctaccgtaccgtacgttaccgacgtacgtaccgtccgttagacggttacgttaacggtaacgttaaggtttacgttttacggaaccgtttttaaaggttttaacgtttacgtttaccggttaacctaacgttaaccgttaaatttaaccgttaaagggttaaccggtccggtttaacccgtacccgggtttacgtacggtttaccgggttacccgttttaccggggtttaccgggaaccccgggtaaaccggggggttaaccctaacggggtttccgaaggggtttaaacccggtaaccgttaaacccggtaaaacccggttacggttaacgggtccggttacccgtaaaccggg

SEQ ID NO: 242265 - DNA, 669 bp, Homo sapiens
  misc_feature: GYAE6OF01AF2BB.35.85.H08.1.454.CMB.1.raw
  modified_base (449)..(449): a, c, t, g, unknown or other
  misc_feature (449)..(449): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcgagggccagtacaggagttgtacgcagactaacgttcgccgtcggtaaccaggaccaaggtaaacggttcggacccgaagggccctacccgacggtccctccgtactacgttccgtttgggtacgttcggtaccgtacggtacggggccgtcgtcgggtcgtccccgtagtccgtaggttcgaggttcggctaggtcggtctcggtagggactagtacgttcactctacgacngtacgacgcacgcccgtgacgtacgtcgtagtaagttacgtttgaccgtttagtttaactcgtacgtacctaagtaactaaattaagtacttacggtccgttacgggtccctacggtagttccggtacgttacggttaccggaccggtacggggtaacacgggttcgtacgggtaacgtaacgtaaccggtaaacgttacggtacggtcgtcgtaacccg

SEQ ID NO: 242266 - DNA, 749 bp, Homo sapiens
  misc_feature: GYAE6OF01DS0QQ.35.85.H08.1.454.CMB.1.raw
tcagtacagatcgtcacgaccggtgctcgatttagtatcactcagtcggcgggggaggaactgctcagttaggacccagacggaaccatggaagccccagcgcagcttctcttcctcctgctattctggctcccagatatcactggagaaatagtgatgacgcagtctccaacctactctgtctgtgtcctccgaggggacagacgcccacctctcctgcagggccagtcagagtgttagcagcaacttgcctggtaccagcaagaaagttcggaccaggcctcccgaggcctacctctattccgtttggtcgtcgtacccgacgttacggggccgtcgttagggttccgtacccctaggttccgtaagggtttccaagggttcggacgtaggtcgggtcctcggtacggggaaccaggttacgttcccgtaacttcccgtacctaaccctacgttccgaacggtaccgtaacgtcccgtacggtaccgtaacggttacgtacggtaaagttactttttacggaccgtttaagtttttaaccgtttaaccgtttgtacgtaacgaacgtaaaagtttaagtaaacggttacggtaccgttaccgggttacccctttaccgggtagtttaccgtaccgtttaaccggttttcgggaacccggttaacgggggtaacccttaagggtccggttaacgggaacgtaacccgttaaccgaaaccggttagttcggtcggtaccgtaacccggg

SEQ ID NO: 242267 - DNA, 767 bp, Homo sapiens
  misc_feature: GYAE6OF01ED9L9.35.85.H08.1.454.CMB.1.raw
  modified_base (135)..(135): a, c, t, g, unknown or other
  misc_feature (135)..(135): n is a, c, g, or t
tcagtacagatcgtcacgaccggtgctcgatttagtatcactcagtcgcgggggaggaactgctcagttaggacccagacggaaccatggaagccccagcgcagcttctctctctgctattctggctccagatancatgagaatagtgatgacgcagtcctaccaacactctacgtctgtcgtacctccgaaggggtacaggacgccctaccctctccgtgaccgtacgggtcctagtcgaagtaacgttcgttaacgctaacgtactaaccgttacggcctacgggttaaccaggacctaaagggtaaacgttccggaccagggtacctacccgacggtcccttaccgtcgtacgtttccgttttcgggtacgttaccgtaccgtaccggttagggtccccgtagttcgggtactaccccgtaggtacctacggttaccgacggtcgggtaccgtagggtccgtcgttaaccggtgggtaacctagggttaccgtttaccgtaacttacccggttaacaacccggttaacgtcccgtaaggtccgtaacgtacccggttcgaccggttaacgtcgttaaaggtaaccggtttgtttaccggactttaaggtttaacttccgttagacgtacgtactaaatacgttaacgtcgtacgtcgttaaccctacggttacgtgtcccttacgttaccggaccggaacgggtaccgtacggtgtaccggaattacccgtaaaccgtaaaggtaccgttcggtcgtcgtaccg

SEQ ID NO: 242268 - DNA, 653 bp, Homo sapiens
  misc_feature: GYAE6OF01B2SJO.35.85.H08.1.454.CMB.1.raw
  modified_base (241)..(241): a, c, t, g, unknown or other
  misc_feature (241)..(241): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcacgggccagtcagagtgtagcanacaacttagcctggtaccagacgaaggtaaaggttggaccacggcctaccccgaggtcctcctctacttcgttttggtgtcgtaccacggtagggtcccgtgttgggtcgtccccaggttcctaggggtttcagggtcggaccgaggttcggacttcgtgggactaggtacgttcaccgttcacacctagtaccagccgtacgccgtacgacgtacgtacgtacgtaagttagttttacgtacgtttagttttaactttacgttacgttacctaagtacttaaagttaataacgttagtccgttacggtccgttaccggtaggttcgtccgttacggtttcggaccggtacggggtaaccaggtccgtaggacgtaacgtaacgtaaacgtaacgttcggtacggtcgtacg

SEQ ID NO: 242269 - DNA, 686 bp, Homo sapiens
  misc_feature: GYAE6OF01B9DMD.35.85.H08.1.454.CMB.1.raw
  modified_base (407)..(407): a, c, t, g, unknown or other
  misc_feature (407)..(407): n is a, c, g, or t
  modified_base (460)..(460): a, c, t, g, unknown or other
  misc_feature (460)..(460): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtctccaaccactctgtctgtgtcctccgaggggacagacgcccaccctctcctcgcgagggccagtcagagtgttagcagactaacgttacgccgtaggtaccagacaaaggtaagttcgggaccgacggccctacccgacggtcccttcccgtcgtacgtttccgtttgggtcgttcgtacccgtacggtcgggcccgtcgttcgggtccgtcccgtaggtccgtaggttcgaggtggcgnggtcggtctcggtagggactagtacgttcacgtccaccactatccgacgtacncgtcctagctaggtacgtacggtaagttacgttttcggaacttttaggtttactttactcggttaactagttaactaattaacgtaagtcgtcggttaccgtacccgtcggttgttacggtacctttacgggttaccggaccgggtaacggggtaacccgaaggttcggaaaggtacgtaaaccttaaaccgggaaacgttacgggcggtacgggttcgtacccgg

SEQ ID NO: 242270 - DNA, 605 bp, Homo sapiens
  misc_feature: GYAE6OF01CNK8T.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgtagcagcaattgcctggtaccagcaagaaagttcgccaggcctccgaggcctcctactattctttgggtgtcgtccacgtacgggccgtcgttggtcgtcccagttccgaggttcaggtggcaggtggcttcgtgggacaggtagttcacgttcacaccatcgacgcagcctgcgtagtctagtaagttattttgacgttagtttactttacgtagtactagtactaaagttaataaagttcgtacgttcggtacccgttaccggttaacggttcgtaccgttacggttttccgggacccggtaacggggaccctaaggtccgtagggtacgtaactaccggaaaacgtacgttcgggtacggtcgtaccgg

SEQ ID NO: 242271 - DNA, 818 bp, Homo sapiens
  misc_feature: GYAE6OF01E2TVD.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtcgtctccgaggggacagacgcccaccctctcctgcgacggcctagtcagtagtgttagcagactaacgttacgccgtaggtaaccgagacgaaaggtaaacgttcggaccacgggtcctaccccgaggtccctcctactacgttccgtttggtcgtcgtacccgaacggtacgggtccgtcgtgggtctccccgaaggttccgtacgggtttcgaggttcggacgtacggtggtcgttcggtagggaccgttaagacgtttaccacgttacctacctaaccgtaacgtaccgtaacgaccggtaaccggtcccgtacggtaaccggttacgtacgttaacgggttaaacggtttactttttacggtaaccgttttaaagtttttaaccgtttaacggtttacgtaccgtaaacggtaactttaaaaccgttaaagtttaaacggttaaccgttaccggttaacccgggtacccgtttaccgggttaacgggtttacgttaacctttaacccgggttttaacggaacccgggtaaccggggtaaaccttaaaccgggtcggttaaacggggaacgttaaacccgttaaaaggtaaaacccgttaacgggttacggttcgggtaaccgttaaccgg

SEQ ID NO: 242272 - DNA, 837 bp, Homo sapiens
  misc_feature: GYAE6OF01D05GL.35.85.H08.1.454.CMB.1.raw
  modified_base (178)..(178): a, c, t, g, unknown or other
  misc_feature (178)..(178): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctccagatatcacgtggaagaaatagtgatgacgcgatcctaccaaccnctctgtctgtgtcgtccgaggggacagacgccctaccctctccgtgccgacgggcctagtcgaggtgtagtacgacacgtactaacgttcgccgtacggtaccgagtacgaaggtaacggttcggaccgtacggtccctacccggacgtcccgtcctacgtacgtttccggtttaggtcgtaccggtaccgtacggtacgggtccgtcggttacggtccgtaccgagttacgtacggttcgaggtcggacggtaggtccggtcgttacgggaggtacgtacgtaccgtttacgaccgttccctacgtacctacgttaccggacgtcccgtaacggtccgtacgacgttaccggtagttaaggttaacgtttgttttaaccgacgtttttaaacggtttacttaccggttacggtactaaacggttaaccttaaagtttaacgttaaccgggtacgttacccgggttaccgttaaccccggttggtttaaccggtttccgttaacccgggttttcccgggtttaaacccgggggaaaccgggtaacccggggtttaaacccgtacgggtttccggggaaaacgggttaaccttaaaacccgggaaaccggtttaaaccggttaaggggttccccggttaacggtcccggttaaaccccgg

SEQ ID NO: 242273 - DNA, 776 bp, Homo sapiens
  misc_feature: GYAE6OF01A6GLE.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccacctctccgtgccagggccagtcagcgtgtagcagactaacttacgccgtaggtaaccagacaaggtaaacgttcggaccgaggcctaccccgaggtcctccctacgtacgttccgttttgggcggttccgtacccgacggttacggggccctgttcgggttccgtccccgtaaggtccgtaggggtttccaagggttcgggacgtagggttcgggtaccttcgggtacggggtaacctaggtaccgttttcccgaaccgttcccgtacccgtaacccgtataccgaacgaccgtaccgtccgtacgaccggtaacgttacgtaaggttaacgtttactttttacggtacgttttaacggtttttaacttaaccgttagtaccgtaagttaaccgttaaaatttaacgttaaagttaccggtacgttacccggttacccgttaccggttaagtttccgttacccgtttaaccggttttaccgggaacccggtaacggggtaacctaacggggtcggtagggtaacgtaacgtaaccgaaacggttacggttcggtacgggccgtaaccgg

SEQ ID NO: 242274 - DNA, 869 bp, Homo sapiens
  misc_feature: GYAE6OF01C22BA.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtcctccgaggggacagacgcccaccctctcctgcagggccagtacagtagtgttagcgagctaacttacgccgtaggtaccagacgaaggtaaagttcggaccgacggcctcccgacggtcctccgtctacgttcgtttgggtcgtacgtaccgtacggtacgggcccgtcgttcgggtccgtacccgacggttcgtacggttcgtaggtcggcgtacggttcggtccgttcgggtacggggaacgtacggtacggtttacctaaccgttccgtaaccctaccgtaagttaccgaacgtaccgtaacgtcccgtacggaccgtacggttacgttaacgggttaacgttacgtttttacggtaccgttttaaggtttttaaccttttaacggttacggtaacccgttaaacggttaaccgtttaaaagtttaaacgttaaacgttaaccgggttccggtttaacccgggttacccccgtttaccggggtttaacggttttacccggttaccggtttaaaccccgggtttttacgggggaaaccccggggttaaacggggggtaaaccccctaaaggggttaacccggtttaaccggggtaaacggttaaaaccccgttaaaaccgggttaaaaaccccgggttaccgggtttacggggtccgggttaacccggttaaaccccggg

SEQ ID NO: 242275 - DNA, 743 bp, Homo sapiens
  misc_feature: GYAE6OF01D015C.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggagaaatgtgatgacgcagtcctccaaccactctgtctgtcgtcctccgaggggacagacgccctaccctctcctgcgacggccagtcagtgtgtagcagctaacgttgcctaggtaccagacaaggtaaacgttcggccaggtcctacccgaggtcccttacctcagtttccgtttggtcgtacgtccgacggtcgggtcccgtgttcgggttccgtccgtaggtcgtacgggtttcgagggttcgcgtaggtggtccgtcggtgggaactagtacgttccacgtcttacgaccctatacgtacgtacgacgtcctacgactacggttaactacgttaagttcttttaggacttttaacgtttaactttccgtagtaccgtaagtaacttaaattaacgtaaacgttaccggtacccggtttaccggaccccgtttaacgggttacggtttaccgggttacccgtttaaccggttttccggggaaaccccggtaaaccggggtaaccccgttaagggtaccgggttaacgggtaacgtaaaccgttaaacccggaaaacgggtttaacgtcgggttaaccggccgtttaaaccccggg

SEQ ID NO: 242276 - DNA, 604 bp, Homo sapiens
  misc_feature: GYAE6OF01CSB1P.35.85.H08.1.454.CMB.1.raw
  modified_base (302)..(302): a, c, t, g, unknown or other
  misc_feature (302)..(302): n is a, c, g, or t
tcagtacagatcgtcacgaccggtgctcgatttagtatcactcagtcgcggggaggaactgctcagttaggacccagacggaaccggatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcagaaagttcggccaggctcccgaggctccgtcagtctttggngtcgtccgacgtagggccgcgttggtcgtccccaggttccaaggtttcaggttcggcgtaggtggctcggtgggaacagtacgttcacgttctacacatcagcagcctgctagtctgtaacgtagttttagacgttaagtttactttacgtgttaccgagtactaaattaagttaacgttacgtcgtcggtcccgttacgtaaggttgtaccttacggttttacggacccggtaggggaaccctaaggtcctaggggtaactacgtaacgtaaaaccggtacgttacggtcggtcgtaacgg

SEQ ID NO: 242277 - DNA, 756 bp, Homo sapiens
  misc_feature: GYAE6OF01CWQX1.35.85.H08.1.454.CMB.1.raw
tcagtacagatcgtcacgaccggtgctcgatttagtatcactcagtcggcgggaggaacctgctctagttaggacccacgacggaaccatggaagccccagcgcagcttctcttcctcctgctattctggctcccagatactcactggagaaattagtgatgacgcagtcctaccaaccacttcgtgtcctgtgtctccgaggggacagacgacccacccttctcctagcgacggccagtcagtagttgttacgctacgactaacgttacgccgtagtaccgagtacaaggtaaacggttcggccgacggtccctaccgaggtcccttaccgtcttacgtttccgttttgggtcgttacggtaccgaacggttcggggcccttcggttcggtacccggttccgtaacggttaccggtaacggggtttcgtaggggtcgggtacgtacggggttcggtccgttcgggtaacgggtaactaaggtccgtttacctacccgttacgtacccctacgtacttacgacgtaccgtacgcccgttaagtcccgtaggttacgttaacgttaaggtttacttttacggttacctttaaggttttactaaccgttgtaaccgtagtaaccttaagttaacttacggtacgtaccgtacgtccttagggtacttcgtacgtttaccgttccgggaaccggttacgggaactacggtcgaacggtaacgtaaaccgtaacgaaccgtacgttgggtccgctaaccg

SEQ ID NO: 242278 - DNA, 799 bp, Homo sapiens
  misc_feature: GYAE6OF01CY9RW.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtcgtctccgaggggacagacgcccaccctctcctgcgacgggccagtcaggagttgttacgcagactaacttacgcctaggtaaccagacaaggtaaacgttcggaccaggcctcccgaggtacctcctcagttccgttttaggtcgttccgtcctaacggtaggggccccgtacgttcgggtcgtcccgaggttacgacggtttcaggttcggctaggttcggcgttcggtacgggaacgaggtacgtttccaccttcctaccgaacctaatccgacgtcctacggtcccttaggtcgtaacggttaccgtaggaaacggttttagttttaccggtacgttttacgtttttaacgtttacgttacggtaaccgtaacggtaaaccttaaagtttaaacgttaacggttaacggttaccgttacccggggttaccccgttaccgggtttaacggttttaccggtaccgttttaaccgggtttttaccggggaacccgggttaaaccgggggggtaaccccttaaacgggtcggttaacggggaaacggtaaaccttaaacccgggtaaaaacccgggtttacgggtaacggggttccggtaccggttaaacccggg

SEQ ID NO: 242279 - DNA, 713 bp, Homo sapiens
  misc_feature: GYAE6OF01DR55B.35.85.H08.1.454.CMB.1.raw
  modified_base (153)..(153): a, c, t, g, unknown or other
  misc_feature (153)..(153): n is a, c, g, or t
  modified_base (225)..(225): a, c, t, g, unknown or other
  misc_feature (225)..(225): n is a, c, g, or t
  modified_base (706)..(706): a, c, t, g, unknown or other
  misc_feature (706)..(706): n is a, c, g, or t
tcagtacagatcgtcacgaccggtgctcgatttagtatcactcagtcgcgggggaggaactgctcagttacggacccagacggaaccatggaacgccccagcgcagcttctcttcctcctgcttattctggcctcccagatactcactggaanaaatagtgatgacgcagtcctaccaaacctctcttgtctgtcgtctccgaggggacagcgcccacctctccncgacgacggcctagtcgaggtagtgtagcgacgacctaacgttcgccgtagaccagacgaagtaagtcgacgacgctaccgacgtcctcctactgtttcgttggtcgtaccgtcctaacggtcggccgtcgttacggtccgttaccgagttcgacggtttacgaggttccgggacgtaggggttcgtcgtttaccgggacgggtaaccgtaggtaccgttccgtacctcctaccaacctacgtccaacgtccgacgtcctacggctaacggttctaacggttactttagtttcggtaatttttacggtttttaaccttacgttacggttaacgtaacgtaacttaaacgttaattaaacgtcgtaccgttcggtaccctcggttagttccgtacgtttacgttccgggaccgtaaacgggtacccgagttaaccggaggtaaccgtaacgtaaacccggtaaagtaccgggtcggttacgntaacccg

SEQ ID NO: 242280 - DNA, 681 bp, Homo sapiens
  misc_feature: GYAE6OF01AVOAQ.35.85.H08.1.454.CMB.1.raw
  modified_base (104)..(104): a, c, t, g, unknown or other
  misc_feature (104)..(104): n is a, c, g, or t
  modified_base (141)..(141): a, c, t, g, unknown or other
  misc_feature (141)..(141): n is a, c, g, or t
  modified_base (325)..(325): a, c, t, g, unknown or other
  misc_feature (325)..(325): n is a, c, g, or t
tcagtacagatcgtcacgaccggtgctcgatttagtatcactcagttcggtcgggggaggaactgctcagttaggacccagacggaaccatggaagccccagcncagcttctcttcctcctgctatctggctccagatacncgatggagtaatagtgatgacgtctacgtctccaacctctcttgtctcgtaggtactccgacgggaccagtacgcccaccctcgtcctaggccagggcctagtccacgtagttcgtacgcgacacgtaacctacgccgtacgaccgtacgccgaaggtaaccgttcgacctacgtccgtaccgngtcctaccgtctagttccgttaggcgtcgtccgacgtacggcccgagtcggtacgtccaggtcgcgttcgtaggtcggacgtagtcgtctcgtacggtactacgatttccacgtcctaccgacacgtacgacgtacgtacggtacgtgttacctacgttacgttaagtaacgttgtttacgtacgtttactttacgttaccgtacgtaccgtaacggtcgttaaccttacggttaaccggtcggtacttaaccgggtaccttaccggtaaggtccttaaaccgtacggttacgacgggtacgggaactacggtcgtaacgtacgtactaacgtaacgttcgtcgtcggtccctacg

SEQ ID NO: 242281 - DNA, 509 bp, Homo sapiens
  misc_feature: GYAE6OF01DEWIX.35.85.H08.1.454.CMB.1.raw
  modified_base (352)..(352): a, c, t, g, unknown or other
  misc_feature (352)..(352): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagtagtgttagcagcaacttagcctggtaccagcaagaaagttgcaggctccagctctcatctttggtgtgtccagtagggccgctgggtctcccagtcaggttcagtggcagtggctcgtgggacngtagttcactctcacatcagcagcctagcagtctgaagtatttgctatttattactgtcagacaatataatagctagtcctcgtagttcgtacgtacgttttggaccgtaaggggtaccgaagtcgtaggtagactacaaacgtataggtgcgtacg

SEQ ID NO: 242282 - DNA, 755 bp, Homo sapiens
  misc_feature: GYAE6OF01AJERB.35.85.H08.1.454.CMB.1.raw
tcagtacagatcgtcacgaccggtgctcgatttagtatcactcagtcgcggggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgccagggccagtcagagtgttagcagcaacttagcctggtaccagcaagtaagttcggccaggcctccccgaggcctcctctatcgtttgggtgtcgtacccgacggtacggggcccgtcgttcgggttccgtaccccgaggttcccgtaggggtttccaaggggttcgggaccgtagggttcggtacccgttcgggtagggggaaccgtaaggtaccgttttacccaaccgttcccttacccgaacccgtacgttacgacggtccgaccggtcccgtacggacgtacggttcttaagggtaacgtttatttttcggtactttaacggtttttaacctttacgttcgtaccgtaagtaccgttaaaattaacgtttaacgttacggtcccggttacgggtccccttttacggtacggtttcggtaccgttttaccgggtttcccgggaccgggttaacgggggtaaccctaagggtccgtaacggggtaacgtaaccgttaaaccggtaaaccggtaggttcggtcggtccgtaacgg

SEQ ID NO: 242283 - DNA, 728 bp, Homo sapiens
  misc_feature: GYAE6OF01ENGNQ.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctaccaaccactctgtctgtgtcctccgaggggacagacgcccaccctctcctgcgacgggcagtcagtagtgttagcaggcctaacttagcctaggtaccagcaagaaaggttcgaccaggcctcccgaggcctcctcgattcgtttggtgtcgtccacgtacgggcccgcgttggtcgtacccgtagtcgtaggtctaggtcggacgtaggtcggcttcggtgggaacctaggtacgttacaccttcctaccgtacctagttccgacgtaccgacgtacccgtcgtacgtacgttacgtaaggtaaacgttacgttttttacggctttaacggtttttaatttaccgttacggttaacccgtaagtaaccgttaaaacgtttaagttaaacgtacggttaccggttacccgggttaccccgttaaccggttacggttttaccgtaccggtttaacggtttttacccggggaaccccggtaacgggggtaaaaccccgtaacggttacgggtaacgggtaaactaacccggttaaaccgtaaaaacccggg

SEQ ID NO: 242284 - DNA, 622 bp, Homo sapiens
  misc_feature: GYAE6OF01A5LW0.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctggcagggccagtcagagtgtagcagctaactagcctggtaccagcagaaagttggccaggcctccgaggcctcctcattcgtttggtcgtcgtccaacgttacgggccgtcttgggtcgtcccaggttcgtaggttcagggtggctaggtggccttcgtggggaaccaggtagtttcaccttcctacaccatcgacgctacgccctggactagttcgtagtaagttattttcggacttaggttttacttacgttaggtctaagtaccgtaattaataacgtacgtcgttacgtacccgttacggtagttccgtacgtttaccgtttcgggacccgtacgggggtaacctacgggtcgtaagggtacgtaactaccggtaaaacgtacgtcggtacggtcgtaaccgg

SEQ ID NO: 242285 - DNA, 573 bp, Homo sapiens
  misc_feature: GYAE6OF01DKRZW.35.85.H08.1.454.CMB.1.raw
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccaggggacagacgccaccctctcctgcagggccagtcagagtgttagcagcaacttagcctaggtaccagcaagaaagtgccaggctcccagctcctcatcttggtntgtccacgtgggccncgtggtctcccagtcaggttcaggtcgcagtggctcgtggacagacgttcacttcacacatcacgcagcctagcctagtctagaagtatttcgactagtttattacttgtcagtactaattaacgttaagttacgagttccggtaccttccggtaagtttcgtaccgttaaccggttttggacccggtaacgggggaaccaacgggtcgttaacggaacgtaacgttaacgaaaacggtacgttacgggtcggtcgtaaccgg

SEQ ID NO: 242286 - DNA, 745 bp, Homo sapiens
  misc_feature: GYAE6OF01DCHWE.35.85.H08.1.454.CMB.1.raw
  modified_base (208)..(208): a, c, t, g, unknown or other
  misc_feature (208)..(208): n is a, c, g, or t
  modified_base (397)..(397): a, c, t, g, unknown or other
  misc_feature (397)..(397): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgctagtcctaccaaacctctctgtctgtgtcctccgaaggggacagacnccctaccctctcgtgcgaggccagcgagcgtgtacgcagctaacttcgcctagtaccagacgaaggtaagtcgacgacggcctccgacggtcctcctctacgttcgtttggtacgtcgtaccgacggtcgggccgtacgttcgggtctacccgtagtccgtaggtcgaggtgcgtaggtcgtctacggngggtaactacggttactaccggtacttacccaccgtaacctaacgtaccgacggtaacctacggtccgtaccggtacgtaacggttaccgttaaggtaacgtttacggttttaacgttacgtttaacgtttttaactttaacggttagttaaccgttaagtaaacttaaacttaacgtaaacgtttacggacggtttacccgttacccgttacggttacggttaaccgttccggttaacccggtttacgggaacccggggtaaacgggtaacccggtaaggtccggtaaggaaaccgttaccgtaaaccgtaaaccggttacggtacggttaccggtcggtaacccgg

SEQ ID NO: 242287 - DNA, 619 bp, Homo sapiens
  misc_feature: GYAE6OF01E2Z7N.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgtagcagcaacttgcctggtaccagcaaggaagttggccaggcctccccaggcctcctctattcgtttggtgtcgtcccacgtacgggccgtcgtgggtcgtccccgagtccgtaggttcaggtcggcgaggtcgggcttcggtcgggacaggtacgtttcaccttcgtccaccactcgacgccacgccgtcgcgtagttcgtaggtaacgttattttcgacttaagttttacttacgttacgtcagtactaattagttaacgttacgtcgttcggtcccgttaccgttagttcggtccgtttaccgtttcgggacccggtacggggtaacctaaggtcgtagggtacgtacgtaaccgtaaacgtaaccgttggtcggcgtaccgg

SEQ ID NO: 242288 - DNA, 813 bp, Homo sapiens
  misc_feature: GYAE6OF01B7XGP.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctccagatatcactggaagaaatagtgatgacgcagtctaccaaccactctgtctgtcgtctaccgaggggacagacgccacctctcctgcgagggccagtcagagtgttagcagacaacgttacgccgtaggtaaccagacaaggtaaaggttcgggacccgaggcctaccccgacggtacccttccgtactaacgtttcgttttgggttcgtacggttacccgtaacggtaccggggtcccgtcggttcggtttccggaccccgtacggttacgtaacggggtttccaagggttcgggaccgtagggttccggtaccgttcggggtagggggaaccgtagggttaccgtttaccgaccttacccgttacccgaacctagtacctaacggaccgtaacggtcccgttaggacccgtaaggttaccgttaaggaaaggttttactttttacggacgttttaaagtttttacgttaacttacggtttacaacgttaactaaaagtttaacgtaacggtacggtaccgtttacggtacccgttacgggttacgtttcggtaaccgttttcggtttaaccggggaacccgggtaacgggggtaaaccctaacgggttcgttaaacggggaacgttaaacgttaaacccggaaaccggttacggtcgggttaaccggccgttaaacccgg

SEQ ID NO: 242289 - DNA, 823 bp, Homo sapiens
  misc_feature: GYAE6OF01DVTZF.35.85.H08.1.454.CMB.1.raw
  modified_base (245)..(245): a, c, t, g, unknown or other
  misc_feature (245)..(245): n is a, c, g, or t
tcagtacagatcgtcacgaccggtgctcgatttagtatcactcagtcgcgggggagagctctggggaggaactgctcagttaggacccagacggaccatggaagccccagcgcagcttctcttcctcctgctattctggctcccagatatcactggagaaatagtgatgacgcagtctccaaccactctgtctgtgtctccgaggggacagacgcccaccctctcctgcgacgggccagtcaggngtgttagcagcaacttcgccgtacgtaccaggacaaggtaacggttcggaccacggcctacccgaggcctccgtctatttcgttttgggtcgttacgtcccgtacggttacggggccctcggtttcgggttccgtccccgttaaggttcccgtaagggtttccgaagggtcgggtccgtaagggtcgggtcttaccgggtacggggaaacctagggttaccggttccgtaacccttccttaacccgactacgttaccgaacgtccgacgtacccttggaccgttaacgttccgtaagggtaacgttttacgttttttacggacgttttaacgtttttaacgtttaccgttacgttaaccgtaacggttaataaaacgtttaaccgttaagttaccgtaccgggtttacccgggtaccccgtttaaccgggtaacgttttacccgggttacccgtttttaaccgggggttttacccggggtaaccccggggtaaacgggggttaaaccccgtaaacgggggttacccgttaaacgggggtaaacggttaacccgttaaaacccgggtaaaaacccgggg

SEQ ID NO: 242290 - DNA, 557 bp, Homo sapiens
  misc_feature: GYAE6OF01DCVYO.35.85.H08.1.454.CMB.1.raw
  modified_base (157)..(157): a, c, t, g, unknown or other
  misc_feature (157)..(157): n is a, c, g, or t
  modified_base (385)..(385): a, c, t, g, unknown or other
  misc_feature (385)..(385): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagttangacgcagtctccaacactctgtctgtgtctccaagggacagacgccaccctctcctgcagggccagtcagagtgtagcagcaattgcctgtaccagcaagaaagttggccaggcctaccaggctcctcattcgtttaggtgtcgtaccacgttacgggccgtcgtggtcgtacccaggtcaggttcagtggacagtggctcgtgggacagacgttcacgtctcacctntacacgcagcctgacagtctagaagtagtttgacgtagtttattacgtgtacagtacgtaatataatagtcgtcgcttaccgtagttcgtacgttacgtttcggaccgtacgggtaaccgtaagcgtaggacgtaatacgtaaaacgtacgtaggtcggtcgttcgaacccg

SEQ ID NO: 242291 - DNA, 516 bp, Homo sapiens
  misc_feature: GYAE6OF01BOLLX.35.85.H08.1.454.CMB.1.raw
  modified_base (314)..(314): a, c, t, g, unknown or other
  misc_feature (314)..(314): n is a, c, g, or t
  modified_base (490)..(490): a, c, t, g, unknown or other
  misc_feature (490)..(490): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtgtccacgtagggccnctggtcgtcccagtcaggttcagtggcagtgctcgtgggacagagttcactctcaccatcagcacgctgcagtctagaagtatttgactagtttacttactgtactagactaatataaatagtactggtacctacgtagttgctacgtttggaccgtagggaccaaggcgtagganacgtacaaacgtaatggtggcgtacg

SEQ ID NO: 242292 - DNA, 788 bp, Homo sapiens
  misc_feature: GYAE6OF01AQGSN.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagataccactggagaaatagtgatgacgcagtctccagcccacctgtctgtgtctccgaggggacagacgccaccctctcctgcgacgggccagtcagtagtgttagcagacctaaacgttcgcctaggtacccagaccaaggtaaacgttggaccctagggcctacccgaggtccctccgtctacgttcgttttgggtcgttcggtccctaacggtacggggcccgtcgttcggggttccgtaccccgtagggttccgacgggtttccgtaaggtcgggaccgtaggggttcgggcctttacgggttacggggaacctaaggtacggtttcccaacccgttccgttacccgaaccgttaaccgtaccgaacggtacccgtaacgtccccgtacggtacccgtaacggtacgttaaggttaaacgtttacgttttacggtacgtttaacggttttaacgttttaccgttacggttactaacgtaacgttaaattaacgttaaggttacggtacggttaccggtcccgttacggttaacgttcgttaccgttacggttttaccgggaacccgggtaaacgggtacccgtaaagggtacggtacggtaacgtaacgtaaacgtaaacggtacggtacggtacggtcgtacgtaacccg

SEQ ID NO: 242293 - DNA, 705 bp, Homo sapiens
  misc_feature: GYAE6OF01BYERL.35.85.H08.1.454.CMB.1.raw
  modified_base (497)..(497): a, c, t, g, unknown or other
  misc_feature (497)..(497): n is a, c, g, or t
  modified_base (695)..(695): a, c, t, g, unknown or other
  misc_feature (695)..(695): n is a, c, g, or t
tcagtacagatcgtcacgaccggtgctcgatttagtatcactcagtcgcggggaggaactgctcagttaggacccagacggaaccagtggaagccccagcgcagcttctcttcctcctgctattctggctcccagatatcactggagaaatagtgatgacgcagtctccaaccactctgtctgtctctccgaggggacagacgcccacccgtctaccgtgcgacgggcctagtcaaggtaggttgttaaggccaagacctaaacgttacggcccttagggtaaccccaaggtaccgtaaaggtaaacgggttcggacccaagggtccccttaccccgacgggtccttacccctcgactttcgttttcgggtgttaccgtacccgtaaccggtacggggccccgttcgttacgggttccgtacccccgtaagggttcccgtaagggtttccaaggtcgggtctaaggggtcgaccgttgacgggactaggtagttccncgttactcctaaccgattaccgagtacctacggtcctacgaacgtgttacgtagagttagttttcgacgtttaatttagtaacttgaactacgtactaagtattaagtacgtcgtacgtaccgttcgagttctacgttacgttaccggcggtacggtaccagggtctacggataaccgtaacgtaaaccggtatcggngtcctaaccg

SEQ ID NO: 242294 - DNA, 752 bp, Homo sapiens
  misc_feature: GYAE6OF01BT04G.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctctcctcctgctattctggctcccagatatcactggagaaatagtgatgacgcagtctccaacactctgtctgtgtctcgagggacagtgcccacctctcctggcagggccagtcagtgtgtagcagactaacttagcccgtaggtacccagaccgaaggtaaacgtcgggcccagggtcctaccccgagggtcccttaccctctagtttccggttttacgggtgttcggtacccaccggttacgggggcccctccgtgggttcccggttaccccgtaggttccgtacgggtttaccagggtcggacctagggttcgggccgtttacgggacggggtaacagggtacgtttcaaccctccgtacacgtactcgagtcgacgtctacggctacggttctaggtagtttacttttacgggactttaagttttaagtaccgttgtaaacccgtagtaactaaacgtttaacttaacggtacgtaccggtttaaccggggtcccctttacgggcttttacgggacccttttaccggggtttaccggaccccgggggtaacggtaacctaaacgggttccgggtaaggggtaaaccctacgttaaaacccggaaccggttaaggttccccgggtacgggtatacccggg

SEQ ID NO: 242295 - DNA, 821 bp, Homo sapiens
  misc_feature: GYAE6OF01B8OKN.35.85.H08.1.454.CMB.1.raw
  modified_base (257)..(257): a, c, t, g, unknown or other
  misc_feature (257)..(257): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctcccagatactcgactggaagaaatagtgatcgacgcagtcctacccaacctctctgtctgtagtccgtccggaggggacagacgccctaccctcgtcgtcgcgacgggccagtcgagtagtcgtancgtagactaacttcggcctacggtaaccagcgaaagtaacgtcggaccacggtcctacccgtaggtccttaccgtactcgtttcgttaggtccgtacgtacccgtacgggtaccggtcccgttaccgttacggggtaccgttacccccgtaggttacggtaaccggggtttcaaacggggttcgggtacggacggttcggggtcccttaggggtaccgggaactacgggtttaccgttaccaacccgtttccaaccgttaaccgtacgtaaccgtaccggtacgtaccggtaccgtcggtaacgttaacgggtacgtttaacgggttaacgtttacgttttaacggtaacgttttaaacgttttacctttaacggttacggttaccgtaaacggttaaccgtttaaacgttaaacggttaaaccgtttaccgggtaccgttaccggttacccggttacgggttacgttccgttacggttaccgtttaccgggaccggtaaccgggtacggtaaggtccggtaggtaacgacgtaacgtaaccgtagtgggtaccgtcgtacccg

SEQ ID NO: 242296 - DNA, 817 bp, Homo sapiens
  misc_feature: GYAE6OF01EP960.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattcctggctcccagatatcactggagaaatagtgatgacgcagtctccaaccactctagtctgtgtctccaggggacagacgccaccctctcctgccgagggccagtacagagtcgttagcagctaacttagccgtggtaaccagacaagaaagttcggaccaggcctccccgaggtcctccgtcattccgttttggtcgtcgtacccacggtacggggcccgtcgttcgggtcgttcccccgaaggttccgtaacggggtttccagggttcgggaccgtaaggttcgggccttccggtaggggaactacgggtacgtttaccaaccgttcctaccgaaccctaacgttaccgaacggaccgaacggtcccttcggaccgttaacggttaccgttaaggtaaacggtttaacgttttttacgggaccgtttaaaggtttttttaactttaacccggttaggttaacctaagggaaccctttaaaagtttaaagttaaaacgttacggtaacccgtttcgggaaccccgtttacccggtaaaggttttcgtaacccggttttaaccggtttttaccggggaccccgggtttaaaccggggggaaacccctaaacggggttccgttaaaccgggggaaagtaaaccgttaaaccggtaaaaaccggtaacgtttacggggtcgggtaccgttaaccgg

SEQ ID NO: 242297 - DNA, 597 bp, Homo sapiens
  misc_feature: GYAE6OF01AHJ62.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctccacgggccagtcagagtgttagcagcaacttagcctggtaccagcagaagttggccaggctccaggctcctcagttcttggtgtcgtcccacgtcgggccgtcgttgggtcgtccccaggttccgaggtttcaggttcggcaggtcggcttcgtgggacaggtacgttcactcgtaccaccatcgacgcacgtcctgctagtcgtagtaagttattttgtacgttagtttacttacgttgtacagtactaattaataacgtagtcgtccggtaccttccgtagttcgtcgttacgttttcggaccggtaacgggtacccgtaggtacggtacggacgtaactaaccgtaaacggtaccgttaggtccggtacgtcgtaaccg

SEQ ID NO: 242298 - DNA, 750 bp, Homo sapiens
  misc_feature: GYAE6OF01DLAFJ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgcttattctggctccagatatcactggagaaatagtgatgacgcagtctccaaccactctgtctgttgtctccgaggggacagacgcctaccctctccgtgcgacgggcagtcagtagttgttagcgagactaacgttagccgtaggtaccaagaccgtaaaggtaaagttcggaccgacggcctaccccgaggtcccttcccttctaagtttccggtttttcggtcggttaccgtcccgtaacggttacggggtcccgtcgttggggttcctaccccgtaggttacgttaagggttccgtaagggttcgggacgttaggttcgggtacgtttcgggtacggggaactagggtaccgtttccgaaccctttcctaaccgaccgtactacgacggtacgacgtaccgttaggacctacgttacgtagggtaagtttacgttttacgtacgtttaagttttacgttaacgttcgtataacgtaactaaagttaacgttaattacggacgtttacgtccgttacgttacgttccggttacgttaccgttttacgggacccgggttaaacgggtaacccgaaggtccgtaaggtagtaaaccgtaacggaaacgttacggtacggtcgtcgtaccg

SEQ ID NO: 242299 - DNA, 737 bp, Homo sapiens
  misc_feature: GYAE6OF01B2DKB.35.85.H08.1.454.CMB.1.raw
  modified_base (175)..(175): a, c, t, g, unknown or other
  misc_feature (175)..(175): n is a, c, g, or t
  modified_base (200)..(200): a, c, t, g, unknown or other
  misc_feature (200)..(200): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggagaaatagtgatgacgcagtctccaaaccnctctgtctgtgtcctccgagggganagacgccaccctctctgcgagggccagtacaggtgttaggtagacgaacgtactaaacgtttacggccgttacggtaaccgagaaccgtaaggtaaaacggttcggacccgtagggccctaccccggaaggtcctaccgttactacgtttcgtttcggtgttccgtaccgtaacggttacgggccgtcgttacggtccgtaccgtaggtaccgtagggttccaggtcgggacgtaggtcggtccttacgggtacggggaactaggtaacccgtttctaacctctacccgaactacgacgacgcgacgtcctagccgtagtcctaagtaagttacgtttgaccgttaagttttacgtttacgagttaccgaagttaactaaaacgttaagttaacgtaacggtaccgtacggttacccgttacgggttaacgttccggttaacgttccggttaaccggacccggtaaggggttaacccaaggttcggtacgtaaagaacggttaaaccgaaacggttagtacgggtgtaacccgttag

SEQ ID NO: 242300 - DNA, 739 bp, Homo sapiens
  misc_feature: GYAE6OF01DFMJB.35.85.H08.1.454.CMB.1.raw
  modified_base (220)..(220): a, c, t, g, unknown or other
  misc_feature (220)..(220): n is a, c, g, or t
  modified_base (472)..(472): a, c, t, g, unknown or other
  misc_feature (472)..(472): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctccagatactcacgtggaagaaatgtgatgacgcagtcctaccaacctctctgtctgtcgtcctcggaagggacagccgcccacctctcngcgacgggcagtcaggtagtgtacgacagacctaacgtcgccgttacgaacgagacgaaaggtaacggtcggacccgaggtccctccgacggtcccttaccgtacgtacgtttcgtttggcgttcgtacccgtaacgggtaccgggccgtcgttcgggtccgtacccggtaggttacgtgggtttacagggtcggtcgaggttcggtactcgggtacgggaatacgggtaacttcgacttcctacaccgtanccgtaacgcgaccggtcctaggacgttacggttacgtaacgttaagttacggtttacgtacgttttaacgtttaacgttacgttaccggtactaaacggttaacctaaagttaagttaacgtacgtacgttccggttacccgtacggttacggttcgtaccgtttacccggtttacgggaaccggttaaccggggtaaacccgaggttacggagggtaataaacccggtaaccggtaaacggttcggtacggtaccggtgtaacccg

SEQ ID NO: 242301 - DNA, 617 bp, Homo sapiens
  misc_feature: GYAE6OF01AKZGZ.35.85.H08.1.454.CMB.1.raw
  modified_base (434)..(434): a, c, t, g, unknown or other
  misc_feature (434)..(434): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccgagggacgcccatcgcgtgcgaaggtccgggccaggacggtcgccccgtgaaccgtgaacggccaagtcgacgacccaagacgacggaccaaggtggttgtcggacgacccgtggacggacgcgtcggcccgtcggtccgacggcgacgcggccgtcggccctgcgtgcgtgcgtggtctcggctcgtcgtccgccngtcggcgtcgcgtcgccgaccgtagtcgtacgccgacgacgaacgggaccggacccacggccgtcggaccgcgtgtacgtcggacgtccgacgtccgacgtccgacgtaccggtcggccggtcggccggtggggccggacggtccgggtacgacccggtacccggacccggccctaaccccgg

SEQ ID NO: 242302 - DNA, 797 bp, Homo sapiens
  misc_feature: GYAE6OF01CHDHT.35.85.H08.1.454.CMB.1.raw
  modified_base (91)..(91): a, c, t, g, unknown or other
  misc_feature (91)..(91): n is a, c, g, or t
  modified_base (561)..(561): a, c, t, g, unknown or other
  misc_feature (561)..(561): n is a, c, g, or t
  modified_base (605)..(605): a, c, t, g, unknown or other
  misc_feature (605)..(605): n is a, c, g, or t
tcagtacagatcgtcacgaccggtgctcgatttagtatcactcagtcgcgggaggaactgctcagttaggacccagacggaaccatggaancccccagcgtcagtcttctcttcctcctgctacttcgtggcctccgagtatactctacgtggaagtaaattaggtcgactacggaaccgtcgtacggttcctacccaacctcttcgtcgttcgtcgttcgtccgtaccggaggggacacgaccgacccctaccccttcctccgacggccgaacggggtcctacgtcgaggtacgttcggtacgacctaggtacctaaacgttccgcccggttacggtaaccaggtaccaaaaggttaaacggttccggacgaccggtccctacccggacggtccttaccctacgtagtttccggtttggacgttccgtaccgtaacggtccgggtccgttcggtccgggtacccgtacccggtacggttcgtaccggttcgaacgggttcggacgtaggtcggtcgttaccgggagggtaactaggtaccgttctaccgtctaccgactntaccgagccgtacgtactcggacgtagtacgtaaggtacgtttntttaccggaatttacgtttactcgtacgacctaagttacctaaatacgttaacgtcgttaccgaccggttaccgtacgttggttacgtaccgttacgggtttacggaccgggtaaaccggtaagaacgggttcgacggtaaattacccggtaaaaccggaacggttacgggtacggtccggtactaacccgg

SEQ ID NO: 242303 - DNA, 731 bp, Homo sapiens
  misc_feature: GYAE6OF01EJY17.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtcctccaaccactctgtctgtgtctccgaggggacagacgcccaccctctccgtgccgagggccagtcagtagtgtagcagaccaacttagcctaggtaccagcaaggtaaacgttggaccaggcctacccgaggtcctcctcattcgtttggtgtcgtccaacgtacgggccgtgtaggtcgtacccgagttcgacggttcaaggtcgggctacggtcggtctcggtagggacaggtacgtttacaccgttctacccgaactactacgacgacgacgtcccgtgacgtacgttctaaggtaacgtttaagtttttcggaccgtttaaggtttttaacttaccgtttacggtacgtaacgtaacgttaaaatttaaacgtaaagtttacggtaccgtttacggggtaccccgttaaccggtacggtttccggttaccgtttaaccggtttttaccgggaacccggggtaacgggggttaaacccgaagggttacccgggtagggttaaaccggaaccgtttaaacggaaacccggttaaaggttcgggttacggaccgttaacccggg

SEQ ID NO: 242304 - DNA, 714 bp, Homo sapiens
  misc_feature: GYAE6OF01CGEK3.35.85.H08.1.454.CMB.1.raw
  modified_base (340)..(340): a, c, t, g, unknown or other
  misc_feature (340)..(340): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctaccaaccactctgtctgtgtcctccgaggggacagacgcccaccctctccgtgcgacgggccagtcagtagttgtagcagctaacttagcctggaccagcaaggtaacgttggaccaggcctacccgaggccctacctctagttcgtttggtgtcgtaccgtacgtacgggccncgttggtcgtcccagtcgtaggttcaggtggctaggtcgtcgtcgtgggactagtacgttcgacttcctaccgtaacctacgttacgaacgtccgtaacgtcccgttaggaccgtaaggttacgtaggtaacgtttacgtttttaccggaacgttttaacgttttaacgtttccgttaggttacctaacgtaacttaaagttaattaacgtacggttcccttaccgggacccgtttaccgggttacgtttaccggtaccgtttaccgggttttaccgggacccgggttaaacggggaacccttaagggtcccggttaggggaaaccttaggttaaacccgaacgggttacgttacgggtcggtaccgttacccg

SEQ ID NO: 242305 - DNA, 678 bp, Homo sapiens
  misc_feature: GYAE6OF01BJ6AL.35.85.H08.1.454.CMB.1.raw
  modified_base (149)..(149): a, c, t, g, unknown or other
  misc_feature (149)..(149): n is a, c, g, or t
  modified_base (163)..(163): a, c, t, g, unknown or other
  misc_feature (163)..(163): n is a, c, g, or t
  modified_base (188)..(188): a, c, t, g, unknown or other
  misc_feature (188)..(188): n is a, c, g, or t
  modified_base (244)..(244): a, c, t, g, unknown or other
  misc_feature (244)..(244): n is a, c, g, or t
  modified_base (485)..(485): a, c, t, g, unknown or other
  misc_feature (485)..(485): n is a, c, g, or t
tcagtacagatcgtcacgaccggtgctcgatttagtatcactcagtcgcgggggaggaactgctcagttaggacccagacggaaccatggaacgccccagcgcagcttctcttcctcctgctattctggcctcccagatatcactgganaaatagtgatgacntacgtctccaaccactctgtctgtntctcgaggggacagacgcccaccctctcctcgacggtccagtacagtaggtgttancgagactaacttacgtccgttacggtaccacgacgtaagtaaacggttcgaccgacggaccgtacccgacggtcctacccgtactacgttcgtttcggtcggttacgtccgacggtacgggcgtcgtgggtccgtccgtacggtctacggttcgtacggtggacgtacggttcggtctacggtacgggactaggtacttacgtactccgtaccacctactcgaaccgcgtaacgtccggtntactacggttagtaacgtaaggtttcgtttcgtaacttagttttaacgttaccttagtacccgtaagtactaaacgtttaagtaacgtagtccgttacgcccgttacgtgttacgtcgttacggttacgaccgggaacggtactaggtcaggtaacgacttaacgtaacggacgtaggcgttaagtcgtaacc

SEQ ID NO: 242306 - DNA, 636 bp, Homo sapiens
  misc_feature: GYAE6OF01BI8IF.35.85.H08.1.454.CMB.1.raw
  modified_base (327)..(327): a, c, t, g, unknown or other
  misc_feature (327)..(327): n is a, c, g, or t
tcagtacagatcgtcacgaccggtgctcgatttagtatcactcagtcggcgggggaggaactgctcagttaggacccagacggaaccatggaagccccagcgcagcttctcttcctcctgctattctggctcccagatatcactggaagaaatagtgatgacgcagtctccaaccactctgtctgtgtctccgaggggacagacgccacctctccgtgcgaggccagtcagagtgtagcagctaattagcctaggtaccagctaagaaggttcggcaggctaccgagcctcctatattcgtttggtcgtcgtaccacgtacgggccnttgggtctccgaagtccgagtttcgaggttcggactaggcggtctacggtggggaactaggtacgttacactcgtacaaccgtatacgatacgtacgactcgcgtacgttacgtagaagttacgtttagtaccttaagtttattacgtagtaactaaactaagttaataactagtacgtacggtccgtaccgtagttacgtacgttacgtttacggacccggtaagggtaacctaagtccggttaaggaaacgtaacgtaaaccgtaaaaccggtaacggttaggtaacgggtccgttaaggtaacccg

SEQ ID NO: 242307 - DNA, 657 bp, Homo sapiens
  misc_feature: GYAE6OF01DFUMF.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtcctccgaggggacagacgcccaccctctcctgcagggccagtcagagttgttagcagcaaacgttacgcctaggtaacccagaccgaaaggtaaacggttcggaccgtacgggtccttccccgacgggtccttcccgtactagtttccgttttgggtcgttcgtcccgtacgtacggggccgtcgtgggttcgtccccgtaggtcgtaggtttcaggtcggcgtaggttggcttcggtgggaaccaggttacgtcacttccgtaccacgtatccagtcacgcctgtcgtagttccgtagtaagtttacgtttacgtacttagttttactttactcgtactaagtaacttaagttaacgttaagtacgtcgttacgtaccgtcggtagttccgtacgttaccggtttcggaccgtaacgggtaccgtaggcggttaggagtaacgtacgaaacggtagtcggtcggtcgtacg

SEQ ID NO: 242308 - DNA, 827 bp, Homo sapiens
  misc_feature: GYAE6OF01CP2K4.35.85.H08.1.454.CMB.1.raw
  modified_base (180)..(180): a, c, t, g, unknown or other
  misc_feature (180)..(180): n is a, c, g, or t
  modified_base (188)..(188): a, c, t, g, unknown or other
  misc_feature (188)..(188): n is a, c, g, or t
  modified_base (207)..(207): a, c, t, g, unknown or other
  misc_feature (207)..(207): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtcctacccaaccactntgtctgtntcctccgaggggacagacncccacctctcctgcgacgggcctagccagtagttgttacgcagtactaacgttacggcccgttaggtaccaaggaccgtaaaggtaaaacggtttcgggacccgtaacgggtccgtaccccgaacgggtcccttaccccgttacgttaacgtttccggtttttcggggtacggtttaccggttacccgtaaccgggttaccggggtccccggttaccggttccgggggttaccgtacccccgttaagggttcccggttaacggggtttccgaacggggtttcggggtaccgtaacggggttccgggtacccgtttcggacgggggtaaccgtagggttaacggttttcccccgtaacgtttaccctacccgtaaccctaaggttacccgaacgggtaccgtaccggacccgttcggtaactacggttacttacgggtaagtttacgtttcggtaaccgttagttttacttacgtacgtactagtaacaagtttactaacgtcggttaccttacggtacccttagtacgttacgtccgttacggttccgggacggtaccggaacggtacgtcggtaggaacgttacgaaaccggttaacgtacgttcggtcggctacccgg

SEQ ID NO: 242309 - DNA, 661 bp, Homo sapiens
  misc_feature: GYAE6OF01EFLTZ.35.85.H08.1.454.CMB.1.raw
tcagtacagatcgtcacgaccggtgctcgatttagtatcactcagtcggcgggggaggaactgctcagttaggacccagacggaaccagtggaagccccagcgcagcttctcttcctcctgcctattctggcctcccagatatcactggagaaatagtgatgacgcagtcctaccaaccactctgtctgtgtctccgaggggacagacgcccaccctctccgtcgcgagggccagtcagtagtgtagcagactaacttacgccgtaggtaccagacgtaagtaacggtcgaccacggtcctcccgaggtcctctctagttcggtttggtcgtcgtccacggtacggccgtcgttggtccgtaccgaggtacgtaggttcgaggtcggctaggtcgggtctcggtagggactacggtacgttaccgaacctttccgaaccgtaaccgtataccggacgtaccgacgtccgtagccgtaaggttataacggtagttacttttacgactttaagtttactacgtacgtacaaggtacctaaattagtaagtcgtacgttcggaccgttacggtgtacgtccgttaggttaccgggacggtaacgggtacctaaggtcggtaaaggacgtaacgtaaaccgaaacggtggtacggtgccgtaccg

SEQ ID NO: 242310 - DNA, 647 bp, Homo sapiens
  misc_feature: GYAE6OF01EZSPN.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggcctcccaggcctcctcattcgtttggtgttcgtcccacgttacgggccgcgttcggtcgtccccaggtcaggtttcaggttggcaggtcggctcgtaggggactaggtacgtttcacgttcctcgaaccatccacgcctacgcccttggacctagttaccgtaggaaagttacgtttttacggaccttaagtttttaactttaccgttacggttaccgtaaggtaacctaaacgttaattaaagttacgtacgttacggtacccttaccggtaagtttcgtacccgttaacgttttaccgggacccggtaacggggtaacccaacggtcgtacggtaagtactaaccgaaaccgtaacgttggtcggccgtacg

SEQ ID NO: 242311 - DNA, 763 bp, Homo sapiens
  misc_feature: GYAE6OF01CCZB5.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgcttattctggctcccagatatcacgtggagaaatagtgatgacgcagtctaccaaccactctgtctgtgtctccgaggggacagacgccctaccctctctgcgacgggccagtcgagagtgtagcagacctaacgttagccgtaggtaccaagacgaaggtaaaggttcggaccgtacggcctcccgaggtccctcctctatttcggtttggtcgtcgtacccacggtacgggtcccgtcgtacgggttcccgtaccctaggtaccggtaggtttcgaacggtgggacaggttcggtccgtagggtacgggaacgtaggtaccgtttccaccgttcctacccgaacctacgtaccaacggtcccgtaacggtcccgtacgaccgtacggttaaccgttaacggtaaagttttcggtttttacgtaacgtttaaggtttttaacgtttaacggtcgttaactacggtaaacttaaagttaagttaacgttacggttacccggttcgggtaccccgttacgggttaacgttcggttacccgtttacggtttaaccggggaacccggttaacggggtaaccctaacgggttaccgtaggtaaacgttcgaaacgtaaaccgggtacgttcgggacggtcgtaaccgg

SEQ ID NO: 242312 - DNA, 857 bp, Homo sapiens
  misc_feature: GYAE6OF01E3ZXM.35.85.H08.1.454.CMB.1.raw
tcagtacagatcgtcacgaccggtgctcgatttagtatcactcagtcggcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcgacgggccagtccagagtgtagcgagctaacttgcctggtaccagcagtaagtcggcctagggcctcccgaggtcctcctacgtactttcggttttggcgttccggtacccaacggtacggggccccgtcgttcggggttccgtacccctaaggttccgtacggggtttaccagggttcggacgtagggtcggcgttaccggtaggggaactacgggttacgttaccgaccttcggtacctaacccgtacttcccgaacgtccggtaaccgtccccggttacggtaccgttaacgggtccgttaacggtaaacggtttaccgttttttaccggaaccctttaaaacccgtttaccgttaacgttttacgtaaaccgtaaacgttaaaccggttaaacgtttaaccggtaaccggggtaaccccggtacccccgggtaaccggtaaaccgtttacccggtaaccggttacccggtttaacccggggtaaccccggtaaaacggggggtaaccccgtaaacccgggttaaacgggttaaaccgggggaaaacgggtttaaaaaccgtttaaaaaaacgggtaacccggtttaggggttaccggtaacccgttacggtaaccccgtaaccccgtttaacgg

SEQ ID NO: 242313 - DNA, 727 bp, Homo sapiens
  misc_feature: GYAE6OF01DP8DG.35.85.H08.1.454.CMB.1.raw
  modified_base (175)..(175): a, c, t, g, unknown or other
  misc_feature (175)..(175): n is a, c, g, or t
  modified_base (287)..(287): a, c, t, g, unknown or other
  misc_feature (287)..(287): n is a, c, g, or t
  modified_base (719)..(719): a, c, t, g, unknown or other
  misc_feature (719)..(719): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatgtgatgacgcagtctccaacactntgtctgtgtctccaggggacagacgcccacctctcctgcgacgggccagtcagtagtgttagacagtcaattcgccttcggtaaccaggacaagtaaggttcggccacggcnccacggtctacctactagttcgtttaggtcgttaccgtacctacggtacggggcccgtcgttcgggtccgtaccccaggttaccgtagggttacgacgggtcggcgtaacggttcggacttcggtaggggaacccttaggttaccgtttacaccgtttaccgtacctaacctaccgttacgacggtaccgtacgtcccgtacgtaccgtaggttactacgtaacgttacgtttacgtacgttaacgttttacgtttacgtagtaccgtaacgtactaacgttaagttaagtacgttacgttaccggttaccgttaccggttacgggttactacccggttacgttttaccgggacccgtaaacggggtaaccaacggttaccgtacgggtacgtaaacgttaaccggtaacggtaaccgttcgggtaccggtntaacccgg

SEQ ID NO: 242314 - DNA, 729 bp, Homo sapiens
  misc_feature: GYAE6OF01ALBCA.35.85.H08.1.454.CMB.1.raw
  modified_base (263)..(263): a, c, t, g, unknown or other
  misc_feature (263)..(263): n is a, c, g, or t
  modified_base (437)..(437): a, c, t, g, unknown or other
  misc_feature (437)..(437): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctccagatatcactggagaaatagtgatgacgcagtctccaaccactctgtctgtgtctccgaggggacaggacgcccaccctctccgtgccagggccagtcagagtgttagcagcaacttacgcctggtaccngacgtaaggtaagttcggaccgaggtccttaccgacggtcctacccgttactacgtttccgtttagggtccgtacgttaccccgtacgtacgggggccccgtaccggttgggttacccgtaccccgagttccgtaacggtttcgaggttcggcttacggtcggtaccgttcggngggacctaggtcggtttaccaacccgttccttaccgaacctacgtcgtaacggacctaccggtccgtacggtaccttacggttacgtaacggttaaacgtttagtttaccggtacgtttaacgtttttaacgttaccggttcgtaacgtaacgtaacgtaaattacggtaaattcggtaccgttaccggtccgtaccgtaggttctaccgttaacgtttccggaccggttaacgggaacccgtaggtccgtaggactaaccgtaccgaaacggttgacggtacgtcgtaacg

SEQ ID NO: 242315 - DNA, 649 bp, Homo sapiens
  misc_feature: GYAE6OF01BVHHI.35.85.H08.1.454.CMB.1.raw
  modified_base (337)..(337): a, c, t, g, unknown or other
  misc_feature (337)..(337): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagagcccaccctctcctgcagggccagtcaggagtgttagcagctaacttacgcctacggtaccagacaaggtaaagttcggaccagggcctccccaggtcctcctcacttcgtttggcgtcgtccacgtacgggccgtnttgggtacgtcccagttcgaggttcaggtcggcaggttcggctcggtacgggacaggtcttcgactctacgacctatccgagcacgcctgctacgtacgttacggtaagttgttttcgacgtttagtttacttacgttcgtaacgtaacgtactaaattaacgtttaaacgtcggtaccgtttccggtcccgtttaccgggtaggtttccgtacgtttaccggtttaccgggaaccgtacgggggtaaccctaacgggtcgtaggggaacgttacgtaaacgtaaacgaacggttcggtacggccgttacgg

SEQ ID NO: 242316 - DNA, 813 bp, Homo sapiens
  misc_feature: GYAE6OF01A5I3N.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtcgtctccgaggggacagacgccaccctctcctgcgacgggccagtcagtagtgttacgcacgactaacgttacgccgtaggtacccagaccgtaaggtaaacggttcggacccgaacgggtccctaccccggaagggtcccctacccgttccgtaacgtttccgttttagggttacggttccgtacccgtaacggttaccggggccccggtcgtttacggggttccgtacccccgtagggttaccgttacggggtttcccgtaagggtcgggtaccgtacggggttccggggtccgttacgggtaaggggaaccttaagggtaccgttttaccaccgtttccctaccgtaacccacgttccgaagtcccgtaccggtcccgtaggacctaaggttccgttaaggtaagtttacgtttcgtaacgtttacggttttacttacgttacgtacgtaacgttaacctaaattaacgtaacgtacggttaccgttaccgggttaccctaccgggttagttacgttacccgttttaccggtttccgggaaacccgggtacggggtaaccctaagggttccgaaggaacgttaaccggtaaaccgtaaacggttacgtcgggttcgccgttaaccg

SEQ ID NO: 242317 - DNA, 821 bp, Homo sapiens
  misc_feature: GYAE6OF01DI19S.35.85.H08.1.454.CMB.1.raw
  modified_base (113)..(113): a, c, t, g, unknown or other
  misc_feature (113)..(113): n is a, c, g, or t
  modified_base (145)..(145): a, c, t, g, unknown or other
  misc_feature (145)..(145): n is a, c, g, or t
  modified_base (177)..(177): a, c, t, g, unknown or other
  misc_feature (177)..(177): n is a, c, g, or t
  modified_base (218)..(218): a, c, t, g, unknown or other
  misc_feature (218)..(218): n is a, c, g, or t
tcagtacagatcgtcacgaccggtgctcgatttagtatcactcagtcgcggggaggaactgctcagttaggacccagacgaaccatggaagccccagcgcagcttctcttccnctgctattctggcctccagatatcactggaanaaatgtgactgacgcagtcctaccaactactntagtctgtgtcgtccgaaggggacagcgcccaccgtctcgngtccgacgggcctagtcgaagtagttcgttacgacgagtacctaaacgttcgccgttaacggtaccgagtaccgtaaggtaaacggttcggacccgaggtccctaccgaaggtccctccggtctacgtttccgttaggcttcggtacccgtacggtacgggtcccgttgtcgggttaccgtaccgtaacggttcggttaacggttcgaacggttcgggactacggggttacggccggttaacgggtacggggttaaacgtaaccggtttacgttcccgaaaccgtttccgttaacccgaaaccgtacgttaaccggaaccgtacccgtaacggtcccgttaccggtacggttacgttaacggttacgtaacgtttacgtttacggacttttaacgtttacgtacttacgtacgtaacgtaacgtaaacttacgtaacggttacgtccggttaccgttaccgtacggttaccggtttgtaacccggttaccggttaccgggaaacccgggttaaacggtacccgttaacggtcggttaaccggaacttaacccggtaaaacgggtacccttaaaggggttccgtaaccggtccgttaaacccgg

SEQ ID NO: 242318 - DNA, 649 bp, Homo sapiens
  misc_feature: GYAE6OF01B4RJ0.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgcccaccctctcctgcagggccagtcagagtgtagcagctaacttagcctggtaccagcaaggtaagttcggaccaggcctcccgaggcctccgtctattcgtttggtgttacgtccaacgttacgggcccgtcgttgggttcgtaccccgtaggttccgtagggtttccaaggttcgggctaagggtcggcgttcggtacggggactaggtacgttcaacgtctacacctacgtcacgctacgccgtgacgtacgttacgtagaacgttagttttagacgtttaagttttacttaacgttgtactaagactaattaataagttacgtacgttcggtacccttacggtagtttacgtaaccgttttacggacccgtaacggggacctaaggtcgttagggaactaagttaaccgaaacggttaacgtagggtacgtcgttcgtaaccg

SEQ ID NO: 242319 - DNA, 685 bp, Homo sapiens
  misc_feature: GYAE6OF01DF3Y7.35.85.H08.1.454.CMB.1.raw
  modified_base (232)..(232): a, c, t, g, unknown or other
  misc_feature (232)..(232): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctaccaaccactctgtctgtgtctccgaggggacagacgcccaccctctcctgcacgggccagtcagngtgtagcagacaacttacgcctaggtacccagaccgtaagtaaaggttcggaccgacggcctccccgaggccttcctctacttcgtttggtcgtcgtccgtaacgtcgggccgtcgtggtcgtccccgagtcgtaggtttcaggtcggctaggtcggtctcggtagggacgtaggtacgttccgaactttccacctaacccgtactccgacgtccgaacggtcccgtggtccgtaacggttaccgtaggttaagtttacgtttttagtacgtttaacgtttttatttaccgttcgtactacgtaacttaaattaacgttaattacggtacgttacggtccttacggtacgttcgtacgtttaccggtttacggacccggtaaaggggtacccaacgggtcgtaagggtaactaacgtaacgtaaaacggtaccggttaggtcggtcgtacccg

SEQ ID NO: 242320 - DNA, 706 bp, Homo sapiens
  misc_feature: GYAE6OF01DCVN6.35.85.H08.1.454.CMB.1.raw
tcagtacagatcgtcacgaccggtgctcgatttagtatcactcagtcgcgggggaggaactgctcagttatgacccagacggaaccatggaagccccagcgcagcttctcttcctcctgctattctggctcccagatatcactggagaaatagtgatgacgcagtctaccaaccactctgtctgtgtcctcgaggggacagacgccaccctctcctgacgaggccagcagagttgtagcacgactaaacgttcgcctggtaaccagaccgaaggtaaagttcggaccagggtcccctaccgaggtcctaccctgtacgtttcgttttggtgttccgtaccgtacggtacgggtcccgtacgttcgggtcccgtcccgtaaggttccgttacgggtttccgaagggttcgggacccggttagggttccggggtacccttacggggtaacgggtaacgttaacgggtacgttacctaccgtcctacccgaaccgtacgtacaccgtacacgtcccgtagtacgtacgtcgtagtaacgtttcgtttcgtaactttagttttactacgttcgtacgtaagtaactaagttaactagtccgttcggtaccgttcccgtacgttcggttcgaaccctttggttcccggaacgggtacggtaacctaggtacgtaggtaagtaacctaacgtaaggtacggtgtcggtaccg

SEQ ID NO: 242321 - DNA, 771 bp, Homo sapiens
  misc_feature: GYAE6OF01A9DRQ.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtcgtctccgaggggacagacgccaccctctcctgcgagggccagtcagagtgtagcacgctaacgttcgccgtaggtaccagactaagtaaaggttcggaccaggtcctacccgaggtcctccctactacgtttcgtttgggtcgtcgtcccgtacggtacgggccgtcgttacgggtccgtaccccgtaggttccgtaggtttccgaaggttgggacctagggtcggtccgtacggtacggggactacggtacgtttccaaccgttcctaccgacctacgttccgaacgtccgtaacgtcccgttaggaccgttaacggtcgtttaaggtaacgtttacgtttttacgtaccgtttaacgttttaaccgtttaaccggttacggttaaccaacggttaaaccttaaaacgttaacgttaacggtaacgttccggttaacggtacccgttaccgttaaggttccggtaccgtttaaaccggtttcgggaacccgggtaaacggggtaccctaacgggttaccggtaacgggtaaacgttaaccggttaacccgaaaaccggttacgttccggttaggcccgttacccgg

SEQ ID NO: 242322 - DNA, 722 bp, Homo sapiens
  misc_feature: GYAE6OF01CFHWT.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggaagaaatagtagatgacgcagtcctaccaaccactctgtctgtgtcctccgaggggacagacgcccaccctctcctgcgacgggccagtcgaggtagttgtagacgagacctaattacgccgtacggtaaccagcgaaaggtaaaggttccggaccgaacggtccctacccgacggccttccgtactacgtttcgttttaggtcgttacgtacctacgggtacggtccgtcgtcggttccgtcccgtagtcgtacggttcgaggtcggactaggtcggtccttcggtacgggaacacggtacgttccgacttcctaccacctactacgacgccgtaccgccgttaggaccttaacggtacgttaagttaacgtttagttttcggtaacctttaagtttttaacctacgtttcgtaaccgtaagtaactaaattaattaacgtacggtcgttacccggtaccgttaccggttagttcgtaccggtttacgtttccggggaacccggtaaggggtaccctaaggtcccgtagggtaaactactaaccggtaaacgtacgttcggtacggtccgtaaccgg

SEQ ID NO: 242323 - DNA, 749 bp, Homo sapiens
  misc_feature: GYAE6OF01BR41Q.35.85.H08.1.454.CMB.1.raw
  modified_base (231)..(231): a, c, t, g, unknown or other
  misc_feature (231)..(231): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcacggccagtcagngtgttagcagactaacgttcgcctggtaccaggacaacgtaaacctcggtaccacggtcctaccccgaggtccctcctctatccgtagtgggtcaccacgtacccgaccgtacgggaccctacgtcgtacctcccgaagtccgtaggttcgaggtggacgtaggtcgggtcgagggacaggtacttccaccgttcgaccaccgtactaccgacgaccgtacgtccctacgacctaggttccttagaagtttgtaacgtttttacgacttttaagttttacttaccgttaggtaccgtaagttaccttaagtttaacgttaaccggttaacgttaacccggttccggtaccccggtttagggttaacccggggtttaacccgtttaccggggaacccgggtaaaacggggttaaccccggtaaacgggggttaccgtaaaacccggggtaacccttaaaacgggttaacccggttacgggttaacccgggtcggttacccgtaaccccgttaaacccgg

SEQ ID NO: 242324 - DNA, 678 bp, Homo sapiens
  misc_feature: GYAE6OF01BN63V.35.85.H08.1.454.CMB.1.raw
  modified_base (438)..(438): a, c, t, g, unknown or other
  misc_feature (438)..(438): n is a, c, g, or t
  modified_base (663)..(663): a, c, t, g, unknown or other
  misc_feature (663)..(663): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaactactctgtctgtgtctcgaggggacagacgcccaccctctcctgcgagggccagtcagagtgttagcagactaacttacgccgtaggtaccagacgaagtaaaggttcggaccgaggcctccgaggacctccgtctattcgtttggcgtcgttaccgcgtacgggccgtcgtcggtcgtacccgtagtcgtacggtttacgacggtggacgtaggtcgtacgtcggtaggaactaggtacgttcctaacgtctaccgaaccttacncgaaccggtcgacgtacccgtaggacgttacgtacgttaacggtaagtttccgttttagaaccttttaggtttaacttaccgttggtacaacgtctaaatttaagtagtacgtaccgttccggtaccgttcgttaggtttcgccgttttaaccggttcggaacccggtaagggtacccgaaacggcggtttaggaaacgtaacggttaacaaaacggtttaccgngggtcggtacaaccg

SEQ ID NO: 242325 - DNA, 809 bp, Homo sapiens
  misc_feature: GYAE6OF01DPDMM.35.85.H08.1.454.CMB.1.raw
tcagtacagatcgtcacgaccggtgctcgatttagtatcactcagtcgcgggggactgcttcagggcagttggtagatgcccctctgggagagatccccaggggtgacagccatggaccctgggaagggcctgggcgtaggggacagggaccagagccagtccagggagaggacagagccaatggacgtggggtgtactgtaacagccctgcgtggcgagacgggaccagggccaccgtcctcgagggacgccatcgctgcgaaggtccgggaccaggacggtcgaccccgtaggaaccgtacggaacggccaaagtcggaacgaaccccgaaaggaaccgacggacccgtaaaggtggggttacgtacggacgtaccccgtaggaacgggacgccggttcgggccccgttcgggtaccccgaggccgaacggccggtaccgtccgggcccctggccgtcggtccgttcggccggttcggggtcgtacgggtccgtacggttccggtcccgcccgtacggtccgggtcccgttcggcccgttacggacccggtacccgttaacgggttcgggtttacccgacccgaaacccgggtaaccggaaacccgggtcccgggggaaccccgtaaccggggtaccccgtacggggtacccgtacccgttaccggtaacgggttacgggaaccggtacgaaccgacccgggtactacccggaacgtcccggacgggaccgggacggtcccggttaggggacggggacccgtacgggtcccgacggaccccggaacccggtaccccgtaaaccccgg

SEQ ID NO: 242326 - DNA, 826 bp, Homo sapiens
  misc_feature: GYAE6OF01CEUSL.35.85.H08.1.454.CMB.1.raw
  modified_base (220)..(220): a, c, t, g, unknown or other
  misc_feature (220)..(220): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctaccaaccactctgtctgtcgtcgtccgaggggacagacgcccacccttctccnggcgaacgggcctggtacgagaggttagttacgacgagactaaacgttacggccgttacgggtaacccaaggtaccgtaaaaggtaaaaccgggtttcgggacccgtaagggtcccctacccggtaacgggtcccttacccttctaacgttttcgtttgggtcgttaccggtcccgacggtttaccgggggcccgtcgtttaacggggtcccggttacccgtacggtaccggttaacggggtttcgtaacggggtcgggtaccggtacgggttcggggtcccgttacgggtagggggtaaccccgtaggggtactttaccccggtaccttaccgtacccgtaacctaccgttacaaccggtaccgtaccgtccgtacgtacgtacggttaacgtaggttaacgtttacgtttacgttaccgttttagtttaacgtttacgtagttaaccgtaacgtacttaaaacttacgtaagttaacggtaccggtacgttcccgtaccgtacgtttacgtaccttacgggtttaccgaccgggtaacgggtaaccgtaggtacggaggtaacggtaacgtaccgtaaacggtagttacgtggacgttacccgg

SEQ ID NO: 242327 - DNA, 735 bp, Homo sapiens
  misc_feature: GYAE6OF01C8H4E.35.85.H08.1.454.CMB.1.raw
tcagtacagatcgtcacgaccggtgctcgatttagtatcactcagtcgcggggaggaactgctcagttaggacccagacggaaccatggaacgccccagcgcagcttctcttcctcctgctattctggctccagatatcactggagaaatagtgatgacgcagtctccaaccactctgtctgtgtcctccgagggacagacgccctacctctcctgcgacgggcagtcagtagtgttagcagactaacttacgccgtacggtacccagaccgaaggtaaaacggttcggccaacgggtcctaccccgaggtccctccgttactagtttccgtttaggtcgttaccgtacccgtaacggttacgggcccgtcgttcgggtccgtaccccgtaggtcgtacgggtttcgaggtcgggacgtaggtcggtcgttcggtagggtaacctaggttacgttaccaccgttctacccaccgtacgtaccgtacgtaccgtacggtcccgttggccgtaagttccgtaagttaaggttacttttgtacgtttagttttacttacgtagttaccgaacgttaactaaagttaacttaacgtacggtccgttaccggtacccgttaccggttagttccgtaccgttacggtttaccgggacccggtaaccgggtaaccgaaggttacggtacgggtaaacgtaaccgtaaacggtaaacggtcgtacgggtaccgtgtaacccgg

SEQ ID NO: 242328 - DNA, 731 bp, Homo sapiens
  misc_feature: GYAE6OF01BGDR8.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgccgacgggccagtcagagtgttagcagcaacttgcctggtaccagctaagaagttcggccaggcctccgaggtcctcctcattcgtttggtcgtcgtccctacggtacgggccgtcggttacgggtcgtaccccgtaggtccgtagggttcgagggttcggcgtacggtcgggtccgttcggtacggggacctaaggttacgttaccgtaacccttcgtaccctaccgtaacgtcccgtaaggacccgaacggtcccgtacggtacctacgggtttacccgtaaggttaacgggtttactttttcggtaaccgtttagtttttaacgttaaccgtttcggttacaacgttaaacgtaatttaagtaacgttacgtaccgttaccgggtacccgttacggtacggttttcgaccgttttacgggttacgggtaacccgggaggggtaacccgtcggtaccggtagggtaacgtacgtaaacgtaaaccgggttaatacgggtcggtacgtaccgg

SEQ ID NO: 242329 - DNA, 833 bp, Homo sapiens
  misc_feature: GYAE6OF01CAIES.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccacctctccgtcgcacgggccagtcgagagtgttagcacgacaacttacgccgtacggttaaccgacgacgaacgtaaaaggttacggccgaacggtcccgtcccgaacgggtccttcctcctaacgttcgttttcggtcggtcgtccgtaaccgtacggggcccgtccgttcgggtaccgtccccgtaacgttcgtaacgggtttccgaaggttcgggtacgacggttacgggtaccgtccgggtacgggtacgtaggtaacgtttccgacccgtttacctacccgtaaccgtactacgtaaccgtacctacggtacccgtggtaccgtacggttaccgtaacggttaacgtttacgttttttaccggacgttttaaacgttttaccggttttaacgtttacggttaaccgtaaacgtacgtttaaaacttaaggtttaaaccgttaacggtccggtttaccggtaccccgggtttaacgttacggtttaccggtaccgtttaacccgggttttaaccgggacccggttaacccgggggaaacccgttaacggtccggttaacgggttaaaccgtacgtaaaaccggtaaacggtaaacgttttccgggaacgggttcccgtaaacg

SEQ ID NO: 242330 - DNA, 711 bp, Homo sapiens
  misc_feature: GYAE6OF01B6DFX.35.85.H08.1.454.CMB.1.raw
  modified_base (225)..(225): a, c, t, g, unknown or other
  misc_feature (225)..(225): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaataggtgatagacgctagtcctaccaaccacgtctgtctgtcgtctccggaggggacagacgcccaccctctccnggacgacgggccaggtcaggtagttgtagacagtacctaacgttacgcgtaggtaaccagacgaaaggtaaacggttcggaccgacggtccgtaccgacggtcctacctctagtttcgtttggtcgtacgtaccgacggtcgggccgtcggttggtaccgtcctagtccgtaggttcaaggtggcgtaggtcgtcgtggtaacggacgtagtacgttcaccgttctacccgaacgtcgtacgacgtcgtaaccggtccgtacgcgttaacgtcgttaagttaacgtttacggttttacgacgtttaacgttttaatccgtaggtactagtaactaaaagttagtacgttacgtccggtccgtacgttacggttacgttacgtcccgtttaacggttcgggaaccgggtacgggtaactacgggttcgtaacgggtaaacgttaactaaaccgggtaaacgtaggtcggttaaacggtcctaaccgg

SEQ ID NO: 242331 - DNA, 755 bp, Homo sapiens
  misc_feature: GYAE6OF01E1I64.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtctccaaccactctgtctgtgtcctccgaggggacagacgcccaccctctcctgcgacgggccagtcagagtgttagcacgacaactttagccctaggtaccagccaaggtaaacgttcggacctaggccctcccgaggcctcctcacgtttcgtttcggtcgtcgtcccgacgtacgggcctcgttcgggtcgtccccgaggttccgtagggttacaggttcggacgagggtcgtcgtccggtagggaactacgggtacgtttccaccgttcctacaacccgtactacgaaccggtctacggtcccgttaggaccgtaacggttcctaaggtaacgtttacgttttacggtacgtttaacgtttttaacgttaaccgtttacgtaccgtaagtaccgtaaaatttaacgttaaagttaccggtaccgttaccgggttcccgttaccgggttaacggtttcggttaacccgtttaccgggttttaccggggacccggtaaccgggggtaaccgtaacgggttccgtaacgggtaaacgtaaccgttaaaccggaaacggtaaccgtttggggtaccggtcgttaacccgg

SEQ ID NO: 242332 - DNA, 703 bp, Homo sapiens
  misc_feature: GYAE6OF01CUT2U.35.85.H08.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (642)..(642): a, c, t, g, unknown or other
  misc_feature (642)..(642): n is a, c, g, or t
  modified_base (680)..(680): a, c, t, g, unknown or other
  misc_feature (680)..(680): n is a, c, g, or t
  modified_base (692)..(692): a, c, t, g, unknown or other
  misc_feature (692)..(692): n is a, c, g, or t
tcagtacagatcgtcacgaccggtgctcgatttagtatcactcagtcgcggggaggaactgctcagttaggacccagacggaaccagtggaagccccagcgcagcttctcttcctcctgctattctggcctccagatatccgatggaagaaatgtagaatgacgcagtcctaccaaccactctgtctgtacgtcnccgaggggacagacgccctaccgtctcnggacgacggccagaccgagtagtagtagacaagtctaaagttcgccttaacggacaagacgtaaggtaagtcggaccaggtccctacgcggtacctcgtactacgtttcgttggtcgtcgtaccgtaggtacggccggtacgtcgggttcgacccgtaaggttcgacggtttacgagggtcggttaccgaggtttcggccgttacggtacggaacgtacgggttacctttaccaacggtttaccgaccgttaaaccaacgttaaccgacggtaccgtaaccgggtcccttacggaaacgtaaccggttaacggttaacggttaaagtttgttttacgtaacgtttagttttaacgttacgttacggtacttaacgtaacttaattaacggttaatacggtaccgttcgaccgtacggtntacgtacgtacgttaggacccgaagtacgagtcagganacgacgaacgtncggtgctaacg

SEQ ID NO: 242333 - DNA, 693 bp, Homo sapiens
  misc_feature: GYAE6OF01A8MT0.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatgtgatgacgcagtcctccaaccactctgtctgtcgtcgtccgagggacagaccgcccaccctctccgtcgcgtacgggcacggtcagtgtcgtagacaggactaacgttcgtaccgtcggtaccacgcgaaggtaacgttcggaccgacggccgtcccgacggtacctcctctagttcgttcggtcgtcgtccgtacggtacggccgtcgttcggtccgtacccgagttccgtaggttcgaggttcggcgtacggtcgtccgtacggtcgggaactacggtcgttacgtaccgttaccaccgtactacgtaccacggctaccggcgttacgacgttacgtcgttaagtaagtttctttacggcgttttaacgttacgttaccgttggtacgaacgttaactaacttaacgttacgtacggttccgttacggttccgtaccggtttcgtaccgttacggttccgtttaccgggaccgtacgggtacgtacgacggtacgaacgtacgtaaaccgtaaggtaccgtcgttacggtccgtaaccg

SEQ ID NO: 242334 - DNA, 756 bp, Homo sapiens
  misc_feature: GYAE6OF01EQ5G8.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctcccagatactcacgtggaagaaatagtgatgacgcagtcctaccaaccactctgtctgtcgtctccgaggggacagacgccctacctctctgcgacggccagtcagtgtgtacgcagactaacgttcgcgtaggaccagacgaaggtaacggttcggaccgacggtccctaccgacgtccctacctcgttacgtttcggtttcgggtcgttaccggtacccggtaacggtcggggtcccgtacggttcgggtacccgttaccccgtaaggttccggtacggttaccggaggttcggcgttacggggtggtcccgtacgggtacgggaactacggttacttaccgacttcccgtaccaacggtactaccgacgtactccggtccgttagaccttaacggttaggtaaagttacgtttccgttttagtaactttaacgggtttttatacgtacgtaacgtacgtaacttaaagttaacgttacggtacgttaccggtcggttaacccttcggttacgttaccggttaccgtttaccgggttacgggaacccggttacgggtaactaccggttcgtaaggaactaacccggtaaaggttaacccgtagttacggttcgacgtaacccg

SEQ ID NO: 242335 - DNA, 571 bp, Homo sapiens
  misc_feature: GYAE6OF01A1G0E.35.85.H08.1.454.CMB.1.raw
  modified_base (229)..(229): a, c, t, g, unknown or other
  misc_feature (229)..(229): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagngtgttagcagacaacttagcctggtaccagcagaaagttgccaggcctccagcctctcattcttggtgtcgtccacgtacgggcctcgtgggtcgtccccaggtcgtaggttcgaggtgggacgtaggtcggctcgtgggacagtagttccacgtctccaccatcacgtcacgccgtgcagtctagtaagttactttgacttagttttatacgttgtaccgagtactaagttattaagtacgttcgacgggttccctacggtagttcgtacgttaccggtttcggaccggtaagggtacctaggccgtaggacgtagtaccaaacgttactggtgccgtacg

SEQ ID NO: 242336 - DNA, 813 bp, Homo sapiens
  misc_feature: GYAE6OF01CDOBF.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctccagatatcactggagaaatagtgatgacgcagtcctaccaaccactctgtctgtgtctccagggacagacgcccacctctcctgcaggccagtcagtagtgtacgacagactaacgttacgccgttaggtaccagtacaagtaaaggttcggaccacggtcctaccccgaggtcccttacctccgtaatttcgtttacggtcgttcggtcccctaaggtaccgggcccgtacgtcgggtccgtaccccgagttcgtaacggttcgagtcggcgtaggttcggcgtcgtaggtacgagttacgttcctacgttccacctactacgtacgacggactacggtacgtgaccgtacgttacgtaagtaacgttacgttttaacggaccgttttaaggttttaaccgtttacgttccgtaacgtaaccggttactaaaacgtttaacgtaaaagttttacccgggtacctttaaccggggtaccccctttaacggggtttacggtttaccggttaaacccgttttaccgggtttacccgggggtaaacccccgttaaaaccgggggtacccttaaaacccggtttccggggaaacgggtaaaacccggttttaaaccgtaaacccccgggtttaaaaaccggggtaacgggtttaccgggttaccgggtaacccggtttaacccgg

SEQ ID NO: 242337 - DNA, 532 bp, Homo sapiens
  misc_feature: GYAE6OF01A5VX9.35.85.H08.1.454.CMB.1.raw
  modified_base (377)..(377): a, c, t, g, unknown or other
  misc_feature (377)..(377): n is a, c, g, or t
  modified_base (397)..(397): a, c, t, g, unknown or other
  misc_feature (397)..(397): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaagttggccaggctccagctcctcatctttggtgtgtccacgtacgggccgctgggtcgtccccgagtccaggttccaggtcggctaggtcggctcgtgggacagacgttcacttcnccaccatcagcacgcctgcngtctagagtattttgcttagtttattacgtgtcagtacaattataagtagcgtgtcctcgtagttcgcttacgtttcggaccgtacggggaccaggtcgtaggagtagtaccgaaacgtagtcggtggcgtacgg

SEQ ID NO: 242338 - DNA, 821 bp, Homo sapiens
  misc_feature: GYAE6OF01DBPZC.35.85.H08.1.454.CMB.1.raw
tcagtacagatcgtcacgaccggtgctcgatttagtatcactcagtcgcgggggaggaactgctcagttaggacccagacggaccatggaagccccagcgcagcttctcttcctcctgctattctggctcccagatatcactggagaaatagtgatgacgcagtctccaaccactctgtctgtgtctccgaggggacagacgccaccctctcctgcaacgggccagtcagacgtgttagcagcaaacttacgccgtaggtaccaagtccgaaagaaagttcggaccaaggccctacccgaggccttcccgtctaacgttccgtttcggggtcgttacggtacccgaacggtaccggggtccccgtcggttcggtccggtacccccgtaggttcgaacggtttcgaacggtttcggggcctaggttcggtccggttcgttacggggaacagggtacgtttcccaacgttcctactaacccacttaccacgaccgacgacccgttgtccgaaggttaccgtagttaacgttaacgttttttacggacgtttaacgttttaacgtttacgtacggttacccgtaagtaaccgtaaattaaacgtttaaacgttacggtaccggttacgggttaccccgttaaccgggttaacgttttaccgggttaacccgttacccggttttttaccggggaccccggtaaaacggggggttaaccccgtaaacgggttcccggggtaaacgggtaaacgttaaaccggtttaacccggtaaaaaacccggttaacgggttacggggtacgggtaacccggttaaacccgggg

SEQ ID NO: 242339 - DNA, 768 bp, Homo sapiens
  misc_feature: GYAE6OF01C5WDF.35.85.H08.1.454.CMB.1.raw
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
tcagtacagatcgtcacgaccggtgctcgatttagtatcactcagtcgcgggggaggaactgctcagttaggacccagacggaaccatggaagccccagcgcagcttctcttcctcctgcttattctggcctccagatatcacgtggaagaaatagtgactgacgcagtctaccaaaccgctctgtctgtgtcctcgagggacagacgcccacccgtntccgngccgaagggcctagtcagtagttggttacgctaagctaagttacgccttggaaccagtacaaaggtaacgttcggaccaggcctaccgaggtcctacctctatttcgtttggcgttcaccgtacgacgggcctacgtggtccaccgtagtcgtagggttacaggtcggtacgtaggtcgggccttacggtaggggtaacaacgttccggttacctaaccgttacccacgtaacccgtaagtaccgtaacggtaccgtaagttcccgttaacggcgttaacggttacgttaaggtaaccgtttaagtttttaccgggaactttttaacggttttaactttaaccgttacgtttaacggtaaacggttaacttaaaacgtttaacgttaaacgtttaccggtaccgtttacgggttaccccgtttacggtacgtttacccggttaacgtttacccggtttaggggaacccggtaaggggtaacctaacgggtcgttaaggataaaccgttaaccgaaaacggttacgttcgggacgttcgtacccgg

SEQ ID NO: 242340 - DNA, 826 bp, Homo sapiens
  misc_feature: GYAE6OF01BIKXI.35.85.H08.1.454.CMB.1.raw
  modified_base (285)..(285): a, c, t, g, unknown or other
  misc_feature (285)..(285): n is a, c, g, or t
tcagtacagatcgtcacgaccggtgctcgatttagtatcactcagtcgcggggagaactggctcagttaggacccagacggaaccatggaagccccagcgccagcttcgtccttccgtccctgcctattcctggcctcccagatatcacgtggagaaatagtcgagtgacgctagtcctcccaaccactctgtcctcgtcgtctcccggagggaccagacgccctaccctctcctgccgagggccagtcaggagtgtacgcagctaacgttcgccttaggtaccngtacaggtaaagttcgaccgacggtcctaccccgaggtcctacctacgtaaccgttaccgtttggtacggttcgttacccgtaacggttaccggggtccgtacggttacgggttccgtaccccgtaggttcccgtaacggggtttccaaggttcggacgtaacggttgggtcccgttaccggttacggggaacctagggtaccgtttaccgaaccgttccgttacccgaacctattaccgtaacggtaccgtaccggtcccgttaacggaccgtaacggttaccgtaacgggttaacggtttaacgtttttacggtaaccgttttaacggttttaactttaacggtttcgtaaccgttaacggtaacttaaagttaaccttaaagttaccggttacgttaaccggtaccgttaccgttaacgttcggttaaccgtttaccggttttaccgggaacccggtaacgggggtaaccctagggttaccggtaggtaacgtaaaccgtacggaaaccgttacggtcggtaaccggtccgtaaccgg

SEQ ID NO: 242341 - DNA, 700 bp, Homo sapiens
  misc_feature: GYAE6OF01BFUR3.35.85.H08.1.454.CMB.1.raw
  modified_base (136)..(136): a, c, t, g, unknown or other
  misc_feature (136)..(136): n is a, c, g, or t
  modified_base (147)..(147): a, c, t, g, unknown or other
  misc_feature (147)..(147): n is a, c, g, or t
  modified_base (437)..(437): a, c, t, g, unknown or other
  misc_feature (437)..(437): n is a, c, g, or t
tcagtacagatcgtcacgaccggtgctcgatttagtatcactcagtcggcggggaggaactgctcagttaggacccagacggaaccagtggaagcccagcgcagcttctcttcctcctgctattctggctcccagntatcactgganaaatgtgactgaacgcagtctaccaacctactctgtcctgtgtccgtccgaggggacagacgcccacctctccgtgccgacgggaccaggtaccaggagttaggttacgactacgcgtaaaccgtttacgccgttacgggttaaccaacggaccgtaaaggtaaaacggttcgggacccgtaacggtcccgtaccccgtaacgggtcccttccgtacgtacgttccgtttggtacgttcgtaccgacggtacgggccgtcgttcggtctacccgtagtccgtaggttacncggtagcgtaggtcgtcgtcggtaggactacgtacgttcaccttctaccaccgtactccgtaagccgtaacgtccgtcggacgtacgttaccgtaaggttacgtttaagtttcgacgtttaagttttacgttacgtcgtacgtaacggtactaattaacgtaagtacgttccgtacgttccgtacgtaggtctacgttaccgttacgggaccgtacgggtacaggtcgtcggaataacgaacgtaacgtgtcggcgtgtaccg

SEQ ID NO: 242342 - DNA, 662 bp, Homo sapiens
  misc_feature: GYAE6OF01E2XXH.35.85.H08.1.454.CMB.1.raw
  modified_base (299)..(299): a, c, t, g, unknown or other
  misc_feature (299)..(299): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttagcctggtaccagcaagaagttggccagcctccgagctcctcattcgtttggngtcgtaccacgtaggccgtctggtctacccgagtcgtaggttcaggtcggcaggtcggtcgtcgtacgggactagtacgttcacttccgtaccaacctacgtaccgacgaccgacgtcccgtacgcctaacggttacgtacggtaagttagttttacgtaccgtttaacgttttaacgttacttagtacgaacgtacgtaaaattaagttaaataacggtccgtacggtcccttacggtagtttcgtaccgttaacgttttccgggaaccggtaaccggggtaacccaacggttaccggtagggaaacgtaaacggtaaacccgtaaaacggttaaccgttacggttccgggtcgtaacccgg

SEQ ID NO: 242343 - DNA, 783 bp, Homo sapiens
  misc_feature: GYAE6OF01BP0HN.35.85.H08.1.454.CMB.1.raw
  modified_base (237)..(237): a, c, t, g, unknown or other
  misc_feature (237)..(237): n is a, c, g, or t
tcagtacagatcgtcacgaccggtgctcgatttagtatcactcagtcgcggggaggaactgctcagttaggacccagacggaaccatggaacgccccagcgcagcttctcttcctcctgctattctggctccagatatcactggaagaaatagtgatgacgcacgtcctaccaaccactctgtctgtcgtcctccgagggacagacgccctacctctccgtgcgacggccagtcagngtgtacgcagactaacttcgcctacggtaccagaccgaaaggtaaacggtcggaccgacggtccctacccggtaggccttccgtactacgtttcgttgggtcgtacgtaccgacggtacgggccgtcggttcggtccgtaccgtaggttaccgtaggttccgaggtcggtcgtaggtcggtccgttacgggtacgggaaccgtaggtttaccgttccgtaaaccctccgtacccgaaccgtacgtaccgtacgaccgtaccgttaccgtacgaacgttacgtaacggtaacggttaacgtttgtttacgtaacgtttttacgtttaacttacggttagtacgtaacgttaaattaaacgttaaagttaccggtacgttaccgggttacgttaccccggttacggttaacggttaccggttaccgtttaccgggttacccggggaaccgggttaaaccggggtaaaccgtcgggttacggttaaggaaaaccgttaccgttaaaccgggtaaacgttacggttccgggtaacggttaacccgtaccg

SEQ ID NO: 242344 - DNA, 786 bp, Homo sapiens
  misc_feature: GYAE6OF01ALEAT.35.85.H08.1.454.CMB.1.raw
  modified_base (235)..(235): a, c, t, g, unknown or other
  misc_feature (235)..(235): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaacactctgtctgtgtctccgaggggatagacgccctaccctctccgtgccgacggggccagtcagngttgttagcagctaacttgcctggtaccagacaagaaagttcggcctaggccctcccgaggtcctacctcgtacgttcgtttggtacgtcgtaccgacgttacgggccgtcgtcggtccgtccaggtcgtacggttcacggtggacgtacggttcgccgttcggtacgggtaacgtagggttacgtttaccgtaaccgttcccgttaacctaaccctacggttacccgaagtccgtaaccggtcccccttaggtaaccggttacggttaccgtaaacggttaacggtttacgttttaccggtaaccgttttaaacggtttttaccttaacgggtttacgtaccgtaaacggttaacccttaaaagtttacgtaaaacgttcggtacccgttaccgggttacccgttaacccggttaggtttaccgtaccgttttacccgggtttaccgggaaaccccggtaccggggtaaccctaaagggtcccgttaaagggtaaacgtaaccgtaaacccggtaaacggttaagggtccgttaacgggccttaacccgg

SEQ ID NO: 242345 - DNA, 844 bp, Homo sapiens
  misc_feature: GYAE6OF01DILOJ.35.85.H08.1.454.CMB.1.raw
  modified_base (217)..(217): a, c, t, g, unknown or other
  misc_feature (217)..(217): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggaagaaatagtgatgacgctagtcctaccaaccactctgttctgtgtcctcgaggggacagacgccctacctcnccgtgacgagggccaaggtcaacggtagtaggtacgcaacactaaccgttacgccgtacggtaacctagaccgtaaggtaaacgttcggaccacggcctaccccgaggtcctcctactacgtttcgttttcggcgttacgtccaacggtacgggtcccgtaggttcggtacctccccgtaagttcgaacgggttctaagggtggtaccgtaggtcgggcccttagggtaccggggaatacgggtacgtttaccctaaaccgttcctaacccgaactaacgttaccgaacgtaccgtaacgggttcccctaagttccgtaaacgttaccggttaaaggttaacgtttaagttttacccggtaagtttaaacggttttacttttaacggttacgtacctaaacgtaaacgttaaacttaaattaaacggtcggttacccgtttaaccggtaccccgggttaaccgtacggtttaacggtaccccgttttaaacgggttttacccgggggaacccgttaaaaccgggggttaaccgagggttaaacgttacggggggtaaaacctaaaccgttaaaccggtaaaaaccgggttaaccggtttgggtaaacccgggtacccgttaaaccgg

SEQ ID NO: 242346 - DNA, 729 bp, Homo sapiens
  misc_feature: GYAE6OF01BBCWM.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctccagatatcacgtggaagaaatagtgatgacgcacgtcctacccaaacctactcttgtcttgtcgcccgtacgaggggacagaccgccctaccctcctccgtcgacgacggccaggtcgagtaggtgttacgacgacgaccgttaacgtacgtccgtacggtaaccgagacgaaaggtaacggttcggaccgaggccccgtacccgacggtcccttcctcttacgtttcggtttggttcgttcgacccgtacgggtaccgggtcccgtcggtttcgggtcctcccggtaggtccggtaggttccggtagggtcggtaccgtagggtccggtcgtacgggtcgggtaacgtacggttacgttcctacccgttctacccgaacgtcgtaccggaaccgtcccgtacggtccctacggtaaccgtaggtacttaggttaacgtttagttttaccgtacgttttacgtttactacgttctaacggtataacttaattaaagtacgtacgtccgttcgtcgtacgtacgttctacgtttcggttccggacggtacgggtacaggtcgaggtacacgtaacgacgtagtcggtccgtcgtaccg

SEQ ID NO: 242347 - DNA, 774 bp, Homo sapiens
  misc_feature: GYAE6OF01DSKX1.35.85.H08.1.454.CMB.1.raw
  modified_base (301)..(301): a, c, t, g, unknown or other
  misc_feature (301)..(301): n is a, c, g, or t
tcagtacagatcgtcacgaccggtgctcgatttagtatcactcagtcggcgggggaggaactgctcagttaggacccagacggaaccatggaagccccagcgcagcttctcttcctcctgctattctggctcccagatatcactggaagaaatagtgatgacgcagtctaccaaccactctgtctgtgtctccgagggacagacgccctaccctctccgtcgcgacgggccagtcgagtgtgtagcagcaactggctcgtacagacaagtaagtggccgacggccaccgcgcctccgtctnttcgttggtcgtcgtccgacggtcgggccgtcggtacggtcgtacccgtacggtcgtacgggttcgtagggtcggacgtagggttccggtcggtacgggttagggaaccgtagggtacgtttaccgtacctttccctaccgtaaccgtaacttacggaccggtacccgacgtcccgtaggtacgttaccgttagtaacggtttaaacggtttacgtttttacggtacttttaaggtttttaacctttacgttcggtttaacgaacggttaaacttaaacgttaaacgtttaaagttaccggttacccggttacggttacccggtttaccggttaacgtttcccggttaaaccgtttaccggggtttaccgggaaccgggttaaccggggtaacccgtaaaggtaccggtaggggtaaaccgtaaacgttaccggtaaaacggttaggttaccgggtcgggtacgtaaccccgg

SEQ ID NO: 242348 - DNA, 673 bp, Homo sapiens
  misc_feature: GYAE6OF01CYP54.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtcgtctccgaggggacagacgcccaccctctcctgcgacgggccagtcagtagtgttagcagccaacgttacgcctaggtaccagacgaaggtaaacgtcggccaggcctcccgaggtcctcctctagttcgttttaggcgttcgtcccgaagtacgggcccgtgttggtccgtccccgtagtcgtaacggttcagggtcgacgtaggtggtactcggtaggggaactaggtacgttcgtaccttcgtaccaccataccgacgtacctacgtcccgtgacgtacgtaccgtagtaacgttagtttcgtacgtttaacgttttagtttacgtgttaaccacggtaactaaagttaactaaagttcgtaccggttcggtacccgttacggtacgtttaccgtaccgttacggtttaccgggaccggtaacgggtacctaaggtccgtaagggaactaacgtaaacgaaacgtacgtacgggtcgtcgtaaccg

SEQ ID NO: 242349 - DNA, 755 bp, Homo sapiens
  misc_feature: GYAE6OF01C9DDT.35.85.H08.1.454.CMB.1.raw
  modified_base (147)..(147): a, c, t, g, unknown or other
  misc_feature (147)..(147): n is a, c, g, or t
tcagtacagatcgtcacgaccggtgctcgatttagtatcactcagtcgcgggggaggaactgctcagttaggacccagacggaaccatggaagccccagcgcagcttctcttcctcctgcttattctggctccagatatcactgganaaatagtgatgacgcagtctaccaaccgatcttgtcttagttcgtccgtaccgaaggggacagaccgcccctaccctctcctggccgagggccctaggtcagtagttggttacgcgagtacctaacgttacgtccgttacggtaaccaaggacgtaaaggtaaaacggttcggcccgtaacggtccgtaccccggacggtcccttacccgtacttacgtttcgttttaggggttccgttacgtcccgtaacgtccggggtccctagtcgggttccgcccgtagtacggtaccgttcgacggttacggcgtaggtcgaccgtttcgagggtaccaggttacttccaacgttcctcccgaatactaccgtacgaccgacgtcccgtaggactacggtttaccgtaaggttaacgtttacgttttcgtacgtttaacggttttactttaccgttacgttaccgtagtaaccgttaattaacgtatacgtcgttacgtacccgtgttacgttcgtaacgttcggtttacggaaccggtacgggtaacttacggtacgtacgggtaactaaaccggtaaccgtaaacggttagtcgggtagttccgtaacccg

SEQ ID NO: 242350 - DNA, 574 bp, Homo sapiens
  misc_feature: GYAE6OF01CUTH5.35.85.H08.1.454.CMB.1.raw
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
  modified_base (467)..(467): a, c, t, g, unknown or other
  misc_feature (467)..(467): n is a, c, g, or t
tcagtacagatcgtcacgaccggtgctcgatttagtatcactcagtcgcggggaggaactgctcagttaggacccagacggaaccatggaacgccccagcgcagcttctcttcctcctgcttattctggcctcccagatatcactggaagaaatagtgatgacgcagtctaccaaccactctgtctgtgtctccgaggggacagacgccaccctcnccngcaggccagtcagagtgtagcagcaaacttagcctaggtaccagacaagtaagttggccaaggcctccgaggcctcctcattccgtttggtcgtcgtcctacgtacgggctcgtggtcgtccgagtccaggttcagtcggctaggtcgcttcggtgggacaggtacgtttaccacttcctcaaccacgtacagacgacgtcctgcctagtacttagaagttatttacgacgttagttttacttacgtntactagactaataataactagacgtcgcctacgtacgttgtccttacgtttgaccgtaacgggtactaaggcgtaggacgactaacgtaaacgtagtcgtcgctacg

SEQ ID NO: 242351 - DNA, 773 bp, Homo sapiens
  misc_feature: GYAE6OF01BQPDX.35.85.H08.1.454.CMB.1.raw
  modified_base (763)..(763): a, c, t, g, unknown or other
  misc_feature (763)..(763): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattcgtggcctcccagatatcacgtggaagaaatgtgatgacgcagtctaccaacctactctgtctgtcgtacctccggaggggacaggacgccaaccctctcctgcagggccagtcaggtagtgttagcaggactaacgttcgccgttaggacccagaccaaggtaaaggttcggaccgcgtacctcccgaggtccctaccactacgttcgtttggtcgtacgtcccgtaaggttcgggccgtcgttacgggtacacccggtagttcgtaaacggggttcaagggtccgggtaagtacgggttacggtacccgttcgggtaacggggaacgttaacggtacggttttaccccaacgttaccgttaacccaccgtaacgttacggtaaccggtaccgaacccggttcttacggggaacctaacggtttacccggtaaaggttttaaaccggttgttttaacggtaacgtttttaaacggtttaagtttcccgtaaggtaaccgtaagttaaccgtaaattaacgtaaaccgtttgacccgttacgttaccgtacgttggaacgttcttacgggtacgaaccgggacgtaacgtacgccggtaaggtaaactacccgtaaacgttaaccggatccggggttanaccgtacccg

SEQ ID NO: 242352 - DNA, 782 bp, Homo sapiens
  misc_feature: GYAE6OF01CHMCW.35.85.H08.1.454.CMB.1.raw
tcagtacagatcgtcacgaccggtgctcgatttagtatcactcagtcggcgggggaggaactgctcagttaggacccagacggaaccatggaagccccagcgcagcttctcttcctcctgctattctggctcccagatatcactggagaaatagtgatgacgcagtcctaccaacctactctgtctgtcgtctaccgaggggacagacgcccaccctctcctgcgtacgggccagtcaggtagttgttagacagacctaacttagccgtggtaaccagacgaagtaaacgttcggacctacggcctaccccgaaggtcccttacccgtcgtaactttcgtttcgggtacgtacggttaccaacggttacggggcccgtcggttacgggtaccgtaccccgtaaggttccggtacggtttacgaagggttcgggacgtacgggttacggtccgttcgggtacgggaacgtagggtaaccgttttccgacccgtttacctaccgtaaccgtacgttacaacggtaccgaacgtcccgtaggtaccgtacggtaccgtaaggttaaacgttgttttacgaccgtttaagtttaccgtttacgttacgtacgaacgttactaaagtttattaaacggttacgtaccggttaccggtacccgttaccggtaaggtttccgtacgtttaaccgggtttacggaccccgggtaacgggtaacccaacgggttcggtaacggacgtaaacgtaacccggtaaacgtaccgtcggtaccgtgttaacccgg

SEQ ID NO: 242353 - DNA, 764 bp, Homo sapiens
  misc_feature: GYAE6OF01D54M7.35.85.H08.1.454.CMB.1.raw
  modified_base (330)..(330): a, c, t, g, unknown or other
  misc_feature (330)..(330): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgacccaccctctcctgcgagggccagtcagagtgtagcagcaacttgcctggtaccagcaagaaacgttgaccaggcctcccgacggtcctacctctattcgtttggtgtacgtccacggtacgggcntggtctcccgagtccgtaaggttccaaggttggaccgtaggtcggtccttacggcgggaacgtaggtaacgttccaaccgttctacccaaccgtattacccgacgaccgtacggtcccttacggtacgtaacggtttacgtacggttaaacggtttagttttttaacggaccgttttaaaggtttttacctttaacggttcgttaacctaaggtaaccctttaagtttaaacgtttaagggtaaactttaaccgtacccggggttacccgttacccggggtttagggtaaccccgtttaccggggacccgtaaaaccgggggtaaacccggtaagggaaaccggggtaaaccgttaaccccggtaaaacgttaacccgggttgggtaccgggtaacccgttccgggaaaccttaaccccgtaagtttaccccgg

SEQ ID NO: 242354 - DNA, 766 bp, Homo sapiens
  misc_feature: GYAE6OF01CFLE6.35.85.H08.1.454.CMB.1.raw
  modified_base (148)..(148): a, c, t, g, unknown or other
  misc_feature (148)..(148): n is a, c, g, or t
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaanaaatagtgatgacgcagtctaccaacctacttctttctgtgtcctccgaggggacagacncccacccttctcctgcgacgggccagtcagagtgtagnagctaacgtgccgtagaccagacaagtaagtcggaccgaggcctcccgaggtccctcctctacgtttcgtttggtacgttcgtcccgtaaggttacggggtcccgtccggttgggttcctccccgtaagggttccgtagggttcgtaagggtccggtcgagggttcggccgttcggtacgggactagggtacgttccctacgtcctacccgtaactacttaccgacggtaccgacggtccccgtagtaccccgtagttaccgttaaggaaacgtttttcgttttacgacgttttaaggttttactttaaccgttgtttaaccgtaacgtaatttaaacgttaaagttaacggttacgtaccggtttcggtaccccgttacggttacggttaccggtaccgtttacggtttacccggggaacggtaacccggggtaaaccgtacgggtacggttacggtaacgtaaacgttaaacccgtaaacgggttacggtaggttaccggcgttaaccggtaacccgg

SEQ ID NO: 242355 - DNA, 827 bp, Homo sapiens
  misc_feature: GYAE6OF01C9FS3.35.85.H08.1.454.CMB.1.raw
  modified_base (176)..(176): a, c, t, g, unknown or other
  misc_feature (176)..(176): n is a, c, g, or t
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
tcagtacagatcgtcacgaccggtgctcgatttagtatcactcagtcgcgggggaggaactgctcagttaggacccagacggaaccatggaagccccagcgcagcttctcttcctcctgcttattctggctccagatatcacgtggagaaatgtgatgacgcagtctaccaaaccnctcttagtctgtgtccnccgaggggacngaccgccctacccgtntccngcgacgggccagtcagtagtgtaagcagccaattacgcctacggaccagacgtaaggaacgttcggacccaaggtccctaccgaggtcctcccgtactacgtttcgtttggtcgtacgtacccgaaggtaccgggtcctaacggttggtaccctacccgaagttccgtaagggttacccagggttcggaaccgttggttcggtaccgttacgaggggtaaaccagttaaccgtttccacgttacctaacgaccgtacgttaccacgtactaccggtaccgtacgtaccgtaacggttaacgtaacggtaacgtttacgttttacgaccgttttaacggttttaaccctttaaggttacgtaaccgttaacggtaaaccgtaaagtttaaaagtaaacgttacgtacccggtttaccgggtaacccgttaccggtaaaccggtttaccgttaacccgggtttaaccggtttacggggtaaccccggtaaacccgggggtaaacccgtaacggttaacccgggttaacggtaaaccgttaaaccgttaaaccccgggaaaaacgggtttacgttaaccgggtccggttaaccgggtaaaccccgg

SEQ ID NO: 242356 - DNA, 652 bp, Homo sapiens
  misc_feature: GYAE6OF01BQIJ9.35.85.H08.1.454.CMB.1.raw
  modified_base (534)..(534): a, c, t, g, unknown or other
  misc_feature (534)..(534): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtcctccgaggggacagacgcccaccctcctcctgcagggccagtcagagtgttagcagctaacgttagccgtcggtaccagcaagtaagtcggccacggcctccgaggcctcctactacgttcgtttggtgttcgtcctagtacgggccgtgtcggtcgtcccgagtccgtaggttccgaggtcggcgtaggtcggtactcggtgggacaggtacgttcgtacctctaccgacctactcgacggtcacgcctgccgtaggtcagtacgttagtttcgaccgtttagtttacttactaggttaccagtactaaagttagtaaacgtccgtccgtacggtcctacccggtnttcggtaccgttttacggttccgggaacccgggtaagggacccctaaaggggtcccggtacggtaaacgttaccgtaacccggtaaaacgggtacttacggggttacgaccgtaccgg

SEQ ID NO: 242357 - DNA, 682 bp, Homo sapiens
  misc_feature: GYAE6OF01ERLGD.35.85.H08.1.454.CMB.1.raw
  modified_base (634)..(634): a, c, t, g, unknown or other
  misc_feature (634)..(634): n is a, c, g, or t
tcagtacagatcgtcacgaccggtgctcgatttagtatcactcagtcgcggggaggaactgctcagttaggacccagacggaaccatggaacgccccagcgcagcttctcttcctcctgctattctggcctcccagatatcacgtggaagaaatagtgatgacgcagtctaccaacctctctgtctgtcgtcctccggaggggacaggacgcccaccctctcctcggcgacgggccagtccaagtagttgtacgcagacctaacgttcgaccgtaggtaccaaggacaaggtaaacgtgggccaggtcccctccgacggtccctcgtactaggtttcgttggtcggtccgtacccgtaacggtcgggtccgtcggtttcggccttaccccgagggttaccctaagggttcgacggtcggacggttaggtccggtacttcgggtaacggacgtaaggttccgtacctacgtcctacgaaccgtagtccgacgtccacgtcgtacggacttacgtacgtacgttaagtttcgtttcgaacgtttagtttacttctaggtacagtaactaacgtatacgtacgccgttcgaccgttagtgttccgtacgtttacgtacgggacccgtacgggtaacncggtgtacggaataacgtaccgtaaacggtcctcgggtccgtagaccg

SEQ ID NO: 242358 - DNA, 745 bp, Homo sapiens
  misc_feature: GYAE6OF01A25GA.35.85.H08.1.454.CMB.1.raw
  modified_base (110)..(110): a, c, t, g, unknown or other
  misc_feature (110)..(110): n is a, c, g, or t
  modified_base (560)..(560): a, c, t, g, unknown or other
  misc_feature (560)..(560): n is a, c, g, or t
tcagtacagatcgtcacgaccggtgctcgatttagtatcactcaggtcgcgggggaggaactgctcagttaggacccagacggaaccatggaagccccagcgcagcttcncttcctcctgctattctggctcccagatatcactggagaaatagtgatgacgcagtctccaaccactctcgtctcgttgtctccgaggggaccagtacgcccacctccgtcctgcacgggccagtcacgtagtgtagcacgacaacttagacccgtaggtaccagtactaggaaagttggacccaggcctaccccgaggtccctccgtacactttccggtttggttacgtcgttacccgtacgttaccgggggtccccgcgttcgggtttcgtacccccgtaagggttaccgtacggggtttaccaacgggttcggggaacctacgggtccggtcggttaccggtttaggggaacgttacgggtacgtttcccaacctttccgtacctaaccctcgtacccgacggtacctaaccgggtcccttagccgtaaggttcctaggtaacgttntttaccggacgttagttttactacgtagtactaagtactaagtacttaagtacgtacttccggacctttacggtacttccggtacctttaccgggttacggaacccgggtaaggtaacccgtagggtacccgtagggaacttaacccggaacgaacggttaacggtcggttccgggacttacccg

SEQ ID NO: 242359 - DNA, 791 bp, Homo sapiens
  misc_feature: GYAE6OF01B1GA4.35.85.H08.1.454.CMB.1.raw
  modified_base (198)..(198): a, c, t, g, unknown or other
  misc_feature (198)..(198): n is a, c, g, or t
  modified_base (261)..(261): a, c, t, g, unknown or other
  misc_feature (261)..(261): n is a, c, g, or t
tcagtacagatcgtcacgaccggtgctcgatttagtatcactcagtcgcgggggactgcttcagggcagttggtagatgcccctctgggagagactccccaggggtgacagccatggaccctggaagggcctgggctagggacagggaccagacgccagtccgagggagaggacagacgaccaagtggacgtggggtntacgtgtaacacgccctgctggcgaggacgggaccgagggaccacccgtcctccgacgggacncccaatcgactgacgaacggtcgggcccaaggcggtccgaccccgtagaaccgtacggaacggacaagtcgaaccgaacccaaggaccgacggaccgtaagggttcgggttacgtacggaccgtaccccggtagggaacggtcgccggttaccgggccccgtccgggtacccgacggggaccgtacggcccgtccggtcccggtcccctgggcccgtcggtccgtcggtaccggttcgggtaccgtcggtacccgtacgggtccggtacccgtccggacgttccgggtccgtagccgtccggaccgtaccgtaacggttcggtaaccgacccgtaaacccggaaccgggaacccgggtaccccgggaaacccgtacccgggtacccggtaccggtaccgtacccggttaacgtacgggtaaccggacggtaccgaccgacccgtacgtcccgtacggccgtaccgggaccgtcggtccggtcgggtccgacgttccggacccgtaccgacccggtaccgacccgtacccg

SEQ ID NO: 242360 - DNA, 788 bp, Homo sapiens
  misc_feature: GYAE6OF01C5N3P.35.85.H08.1.454.CMB.1.raw
  modified_base (148)..(148): a, c, t, g, unknown or other
  misc_feature (148)..(148): n is a, c, g, or t
  modified_base (683)..(683): a, c, t, g, unknown or other
  misc_feature (683)..(683): n is a, c, g, or t
tcagtacagatcgtcacgaccggtgctcgatttagtatcactcagtcggcggggagaactgctcagttaggacccagacggaaccatggaagccccagcgcagcttctcttcctcctgcttattctggctccagatactcactggaanaaatgtgatgacgcagtcctaccaactctctgtctgtgtcctcggaggggacagtacgcccacccttctaccgtggaccggacgggccctaaggtccgtaaggtacggtttacggttacgacctaggtaaccctaaacgtttacggcccgttagggtaacccaggtaaccgtaagggttaaaacggtcggtacccgacgggtaccctaccccgtaacggtccttccgtacctttaagtccgtttttaggggcgttccgtacccgtaacgggtccggggtcccgtcggttcgggtacccgtacccgaggtttcgaacggtttcggtacgggttcgacgtagggtcgtccgttagggacggaactcgtaactcgacttccacgtacacgtcacgtccgtagccttagacgtacgttacgtacggtaagttttacgtttacgtacgtttacgttttaacttcggtagtaaccggagttaactaacgttaaagtaccgttaggcccgttacggttcccgttaacggtcggtttaaaccnccggttttaacgggttaccgaccgggttaacgggaacttacgggaacggttccgaaacgttacggtaaaccaaaagggtttcccgaggttaccgtggtaaacccc

SEQ ID NO: 242361 - DNA, 805 bp, Homo sapiens
  misc_feature: GYAE6OF01EYSQB.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgagggacagacgccaccctctcctgcgacggccagtacagtacgtgtacgcgacgacctaacgttagcccgtacggtaaccagacgtaaggtaaaacggttcggacccgacgggcccctaccgacggtcccttcctcgttacgtttcgtttggtcgtcgtacccgtacggtaaccgggtccgtcggtcggttccgtccccgtagttcgtaggttcgtaggtcgcgtaggtcggtccgttacggcgggtaactacgggtacgttacctaccgttctaaccctacccgtaatacccggaacgccgtaccggtctacggtaacgtcggttagtaacggtaaagtttcgttttacgtacgtttaacgttttacttacggtcgttaactaacgtaactttaaagtaatttaaacggtcgttaccggtacccgttacccggttacggttagttaccccggttacccggttttaacggttaccccggggtaacccggggttaaacgggaaacccggttaacccgggtcggggtaaacgggtaaaacgtttaacccggttaaaaaccccgggttaaaacggttaaacccggtttcggggtaacccggtaacccgtaacccggg

SEQ ID NO: 242362 - DNA, 810 bp, Homo sapiens
  misc_feature: GYAE6OF01EI7IX.35.85.H08.1.454.CMB.1.raw
  modified_base (187)..(187): a, c, t, g, unknown or other
  misc_feature (187)..(187): n is a, c, g, or t
  modified_base (240)..(240): a, c, t, g, unknown or other
  misc_feature (240)..(240): n is a, c, g, or t
  modified_base (474)..(474): a, c, t, g, unknown or other
  misc_feature (474)..(474): n is a, c, g, or t
tcagtacagatcgtcacgaccggtgctcgatttagtatcactcagtcgcggggaggaactgctcagttaggacccagacggaccatggaagccccagcgcagcttctcttcctcctgcttattctggcctcccagatatcactggagaaatagtgatgacgcagtctaccaacctactctgtctgtntcctccgaggggacagagcccaccctctcctagcagggccagtcagatgtacncgaagcaacgttacgaccgtggttaacccgagaccgtaaggtaaaacggttcggaccgtacggtcctacccgaacggtcctcctctacgtttcggtttggtcggtcgtaccacggtacgggcccgtggtcgtcgtccctaaggtcgtacggttcaggttcggacgtacggtcgtacgtcggtaacgggataaggtacgtttaccgacgttaccctacgaacctacgttacgacnccgtaaccggcccgttaacggacttaacgggttccctttaaacggtaaagggttttacgttttttacggtaaacggtttttacgttttaaaaccgtttacgtttaacccgggttaccgaaacggttaaccttaaaagttaaacggtttaaaaccgttaccggttaccggtttacccggtaccccgttaccgggtttaagttcccgggttacctttaaccggggtttaccggtaacccggggtaaaccgggttacggaacggttacggtaacggttaacgtaacggtaaaccccgtaaaacggttacccgtaggggttaaccggcctttaaaccggg

SEQ ID NO: 242363 - DNA, 582 bp, Homo sapiens
  misc_feature: GYAE6OF01A5Y03.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggcctcctcatctttggtgtcgtccacgtacgggccgcgttgggtcgtcccgagttccgtagggtttcagggtcgggctagggttcggccgttcgtggggactaagggtcgtttacccgacttcctaccaaccctatccgaagcacgtcctagcctagtcctagaagttagttttgacttagttttacttacttcgtcgtaagtctaaattataagtagtcgttcggtccgtcgtacgttcgtccttacgtttcgggccgtagggacctaggcgtaggagactacgaacgtatggtcgtcgtcg

SEQ ID NO: 242364 - DNA, 869 bp, Homo sapiens
  misc_feature: GYAE6OF01DO2FR.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtcctccgaggggacagacgcccaccctctcctgcagggccagtcagagtgttagcagactaacttacgccttacggtaccaggaccgtaaggtaaaacggttcggacccaacgggtcctaccccgacgggtcccttaccccgttactagtttccgttttgggtcggttcggtacccgtaacggttaccggggcccgtccgttgggttcctacccccgtaggttccgtaacgggtttccgaagggttcgggaccgtagggttcgggaccgtttccggtacgggggtaacctaggggttaccggtttccaaccgtttccctaacccgtaacccgtaacgttaccgaaccggtaccgtaacggtccccgttcggtaccgtaacggttaccgttaacggttaacgtttaacgtttttacggttaccgtttaacggtttttaacgttttaaccgttacggtttaaccgtaacggttaaccttaaacgtttaacgtttaaacgttaaccggtaccgtttaccgggttaccccgttaccggttaacggtttaccggttaccgttacccggtttttacgggacccggtaaaccgggggtaacccgtaaacgggtacccggttaagggtaaccgtaaacgttaaacccggtaaaccggttaaccggttacgggttacggtaccggtaacccgg

SEQ ID NO: 242365 - DNA, 805 bp, Homo sapiens
  misc_feature: GYAE6OF01CST3E.35.85.H08.1.454.CMB.1.raw
tcagtacagatcgtcacgaccggtgctcgatttagtatcactcagtcgcggggagagctctgggggaggaactgctcagttaggacccagacggaaccatggaagccccagcgcagcttctcttcctcctgctattctggctcccagatatcactggaagaaatgtgatgacgcagtcctaccaacctactctgtctgtcgtctccgaggggacacgacgacccctacccttctcccgtggaccgacggggaccctaggtcaaggtagttgttaagccgaaggtacctaaaacgtttacgcccgttagggtaaacccaggtaccgtaaaggtaaacggttcggaccctacgggtacccttacccgacggtcctcccgtactagtttccgtttggtacttcgtaccctacggtacggggcccctgttacggtccgtccccgtaaggttccgtaacgggtttccaagggttcgggaccgttagggttcgggccttacggttaggggaaacctaggtacgttcctacttcctaccgtaacctacgtacgaacggcaccggtccgtacgtcgtaacggttacgtaaggtaacgtttagttttacgaacgtttacgttttaacttacgttcggttaacctaagtaaacgttaaacttaaagttaacgtacgttaccggttaccggtacccttacgggttacgtttaccggtacccgttttaacggttttaccggggaacccggtaaccggggttaaacccgtaagggttaacccgtagggaaacgtaaccgttaaaccgtaaaaaccggg

SEQ ID NO: 242366 - DNA, 892 bp, Homo sapiens
  misc_feature: GYAE6OF01ANHBU.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtcctaccaaccactctgtctgtgtctccgaggggacagacgcccaccctctcctgccgagggccagtccagagtgtagcagctaacgttgccgtggtaccagcaagtaacgttcggccaggcctacccgaggtcctcctctacgttcgtttggtcgtcggttaccacggtacgggtccctgtcgggttcctcccgtagtccgtaggttcgaggttcgggaccgtaggtcggtccgtttaccggtacggggaaccctaaggggttaccctttaccgacccgtttaccgtacccgtaacccgttaactacccggtaacggtccgtaacccgggttcccttaccgggtaacggttaaccggttaccggttaaaggtttaaaccgggtttaccgttttttacgggtaaaccccgtttttaacggtttttttaacccgttaaccggtttccggtttaaacccgtaacgggtttaacccgtttaaaaagtttttaccggtaaaaggtttacccggttaccggttaccccgggttaaccccggttttaacccgggttaccggtttaccggttcccggtttttaaaccccggggttacccgggggtaaacccggggttaacccggggttaaacccgggaaccgggtttaccgggtaaacccgggttaacgttaaacccggttaacccggtaaaaccgggtacgttttaccgggggacccggttcggtaaccccgg

SEQ ID NO: 242367 - DNA, 214 bp, Homo sapiens
  misc_feature: GYAE6OF01AF4W7.35.85.H08.1.454.CMB.1.raw
tcagtacagatcgtcacgaccggtgctcgatttagtatcactcagtcggcgggggaggaactgctcagttaggacccagacggaaccatggaagccccagcgcagcttctcttcctcctgctattctggctcccaggaactgtggctgcaccatctgtcttcatcttcccgccatctgaacgatctgtactgagcgggctggcaaggcgcatag

SEQ ID NO: 242368 - DNA, 630 bp, Homo sapiens
  misc_feature: GYAE6OF01APWPA.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtcctccaaccactctgtctgtgtctccaggggacagacgccaccctctcctgcagggccagtcagagtgttagcagcaacttagcctggtaccagcaagaagtggccaggcctccaggctcctcattctttggtgtcgtaccacgtacgggcctgtggtcgtcccgtagtccgtagggttccaggtcggcgtaggtcgggtcctcggtaggggactacggtacgtttaccaccttcctaccaccgtatccgacggtccgtacggcctaggacctacggtcgttaaggtaagttacgttttcgacgtttaagttttactttacgtcgtacgtaacgtactaaatattaacgttagtccgttcggtacccttacggacgtttcgaccgtttacgtttcggaaccggtacggggtacccaaggtcggtacggagtaacgtaacgtaaaccgtagtcggtcggcgtaccgg

SEQ ID NO: 242369 - DNA, 848 bp, Homo sapiens
  misc_feature: GYAE6OF01ED3M6.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctccgtgcgacgggccagtcgagagtgttagcagactaacgttagccgtaggtaccagacaaggtaaacggttcggaccaggtcctacccgaggtccttccgtctagtttcgtttagggtcgttcggtacccgtacggtacggggcccgtcggttcgggtaccgtaccccgtaggttaccggttacggggtttaccgaagggttcggggtaccgtaagggttccgggtccgttacggggtacggggtaaccgtagggtttaccgggtttaccaaccccgtttaccgttaacccgaaaccctacgttaaccggtaacggtacccgtaacggtcccgttcgggtaaccgtaacgggtttaccgtaaaggttaaggttttaacgtttttaccgggtaacgttttaacgggttttttaacctttaacgtttacggttaacgtaacggttaaccttaaaagtttaacgttaaagttaccgttaccgggtttaccggtaaccccggtttaccgggttacggttaccggttacccggtttacggttttacccgggacccgggtaaacggggtaaccccgtaaggtacggtacggtaacgtaaccgttaaaccgtaaacggttacgttacggtcggtccgtaaccg

SEQ ID NO: 242370 - DNA, 768 bp, Homo sapiens
  misc_feature: GYAE6OF01BUVRD.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtcctccaaccactctgtctgtgtctcgtaggggacagacgcccaccctctcctcgcagggccagtcagagtgttacgcagacctaacgttacgaccgttggtaaccagaccgtaaagtaaaggttcggacccaacgggccttacccccgaagggccctccctacgtaactttcgttttcgggtacgttccgtaccgtaccggttaacggggcccgtcgtcgggttcgtacccgtacgttacgtacggttaccgaggtacgggtcctaaggttcggcgtcgttacggggactacggtacgtttcgaccttaccgtaccgaaccctagtaccgaacgtccgacgtcccgtacgtacgacggttactaagtaacgttagttttacgacgtttaacggttttaacttaccgtttaggtaacaacgtaactaaacttaagttaacggtacgttaccgttccgggtaccttccggttaaggttccgtacccgttttaaccggttttacggggaaccccggtacggggtaaacccgtaacgggtcgtaacgggtaacgaaacgttaaaccgaaaacccggttaacggtcggttaccgggtcttaacccggg

SEQ ID NO: 242371 - DNA, 655 bp, Homo sapiens
  misc_feature: GYAE6OF01EF3TH.35.85.H08.1.454.CMB.1.raw
  modified_base (207)..(207): a, c, t, g, unknown or other
  misc_feature (207)..(207): n is a, c, g, or t
  modified_base (372)..(372): a, c, t, g, unknown or other
  misc_feature (372)..(372): n is a, c, g, or t
  modified_base (480)..(480): a, c, t, g, unknown or other
  misc_feature (480)..(480): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgaatgacgcagtctaccaaccactctgtctgtgtcctccgaggggacagacncccaccctctcctgcagggccagtcagtgtgtagcagctaacttagcctggaccagcaagtaaagtcggacaggcctccgaggtcctcctctacgttcgtttggtcgtcgtccacggtacgggccgtcgttggtaccgtcccgagtccgacggttcgaggtcggngacggtgggccgttcggtaagggtactaggtaccgtttcaccttccgtaccaaccgtataccgacgtcgacgtccgtcgtacacgttacgaggttaagttcgttttanacgttttagtttaacgttaccgtgttaaccgaacgtaacttaaaattacgtaaggttacgtaccgttaccggtccgttacggtgttacgtccggttacgtttaccgggacggtaacggggtacaaggtcgtaggaactaacggtaaacaaacggtacgtgggtacgtcgtaaccg

SEQ ID NO: 242372 - DNA, 764 bp, Homo sapiens
  misc_feature: GYAE6OF01BE7SA.35.85.H08.1.454.CMB.1.raw
  modified_base (138)..(138): a, c, t, g, unknown or other
  misc_feature (138)..(138): n is a, c, g, or t
  modified_base (175)..(175): a, c, t, g, unknown or other
  misc_feature (175)..(175): n is a, c, g, or t
  modified_base (221)..(221): a, c, t, g, unknown or other
  misc_feature (221)..(221): n is a, c, g, or t
  modified_base (273)..(273): a, c, t, g, unknown or other
  misc_feature (273)..(273): n is a, c, g, or t
tcagtacagatcgtcacgaccggtgctcgatttagtatcactcagtcgcgggaggaactgctcagttaggacccagacggaaccatggaacgccccagcgcagcttctcttcctcctgctattctggcctcccagatntcactggaagaatgtagatgacgcagtccaccaaccnctcgtgtctgtgtccgtcgaagggacagacgcccaccttctaccgngccgacggccagtaccgaggtgtcgtagcagcctaacgtcgccgtcgtaacngacgtaagtaacggtgcccgaggtccctaccgacggtcctccgtactacgtttcgtttgccgttcgtaccgtaacggtccgggccgttgttccgttaccgtcccgtaacgttcgtacggttcgacggtcggacgtacgggtccgtcgttacggggaggtaaccgtacggtacccgttttaccacctttaccggaaccccgtacggtaaccgtaccgaccggttaaccgtccccgggtcgtaacggttaccgtaacggttaacgtttaggggttaaacttttggtttttaacccggtaattttaaacgttttcgttaccgtttggaaccttaaggtaacctaagtttaagtccgtacggttaccgtgtaccccgttagttacggtaccgttacctgggtttaacccggaacggtaccgggtaaatcccggttggtaacccggtaagttaacgtaacggttaaccgtagtttcggaaacgtttcccggaacgg

SEQ ID NO: 242373 - DNA, 759 bp, Homo sapiens
  misc_feature: GYAE6OF01AF78M.35.85.H08.1.454.CMB.1.raw
  modified_base (247)..(247): a, c, t, g, unknown or other
  misc_feature (247)..(247): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgaggagggaccagggccaccgtcctccgagggacncccatgctgcaaggtccggcaggaggtcgcccctgaacctgaacggccaatcgacgaacccgaagacgacggaccgaaggttgggttgacggacgtaccccgtaggacgggacgtcgtcgggcccgtcgggtcccgagggcacggtccggtccgtccgggtcccctggccgtacggtcgtacggtccggttgggtccgtcgggaccgtacggttcgggtacccgtcccgtaggtccgggtcccttcggtaccgttccgggcccgtaacccgtacgggtttccgggttacccgcccgaaccggaaccgggaaacccgggcccggggaaccccgacggtaaccccggtacgggaccgcccgttaacggtacggttaacggaacggtcccgacggtacccgtacgtacccggacgttccggaccgggtcggtacggtcccggtaggggtccggggaccgtaacggggtccccgaaacccggaccccgaaacccgggtaacccccctaaccccggg

SEQ ID NO: 242374 - DNA, 776 bp, Homo sapiens
  misc_feature: GYAE6OF01A9GPW.35.85.H08.1.454.CMB.1.raw
  modified_base (149)..(149): a, c, t, g, unknown or other
  misc_feature (149)..(149): n is a, c, g, or t
  modified_base (202)..(202): a, c, t, g, unknown or other
  misc_feature (202)..(202): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggaanaaatgtgatgacgcagtccaccaaccactctgtctgtcgtctaccgagggganagacgcccaccctctccgtgcgagggccagtcagtactatacgacctaactcgccgtagtacacagacaacgtaaccgtggtacacggtcctcccgacggtcccttcctactacttcgttacgtcggtacgtaccaccgtacccgaacccggacggtaccctacggttaccggtaaccctcccgaacgtccgtaacggttcgaggtcggacggtacgggtcgggtacggtagggtaacgtacgggttacgttacctaccttaccgtacctaacgtaacgtaccgacggtacctaccggtcccgttaacggccgttaacgttccgttaaggttaacgtttacggttttacgtttacggtttaacgttttaacgttttaacgttcctttaggtaacctaagtttaaccgttaagtttaccgtaaagttaaccgttaccggttcccggtcccggtttacggtacccgggttaccgggttaaccggaccgggtaaacgggttaacccggagggttaacccggaaacgttaccgtaacggttaccggtaggtaccgtacgtaccgtaccgtacgttccg

SEQ ID NO: 242375 - DNA, 737 bp, Homo sapiens
  misc_feature: GYAE6OF01BWUWH.35.85.H08.1.454.CMB.1.raw
  modified_base (224)..(224): a, c, t, g, unknown or other
  misc_feature (224)..(224): n is a, c, g, or t
  modified_base (723)..(723): a, c, t, g, unknown or other
  misc_feature (723)..(723): n is a, c, g, or t
tcagtacagatcgtcacgaccggtgctcgatttagtatcactcagtcgcgggggaggaactgctcagttaggacccagacggaaccatggaacgccccagcgcagcttctcttcctcctgctattctggcctccagatatcactggaagaaatagtgatgacgcagtcctaccaaccacttctgtctgtcgtctcgaggggacacgacgccctaccctctccgngacgacgggccaagtcgaaggtaggttcgttagctacgacttaaacgttcgccgttacggtaaccaacggacgaaaggtaaaggttccggacccgagggtccctaccccgagggtcccttccgtacgttacgtttcggtttcggtcggttccgtacccgtaacggtaccggggtccccgtcggttcggttaccggtcctaacggtttcgaacggtttccgaaggtcggtacgtggtcgtcgtacgtgggacgtagtaccggttcaccttacgtaccgaacctacgtaccgccgtacgtccgtccgtagcgtaacgtaccgttaaggtaactttgtttacgttacgttttaacgttttacgtacgttgttaaccgaacgttaacttaaagtaacgttaagtacggttacgttcccgtaccgttcggtaacgttcgtaccgtttacggttaccggaccggttaacgggctaacgtgtacggactaacgtacgaacgttcgnggtacgtcggtacg

SEQ ID NO: 242376 - DNA, 776 bp, Homo sapiens
  misc_feature: GYAE6OF01BZMKG.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccaccctctcctgcacgggccagtcagagtgtagcagactaacttcgccgtggtaccagaccaggaaagttcggaccaggcctccccgaggtcctcctcgtagttcgtttggtcgtcgtaccgacggtacgggccgtcgtcgggtccgtaccctaggtcgtaggttccaggttcggtacgaggttcgggccgtttacggtacggggaaccgtaggtaacgtttaccgtaccgttcttacccgaaccgtactacggtaacgcgtaaccgtcccgttagacccggttaacggttacctagggttaaacggttttacgtttttaacgggtaccgttttaaacggtttttaacgttttaaccgtttacggttaacccgtaagttaaccgtaaaacgttttaacgtaaaacgtttcgtaccggtttaccgggtaccccgtttaccgggttaaggtttccggtaccgtttaccggtttttccgggaacccgggtaaacgggggtacccgaaacgggtcggtacgggtaaacgtacggttaaacccggaaaacgttaccgtacgggttcgtaccggtaccg

SEQ ID NO: 242377 - DNA, 787 bp, Homo sapiens
  misc_feature: GYAE6OF01C8RTO.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtcctccaaccactctgtctgtcgtacctccgaggggacagcgcccaccctctccgtgcgacgggccagtcgagtagtgtagcagcaacttcgccgttcggtaccagaccgaaggtaaacggttcggacccgacgggtccctaccccgacggtccttcccgtacgtacgtttccggttttgggttcgtccgttacccgtaccgggttacggggtccccgtcggttcgggttaccgtaccccgtaggttccgtagggtttcgaagggtcgggtacgtacgggttcggtccgttccggtaggggtaacctagggttaccgtttccaaccgttcccgtaccaacccgtacgtaaccgaccggaccgtacggtcccgtacgaccgtaacgttaccgtaaggttaacgtttacgtttttacgtaaccgtttacgttttaactttacggttacgtacgtaagtactaaagttaacgtaacgttccggtccgttaccggtcccgttacggttacgttccgtaccgtttaccggtttaccgggaccggtaaccgggtaacgtaacgggtccgtacgggtaaagtaacccgttaaccgtaaaaccggttacggtacgggttcggtcgtacccgg

SEQ ID NO: 242378 - DNA, 793 bp, Homo sapiens
  misc_feature: GYAE6OF01CKH1E.35.85.H08.1.454.CMB.1.raw
  modified_base (614)..(614): a, c, t, g, unknown or other
  misc_feature (614)..(614): n is a, c, g, or t
tcagtacagatcgtcacgaccggtgctcgatttagtatcactcagtcggacggggaggaactgctcagttaggacccagacggaaccatggaagccccagcgcagcttctcttcctcctgctattctggcctcccagatactcacgtggaagaaattagtgatggacgcagttcctaccgaaccacctcgtgtcgttggtcgtcctaccggaaaggggacacgacgcccacccttctcgtcggcacgggccagtccgagtacgtagttacgactagtaccgtaattacggtaccctaacggtaaccaacggacgaacggtaaaacggttcgaccccgaacgggtcccctaccccgaacggtcccttaccgtacgttacgtttccggtttggtaccgttacgtacccgaacgggttaacgggtcccgtacggttacggttaccgtaccccgtaggttaccgtaacggggtttccaagggttcggaacccgtaggtacgggtacttaccggggagggtaacctacgggttactttacccaaccgtttctaacccgaccgtaattaccgaacgtacgtaacgtcccgtggacgttaacgttaccggagttaacgttntttaccggactttaaggttttaacttaactgtaacgtacgtaactaacttaagtaacgttacgtccgttacggtacttccggtaacgttcggacgttacgtttcgggaccggtaagggtacccttaagggccgttaacggagtaacgttacaaacggtacttggtaccggtctaaccgg

SEQ ID NO: 242379 - DNA, 711 bp, Homo sapiens
  misc_feature: GYAE6OF01CJLWA.35.85.H08.1.454.CMB.1.raw
  modified_base (149)..(149): a, c, t, g, unknown or other
  misc_feature (149)..(149): n is a, c, g, or t
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (277)..(277): a, c, t, g, unknown or other
  misc_feature (277)..(277): n is a, c, g, or t
tcagtacagatcgtcacgaccggtgctcgatttagtatcactcagtcggcgggggaggaactgctcagttaggacccagacggaaccatggaagccccagcgcagcttctcttcctcctgctattctggctccagatatcacgtggaanaaatagtgatgacgcagtcctaccaaaccnctntgtctgtcgtcctccggagggacagacgccctacctctctgcgacggccagtcaggtgtgtacgacagtacctaaacgttcgccgtaggtaaccngtaacgaaagggtaacgttcggaccgtacggaccctccgacggtaccttctcgtaagtttcggtttggctaccggtaccgtacgggtaccgggtccgtcggttccggtaccgtacccgtaggtccgtaacgggtttcgagggttcggacggttcggtcggtccgttacgggacgggtacctaagggttcgtaccctaccgttaccaccctaacgtaccttacgtacgtaacccgtaccggtaccttacggtacctacggttaacgttagttaacgtttacgtttacgtacgttttagtttacgttaacgtagttaaccgtagtaacttaattaacgtaagttaccgtacgttaccggtccgtcgttacgttacgtcgttacggttcggaccggtacggactaggcgtagactaagtaccaagtgcgtagctacg

SEQ ID NO: 242380 - DNA, 834 bp, Homo sapiens
  misc_feature: GYAE6OF01DRO1E.35.85.H08.1.454.CMB.1.raw
  modified_base (126)..(126): a, c, t, g, unknown or other
  misc_feature (126)..(126): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattcnggctcccagatatcactggagaaatagtgatgacgcagtctccaaccactctgtctgtgtctccgaggggacagacgcccaccctctccgtgcgacgggccagtcagagtgttagcagcaacttacgcgtaggtaccagcaaggtaaagttcggaccgacggtccgtaccccgaggtaccctccgtactacgtttcgtttcgggtacgttcggttacccaacggttacggggtccccgtcggtttacgggtccgttaccccgacggttacgtacgggggtttacaacggggttcgggaccgtaagggttcgggtacccgttcgggttacggggaaaccgtagggtaaccggtttaccgtaaccgtttacccgttacccgaaccgtacgtacccgtaacggaccgtaacgtacccggtacggtaccgtacggttaccgtaacgggttaaagtttacgttttacggttacgtttaacgtttttaacgtttaccgttacggttaacctaaggtaaccttaaagttaaacgtttaaacggttacgttaccgttaccgggtacccgtttacccggttaacgtttacggtaaccggtttaccggttttacggggaacccggtaaccggggtaaaccgtaaccgggtacggttaaccggtaacggtaacgttaaaccggaaaacgtaccggttaacggtcggtacgttaacccgg

SEQ ID NO: 242381 - DNA, 882 bp, Homo sapiens
  misc_feature: GYAE6OF01D5X7A.35.85.H08.1.454.CMB.1.raw
  modified_base (149)..(149): a, c, t, g, unknown or other
  misc_feature (149)..(149): n is a, c, g, or t
tcagtacagatcgtcacgaccggtgctcgatttagtatcactcagtcgcgggggagaactgctcagttaggacccagaacggaaccatggaacgccccagcgcagcttctcttcctcctgctattctggcctccagatatcactggaanaaatagtgatcgacgcagtcctaccaaacctcttctgtctgtcgtctccggaagggacagaccgcccctacccttcgtccgtcgcgaacgggcccagttacgaaggtacggttagttacgaccgaacgtaaccttaaaacgttaccggacccggttacggtaaaccagaacgtaaacgggttaaacggtccggaccgtaaccgggtccctaaccccggacggttccctaccgttaccgttagttttaccgggtttgggtccgttaccggtaacccgtacgggtaccgggtcccgtacggttcggttaccgtaccccggtggttaccgtacgggttcgtacggtcggtgtacggttcggtcgttcgggtaagggaacgtacggttaccgttcctaacccgtttaccgtaaccgtaacctacgtaacccggacggtacccgacgtccccgttaagtaccggttaagttacgttaacggttaacgtttttagtttaccggttaaacttttacggtttttacgttacgtacgtacgtaaacgtaacgtttaaataaaccggttaagtttccgtacccggttaacccggttccgtttacggttaggtttaacccgtagggtttttaacccgggttaccggggaaaccggtaaaccggggtaacaacgggttcgggtaaacgggttaaccaaacgtttaaaccggaaacggttaccggttagggtcctaacggtaaccg

SEQ ID NO: 242382 - DNA, 753 bp, Homo sapiens
  misc_feature: GYAE6OF01DFEGS.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatccactggaagaaatagtgatgacgcagtcctaccaaccactctgtctgtgtctccgaggggacagagtcccaccctctccctgccgtagggcccagtcgagtgtgttagcagtcaacgttacgccgtggtaccagacaagaaagttcggacctaggcctccgaggtcctcctacagttctttgggtcgttcgtaccgtaaccgttaggggcccgtacgttcggggttacgtcccccggtagttaccgtaacggggtttccagggttcgggaccgtaggggtcgtcgttccggtagggtaaccgtaggttacggttaccctaccgtccttaacccaaccgtaacgttacccgacgtaccgtaaacggtcccgtacggtaccgtaacgttccgtaacggtaaaggtttacctttttaggacttttaacggttttaattaccgttacgttaccgtataccgttaaattagtaaagttaccggtaccgttacggttaccccctacgggtaagtttccggtaccgtttaacgttttccgggaaccgggttaacgggaaaccccgttaggaccggttaggaacgttaacggtaaaccgttaaacccggg

SEQ ID NO: 242383 - DNA, 764 bp, Homo sapiens
  misc_feature: GYAE6OF01AL4KB.35.85.H08.1.454.CMB.1.raw
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
tcagtacagatcgtcacgaccggtgctcgatttagtatcactcagtcggcgggggaggaactgctcagttaggacccagacggaaccatggaacgccccagcgccagcttctcttcctccgtgcttattctggcctcccagatactcgactggagaaatagtagatcgaacgtcacgtcctaccaaccactctcgtctgtcgtctccgaggggacagacgccctaccctctccgtgcgacggccagtccgagtagtcgtagcagactaacgtcgcctcggtaaccacgtacgtaaggtaacggttcggacccgacggtaccctacccggtacggtaccctcccttacgtacgttcgtttggtacgtcgtaccgtacggtcgggccgtgttcggtactccgtcgtacgtacgggttcgacgtggtacnggtcgcgtggnggacgngtactcncctcaccacgtcacgacgccgtacgtccgtcgacgtaagtccgtaaagttaccgtttacgttttacggaacttttaaggttttacctacggttacgtaactaacggttaaattaaacgtttacggttaacgtacggttccccggttacggttacccgtttacggttacggtttcccgtaaccgggttttaacccgggtacggggtaaaccccgggtaacggggtaccgtaaccggggttcgggtaacgggtaaacccttaaccgggtaaaccccggttaaaggtcggggtttaccgcgggttccctaacccgg

SEQ ID NO: 242384 - DNA, 814 bp, Homo sapiens
  misc_feature: GYAE6OF01AXKY6.35.85.H08.1.454.CMB.1.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattcgtggactcccagatatcacgtggaagaaatgtgagtgaccgctagtccaccgaaacctctcgtcgtctcggtcgtctccgaggggacagacgcccaccgttcncgtgcgacggcaggcagngttgtacgcgagactaacttgccgtagtaccgagtacgaaggtacgtccggcgacggtcccacccggtacggtcctaccgtcgtacgttccggtttggtacgtccggttaccgtacggtaccgggtcccggtacgttccgggggtaccgtaccccggtacggttaccggttaacgggtaccggtaacgggtacgggtaccggtacggggtccgggtaccgtttaccggggtaacgggtaaaccggtaacggttaccggtttaaccgtaccgttacccgtacccgtaaccgtaacctaaccggtaccgaccgtacggacccggtacgtaccgtacggttaacggtaacggttaacgtttcgtttaagttaacgtttaacgttttaaccgttaacgtttaccggtaacgtacggtaacttaacgttaagttaacggttaccggtacgttaccggtacccgttaaccggtacgttaccggttaccgttccgggtttaccggaaccgggtaccgggtaacgtacggtacggtacggaacgttaacgtaaccggtaaaccgg

SEQ ID NO: 242385 - DNA, 692 bp, Homo sapiens
  misc_feature: GYAE6OF01EOY1W.35.85.H08.1.454.CMB.1.raw
  modified_base (173)..(173): a, c, t, g, unknown or other
  misc_feature (173)..(173): n is a, c, g, or t
tcagtacagatcgtcacgaccggtgctcgatttagtatcactcagtcgcgggggaggaactgctcagttaggacccagacggaaccatggaagccccagccgcagcttctcttcctcctgctattctgctccagatatcactggagaaatagtgatgacgcagtctaccaacnctctgtctgtgtctcgagggacagacgcccacccgtctccgtgcgacgggtccagtcgagtagttgttagcagactaacgttacgccgtaggtaccaggaccaaggtaaacgttcggaccaggtacctcccgaggtcctccgtctacgtttccgtttcgggtcgtccgtaccgtacggtacgggtcccgtcggttcgggtccgtaccccgtaggtcgttaggttaccgaggttcggacgtacggtcggtactcgggttacggacgtacggtacgtttccgaacgtccttacccgactacgtacgacgaccgtacgtcccgtgacgtagttacgtacgtaagttcttttggctttaaggtttactacgttgtactagtaactaataacgtaagtacgccgttacgtacccgtagtacgtcgtaccgtttcggttaccggacgtaacggggacctaaggtcgtacgggtaaactacggttaaacccgtaaaccggttcgttagggcccgttacgtaaccgg

SEQ ID NO: 242386 - DNA, 880 bp, Homo sapiens
  misc_feature: GYAE6OF01BXIPV.35.85.H08.1.454.CMB.1.raw
  modified_base (317)..(317): a, c, t, g, unknown or other
  misc_feature (317)..(317): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtcctccaaccactctgtctgtcgtctccgaggggacagacgcccaccctctcctgacgtagggcctagtcagagtgttagcagcaacgttagcctggtaccagcaaggaacgttggccgtaggcctcccgaggtcctccgtntacgtttcgttttagggtcgtcgtaccgtaaccgtacggggtcccgtcgttacggggttccgtaccccgtaggttcgtacgggtttcgaacgggttcggacgtaacgggttcgggccttacgggttacgggaacctaggtacgtttccgtaaccttccgtaccgtaaccgtacgtaccgtaacggtaccgtaacggtacccgttacggtaacccgtaacggttaccgttaacgggttaaacggtttaacgttttttacggtaaccgtttaaggttttttaaaccgtttaacccgggtttaccggtttaacccggtaacggttaacccttaaaacgtttaacgtttaaacccggtttaaccggttacccggtttacccggggttacccccgttacccggggtttaaaccgggtttccgggtttaaccccggttttaacccgggttttttacccggggaaccccgggttaaacccggggggtaaaccccgttaaaacggggttacccgggtttaaccggggaaacccggttaaaccggttaaaccccgggttaaaaaccccgggg

SEQ ID NO: 242387 - DNA, 704 bp, Homo sapiens
  misc_feature: GYAE6OF01CGFZ6.35.85.H08.1.454.CMB.1.raw
  modified_base (149)..(149): a, c, t, g, unknown or other
  misc_feature (149)..(149): n is a, c, g, or t
tcagtacagatcgtcacgaccggtgctcgatttagtatcactcagtcggcgggggaggaactgctcagttaggacccagacggaaccatggaagcccagcgcagcttctcttcctcctgctattctggctccagatactcacgtggaanaaatgtgatgacgcagtcctaccaacctctcgtgtctgttcgtcctacggaggggacacggaccgtacccacccttcgtaccgtgacggacgggacctacgtacgaggtagttgttacgacacgaccgtaaacttccggccgtaacgtaccgagaacgaaggttaaacgtcggaccgacggtacccgaccgtaggtcccttacctgttacgttcggtttggtcgtcgtaccgtaacggtcgggccgtgtacggtccgtccggtagtcgtaggttcaggtcgacgtcggtcggtaccgtagggctaacgtcgttacaccgtctaccacgtactcgacgacgtcgtcgtagccgttagtaccgtaagtacgtttagttacgtacgtttagtttacttcgtacgtaacggtactaattaacgtaagtacgtacgtcgtaccggtacttacgtcgttacggtactttacgggtacgggtaccgtaacgggtaccgtaaggtccgtaaggtaacgtaaacggttaccgtaaacggcgttaggtacgtcgtaccgggtaac

SEQ ID NO: 242388 - DNA, 738 bp, Homo sapiens
  misc_feature: GYAE6OF01BRS3U.35.85.H08.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggacgtggggtgtactgtaacngccctgctggcgagaggaccagggcaccgtcctcgagggacncccatgctgacaggtcggcaggaggtcgcccctagacctggaacggaccaagtcgacgaacccaagacacggaccgaaggtgggttgtacggacgaccccgtggacgggacggtccggtcgggccccgtcggtaccccgagggccgacggccggtccgtccggcccctcggccgtcggcgttcggtcggtcggtccgtcggtccgtacggtcggtcccgcccgtaggtccggtccgtcggtaccgtcggacccgtacccgtaggttccgggttcgaccccgaacccggtaccggaaaccggggccccggggaaccccgaccggtaaccccggtacgggacccgtacccgtacggtacggttacgggacggacccgtacggacccgtacgtcccggaccgtacccggcgggaccggtccggtccgggttcgggaccggggccggtacgggtacccggaacccgggacccgtaaacccggccccctaaacccccgg

SEQ ID NO: 242389 - DNA, 755 bp, Homo sapiens
  misc_feature: GYAE6OF01AP9LA.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtcctaccaaccactctgtctgtgtacctccgaggggacaggacgcctaccctctccgtgcgacgggccagtcgagtagttgtacgcgagtaccgtaacgttacgccgtacggtaaccgagtaccaaaggttaacggttccggaccaacggccttacccggaggtccctaccgtctacgttgtttacggtcgtacgtccgtaacgtacgggcctacgtcgggtccgtacccgagttacggtacggtttacgaggttcggaccggttagtcgggtcccgttcggacgggaacgtaggttaaaccgtttcctaccgttccttaaccgaaccgtcctaacggtcgacccgtacgtcccggtagtaccgttaacgttcgtaaggttacgttaacgttttcggtacctttaaggtttttaccgtacgtacggttaacaacgttactaattacgttaacggtacgttcgttaccggtaccgttccggtagttaaccgtccgtttaccggtaggtacccgggaacgggaccgttacggtgggaccggttaaagaaccgttaaccgaaaccgggtacgttcgggttcgacgtaacccgg

SEQ ID NO: 242390 - DNA, 867 bp, Homo sapiens
  misc_feature: GYAE6OF01D9B27.35.85.H08.1.454.CMB.1.raw
tcagtacagatcgtcacgaccggtgctcgatttagtatcactcagtcgcggggagaactgctcagttagaccagacgaaccatggaagccccagcgcagcttctcttcctcctgctattctggctcccagatatcactggagaaatgtgagtcgacgctagtctccaaaccactctgtctggtcgtcctccgaggggtacaggacgccctacccctctccgtgacctacgggtcctaggttccgaagtaggtagtaacgctaacgacctaacgttaccgtccgtacggtaaccacggtaacgtaacggtaaacggttccgaccgtaacggtccttacccggacggtcccttaaccgtcgtaacgtttcggtttcggtacgtccgtaccgtaacgtcgggtcctacggttacggtccgtaccgttacggtacgtacggttagacggttcgggactacggtcggtcgtaaacggtccgggaacctttaacggcgtttaccaaaccgttcccgtaacgaacccgttacgtacctaccggtaaccggtaccgtcccggttggtaaccgtaacggtttcggaacggtttaaccggtttatttaccggtaacgtttaaacgttttaccgaaccgtttaggtaacccgtaggttaaaccgttaacgttaaacgttaacggggtacccgttaccggtttaccggtacccgtaacgggtttaccgttaccgggtttaccctttaaacccgggggtttaccgtaaaccggggtaccgggttaaacgtaacccggggttcgtaaacccggttaacgggttaacctaaacccgggttaaacggttaccggtaaacggttccgggaaccgtttaccccgg

SEQ ID NO: 242391 - DNA, 802 bp, Homo sapiens
  misc_feature: GYAE6OF01C5C5E.35.85.H08.1.454.CMB.1.raw
  modified_base (120)..(120): a, c, t, g, unknown or other
  misc_feature (120)..(120): n is a, c, g, or t
  modified_base (195)..(195): a, c, t, g, unknown or other
  misc_feature (195)..(195): n is a, c, g, or t
  modified_base (229)..(229): a, c, t, g, unknown or other
  misc_feature (229)..(229): n is a, c, g, or t
  modified_base (479)..(479): a, c, t, g, unknown or other
  misc_feature (479)..(479): n is a, c, g, or t
tcagtacagatcgtcacgaccggtgctcgatttagtatcactcagtcggcgggggaggaactgctcagttaggacccagacggaaccatggaagccccagcgcagcttctcttcctcctncttattctggcctccagatatcactggaagaaatagtgatgacgcagtcctaccaacctctcgtgtctgtgttcnccggaaggggacaacgcgaccctaccctcgtccnggaccaacggggcctaagtccgagggttacgttgtacgcgtaacgtacctaaacgttaccgtccgttacgggtaacctaaggacggaaaaggttaaacgggttaccggacccggaaacggtccccggtacccggacggtccccttaccgtaccttacggtttgtttcggtggttaccgtaccggtaccgtacggggtcccgttcggtcggttccgtccgtaacggttccggtagggtttacgtacggggnggttaacggtcggttcgggtaacgtcggttacgggggtaactagggtaccgtttaccgaccttaccggtacctaaccgttacgaccgttaacgaccgtacggtacccgtaggtaccgttaacggttaccgttagttaacgtttacgtttacgttacgtttaacgttttacgtacttaacgtcctaaggtaactaattaagtacgtaagtccgttacgccgttacggtacgttcgtaaccgtttcggttaccgggaccggtaacgggtaaccgtacggtaggtaacggtagaacgtaacgaacggtacggtgtcggtccgtacg

SEQ ID NO: 242392 - DNA, 777 bp, Homo sapiens
  misc_feature: GYAE6OF01AJE2V.35.85.H08.1.454.CMB.1.raw
  modified_base (181)..(181): a, c, t, g, unknown or other
  misc_feature (181)..(181): n is a, c, g, or t
  modified_base (222)..(222): a, c, t, g, unknown or other
  misc_feature (222)..(222): n is a, c, g, or t
  modified_base (307)..(307): a, c, t, g, unknown or other
  misc_feature (307)..(307): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctcccagtatactcactggaagaaatgtcgatcgacgcagtcctaccaaccncttcgtcgtcgtcgttgtacctccgaaggggaccaggaccnccctacccttcgtccgtggaccgacgggcctaggtacaaggtagttcgtagactaacgaccttaagttacgccgtacggtaaccngacctaaggtaaacggttcggaccgtaacgggcccttacccggaaggtcccttaccgttacgtcgtttccggttttcgggacggttactaccggtacggtacggggtccgtcgtacgggtccgttaccacgggttcgttaggggttaccaagggttcggaacgttcgggcggtccgtaacggttcggggaaacttacggttaccttaccgtaacttccggaaacctaccgtacgttaccgacgtaccgtacggtccgtacggtaccgtacggttaccgtaaggttaacgtttcgttttaccggttacgtttacgttttaccgttcgttaagtacctaagtaacgttaacttaagtaacgtacgtcgttaacgtccgtacgtacgtttcgtacgttacggtcgtaaccgggcgtaacgtcggtacggtacggaactaacgtaccgtacggtaagtcggtacgtcgtaaccg

SEQ ID NO: 242393 - DNA, 819 bp, Homo sapiens
  misc_feature: GYAE6OF01CT931.35.85.H08.1.454.CMB.1.raw
  modified_base (136)..(136): a, c, t, g, unknown or other
  misc_feature (136)..(136): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagntatcactggagaaatagtgatgacgcagtctacccaaccactctgtctgtcgtctccgaggggacagacgcccaccctctcctgcgagggccagtcagagttgtagcagactacgttacgcctaggtaccagaccgaaggtaacggttcggacccgagggccctacccgacggtccctacccgtactagtttccgttttgggtccgttaccggtacccgtaacggtcggggtcccgtcggttcgggtccgtaccccgtaggttaccgtacgggtttcgtagggtcggtacgtacgggttcggtaccgtttcggggcggtaacctagggttaccttaccgtaccttcccgttacccaaccgtcgtaccgacggtcgtaccgtccgttacggaccgtaagtttccgtaagggttaacgttttaccgttttaacggttccgttttaaagtttttaccgtttacggttacgtaaaccgtaacggttaaccttaaattaacggtttaaacgttccggtcccggtttccggttacccgttacggttacggtttaccgtaccggttttaacggtttacccggggaacccgggtaaccggggtacccgttaacgggtccggttaacgggtaacgtaaccgttaaaccggtaacccgggtttagtaccgggttaccggtaccggttacccgg

SEQ ID NO: 242394 - DNA, 772 bp, Homo sapiens
  misc_feature: GYAE6OF01CTWET.35.85.H08.1.454.CMB.1.raw
  modified_base (183)..(183): a, c, t, g, unknown or other
  misc_feature (183)..(183): n is a, c, g, or t
  modified_base (188)..(188): a, c, t, g, unknown or other
  misc_feature (188)..(188): n is a, c, g, or t
  modified_base (603)..(603): a, c, t, g, unknown or other
  misc_feature (603)..(603): n is a, c, g, or t
tcagtacagatcgtcacgaccggtgctcgatttagtatcactcagtcggcggggaggaactgctcagttaggacccagacggaaccatggaacgccccagcgcagcttctcttcctcctgctattctggctccagatactcacgtaggaagaaattagtagatacgacgcagtctaccaaccnctctntctgttcgtccgtccggaaggggacacggaccgaccctaccttctccgtcgccggacggcctagtacgaaggtaggttacgttacgacgtaacgtacgtaaacgttaccgtccggtaggtaaccgagtaaccgaaacgggttaaacgttccggaaccgtaccgggacctccccggacggtcctttccgtacgttcgtttccggtttggttcgttaccgttccggtaacggtccgggtccgttcgtcggtccgtaccccgtggttacgtaggttacgcggttacgcggtacggtcggccgttgggacggtactaggtaccttaccgtactccgtacactcgtacgcgaaccgtcgtcgtacgtcgtaacttacgtaaaggttcttaagttacgttacgtaaacgtttagttttacnccgttaagttccgaacgttacgttaaggttaaccgttagggttccgtaccgggtccccgcgttaacccgttcgtttacccgggttccggtaacggggaccggtaacgggacggtaacggtaacgtaacgtaagtaaacggtaacggttaacgcggtacgcgtctaaccg

SEQ ID NO: 242395 - DNA, 652 bp, Homo sapiens
  misc_feature: GYAE6OF01B901A.35.85.H08.1.454.CMB.1.raw
  modified_base (212)..(212): a, c, t, g, unknown or other
  misc_feature (212)..(212): n is a, c, g, or t
  modified_base (257)..(257): a, c, t, g, unknown or other
  misc_feature (257)..(257): n is a, c, g, or t
tcagtacagatcgtcacgaccggtgctcgatttagtatcactcagtcggcggggaggaactgctcagttaggacccagacggaaccatggaacgccccagcgcagcttctcttcctcctgctattctggctccagatatcactggagaaatgtgatgacgcagtctccaactactctgtctgtcgtcgtccgaggggacagacgccacctcncctgcgaggccaagtcagacgtgtagcagcaattagctaggtacngcaagaagtcgacagtcctccgagtcctcgcacttcgtttgcggtctccgaagtcgggcgcgttaggtctaccgagtcgaaggtttcagtcgggtacacggttcgggacctcgggtacggtaacctaggtaccgtttaccaacggttctacgaaccgacgtacgacgacaaggtccttacggacgtacgttaccttaaggtaacgttacgttttaggtacctttaaggtttaaccttaacgttacggtactaacgtaaccgtaatttaagtaaacgttacggaccgttacggtacccgttacggtacgttacgtacctaccgtttacggaccggtaacggaacctaggtcgtaggtaagtacgtaaccaaacgtagttacgtcggtacgtaccgg

SEQ ID NO: 242396 - DNA, 689 bp, Homo sapiens
  misc_feature: GYAE6OF01DIZY9.35.85.H08.1.454.CMB.1.raw
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
tcagtacagatcgtcacgaccggtgctcgatttagtatcactcagtcgcgggggaggaactgctcagttaggacccagacggaacatggaagccccagcgcagcttctcttcctcctgctattctggctccagatatcatggagaaatagtgatgacgcagtcctaccaaccacgtctgtctgtntcncgagggacagancccacctntcngcgacggccagtcagtgtcgtagcagactaaacttagccgttaggaaccagtacgaaaggttaaacgtcggccgaacggtcctaccgaacggtcctcctacgtagtttccgttttggcgttacggtccgtaacgtacgggccgttctagggtacgtacccagtacgtggttacaggtgaacgtggtcgtactgtcggaatgtacgttcactctaccgacctatcgacgacgacgtctacgtacgacgtacgtagtaacgttagttttacggactttaacgttttattacgttcgttaacgtaagtaaactaaattaacgtttaaacgtaacgtaccgttacgggtacccttacgggttaacgttcgtaaccgtttacggtttaccgggaaccggtaacggggtaaacccagggtaaccggttaaaggagttaaaaccgtaacgtaaaaacggtagttacgggttcggacgttaaccgg

SEQ ID NO: 242397 - DNA, 867 bp, Homo sapiens
  misc_feature: GYAE6OF01D6IX2.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctccttcctcctgctactctcggcctcccagactaccacgtggaagaaatagtgatgacgctacgtctaccagcccacccttgtctgtcgtccgtaccggaggggaacacgcctacgttcccttccgtccgtcggaccggacgggtccagtaccgaggtacgttacgtacggaaactaacggttagtcgtacggtaccagaccgtaaacgtaaccgtcggacccgacgggtccctaccggacggtccccttcctaccgtacgtttaccgttacggttcgggtaccaccgtaacccgtaccccgaaacccgggtaccggggtcccctaacggttaccggtacccgtaccccgtaacggtcccggttaagggtaccgaagggttccgggtacgtacggggttcggggttacgtacggggtaaccttacgtaccgttaccctaccgtttaccccgaccgtaaacccgtagtacccgtacggccccgtacggttcccgttcggtacccggtttaacggtacgtaaacggttaacgtacggtttacgtttacgttaacgtttactttaccgtacgtacggtttagtaacccgtttaggtttaacgtttaaacgttccgtaccgggtccggttacccgtccgtaccgtttaccggtttccgggttacccgggacgggacggtaaacggtacggtacggggtactaaacgtaaggtaaaccgtaggttacgggttcgtaccgtaccgttaaccgtacttcggttaccg

SEQ ID NO: 242398 - DNA, 677 bp, Homo sapiens
  misc_feature: GYAE6OF01D9P67.35.85.H08.1.454.CMB.1.raw
  modified_base (191)..(191): a, c, t, g, unknown or other
  misc_feature (191)..(191): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtntactgtaaacagccctagctggcgagagggaccagggcaccgtcctccagggacgtcccatgctgcaagtcgggcagaggtgcccctgaacctgaaggccaaagtgacgacccaagacacggccaaggtcgggtgtgacgaccctgacggagcgtcgggccctcggtcccgacggcgacggccgcgttccggcccgtcgtcctcggctcggaccggtgggtcctcggtaccgacgttcgggtcccgtcccgtaacgtcggccgttcggccgtacggccgtaaccccgtagtcggttccggacctaccggaccgaaacggcccgggacccacgaacccgtcggacgtcccgtacgtacggttacgggaagccgaacggccgtaacgcccgtaacggtccgtacgggaccgggaccggtaccgtcggggtacggggacccggtaggtacccgaaggacccccgtaaaccgggccccgtaaaacccccg

SEQ ID NO: 242399 - DNA, 725 bp, Homo sapiens
  misc_feature: GYAE6OF01BPLPC.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtctccaaccactctgtctgtgtctccgaggggacagacgcccacctctcctgcagggccagtcagtagtgttagcagctaacgttcgcctaggtaccagaccgaagtaacggttcggaccacgggtcctccccgaacggccttcccgtacgtacttccggttttgggtcgttacgtcccgtaacgggtaccggggccgtcgttacgggttccgtaccccgtaagtccggtaaggggtttccgaagggtcgggtacgtagggtcggccgtttaccggtagggacctaaggtcgtttaccgaacctttccgaccgtaaccctagtccgacggacctaaccggtcccttaggccttaacggttccggttaaaggtaacgttttacgttttacggtacctttaacggttttttaacgttacccgtagggttaacctaacggtaccttaaagttacgttaaacgtacggtacgttaccggtccgttacgttagtccgtacgttacgttccgggacgtacgggtacaggtcgaggacgaacgtactaacggtatcgggtgtctccg

SEQ ID NO: 242400 - DNA, 660 bp, Homo sapiens
  misc_feature: GYAE6OF01EEYA1.35.85.H08.1.454.CMB.1.raw
  modified_base (127)..(127): a, c, t, g, unknown or other
  misc_feature (127)..(127): n is a, c, g, or t
  modified_base (323)..(323): a, c, t, g, unknown or other
  misc_feature (323)..(323): n is a, c, g, or t
tcagtacagatcgtcacgaccggtgctcgatttagtatcactcagtcggcgggggaggaactgctcagttaggacccagacggaaccatggaagccccagcgcagcttctcttcctcctgctattcnggctcccagatatcactggaagaaatgtgaatgacgcagtcctaccaaccactctgtctgtgtcctccgaggggacagacgcccaccctctccgtgcgacgggccagtcagagttgtagcagactaacgttacgcctaggtaaccagacaaggtaaagtcgaccaggtcctccgaggtcctcctcattcgttggtntccggtacacggtcggcctcgtaggtctaccgagtcgtaggttacaggtcggtactcggtgaccgtggtagggactaggtacttcacctcgtacacctagtacagtaccgagtccgtacgacgtacggtccgtaagtaagtttacttttacggacgtttaaagttttacgttacgttagtaacgtaagtacttaaataacgtaagttaccgcgttacggtacccgtacggttagttaccgttacttaccgggtttagggacccggtaaaggggaaccttagggtcgtaagggtaacaacgtaaacccgtaaacgtaacgtttcgggacggtctaacg

SEQ ID NO: 242401 - DNA, 560 bp, Homo sapiens
  misc_feature: GYAE6OF01AF2EV.35.85.H08.1.454.CMB.1.raw
  modified_base (307)..(307): a, c, t, g, unknown or other
  misc_feature (307)..(307): n is a, c, g, or t
  modified_base (376)..(376): a, c, t, g, unknown or other
  misc_feature (376)..(376): n is a, c, g, or t
tcagtacagatcgtcacgaccggtgctcgatttagtatcactcagtcggcggggaggaactgctcagttaggacccaggacggaaccatggaagccccagcgcagcttctcttcctcctgctattctggctccctagatatcacgtggagaaatagtgatgacgcagtctccaaccactctgtctgtgtctccgaggggacagacgccctaccctctcctgcgagggccagtcagagtgttagcagcaacttagcctggtaccagcaagaaagttcgaccaggcctccgagctcctcatcgtttggngtcgtccaagtcgggcctcgtgggtactcccgaagtcctaggttcaggtggctaggtgctcgtgggacngagttcactctcacatcagcagcctgctagtctagaagttattttgacttagtttattactgtactagactaatagtaatagctgtcccgtcgtagttcggacttacggtttaggacccggttagggaaccctaaggcgttacggaataacgtaaccgaaacggtaactggtacggcgtaaccg

SEQ ID NO: 242402 - DNA, 742 bp, Homo sapiens
  misc_feature: GYAE6OF01DHGII.35.85.H08.1.454.CMB.1.raw
  modified_base (171)..(171): a, c, t, g, unknown or other
  misc_feature (171)..(171): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatgtgatgacgcagtctccaacnctctgtctgtgtcctccgaggggacagacgcccaccctctcctgcgacgggccagtcagtagtgttagcagcaacttacgccgttagaccagctaaggtaacggttcggcgacggcctccgacggtcctcctcgtatttcgtttggtcgtcgtaccgtaacggtcgggtcccgtggttacgggtccgtaccccgtaggtccggtaacggttccgtaaggtccgggtacggtaacgggttcggtaccgttacgggtacggggtaacgtacgggttaacggtttcccctaacgttcccttaacccaacccgtacgttaccgaacgtccgaacggttcccgtacgtaccgttacggttacgtacggttaagtttagttttacgtacgtttaagtttaacgtttcgttagtaacgtataacgtaaattaacgtagttcggtcgtcgttacccgtacgggtacgtttaccgtacgttaccggtttccggggaacccggtaacggggtaccaggttcggtaacgggtaactaaccggttaaacgtaaacggtacggttacggtcggtacgtacccgg

SEQ ID NO: 242403 - DNA, 691 bp, Homo sapiens
  misc_feature: GYAE6OF01CQKI1.35.85.H08.1.454.CMB.1.raw
tcagtacagatcgtcacgaccggtgctcgatttagtatcactcagtcgcgggggactgcttcagggcagttggtagatgcccctctgggagagatccccaggggtgacagccatcggaccctggaagggcctgggcgtagggacgagggaccagagccagtccgagggagaggacagagccaagtggacgtggggtgtactgtaacagccctgcgtggcgagagggaccagggccaccgtcctccgagggcgcccagtcgctgcgaacggtcgggccaggacggtcgcccctagaacgtgaacgcaatcggaaccgaaccgaacgacggaacggaccgtaaggttcggggttacgtacgacccggtaaccccgtagggacgggacggtcggtccgggtcccgtccggtacccgacggcacggcgtcccggtccggccccgtgtccgtcgtcgtcggtacgttcggggtaccgtcggtccgtacggttccggtacccgaccgtaccggtcggtcccgtcggtccgtccgaaccggtccgtagtcggtaccgacccggaccgtaccggaaacggcccggaacccgtcgacccgtcggaccgtccgtacgtacggtacgacgacgtacgccgacgccgtacgcggtcggcgcgtggcgggtgacgcgtacgaccgaccgaccgccccgtaaccg

SEQ ID NO: 242404 - DNA, 549 bp, Homo sapiens
  misc_feature: GYAE6OF01D16F1.35.85.H08.1.454.CMB.1.raw
  modified_base (325)..(325): a, c, t, g, unknown or other
  misc_feature (325)..(325): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
  modified_base (410)..(410): a, c, t, g, unknown or other
  misc_feature (410)..(410): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccgggagggacagagcccaccctctcctgcagggccagtcagagtgttagcagcaacttagcctggtaccagcagaagttggccaggctcccaggctcctcatctttggtgtgtccatacgggccntggtgtcccagtcaggttcagtggctagtggctctagggacagngttcaactctcgaccatcngcagccctgcagtctgtaagtntttgtctagtttattacttagttcctagtactaataagtaattaagtcgttacggccttcccggtagttcgacgttacgttttcgggaccgtacggggaaccgtaaacggacgttacggaaggtacgtacgtaaaacgg

SEQ ID NO: 242405 - DNA, 697 bp, Homo sapiens
  misc_feature: GYAE6OF01B9VS8.35.85.H08.1.454.CMB.1.raw
  modified_base (148)..(148): a, c, t, g, unknown or other
  misc_feature (148)..(148): n is a, c, g, or t
tcagtacagatcgtcacgaccggtgctcgatttagtatcactcagtcgcgggggaggaactgctcagttaggacccagacggaaccatgggaagccccagcgcagcttctcttcctcctgctattctggctcccagatatcactgganaaatagtagatgacgcagtcctaccaaccactctgtctgtcgtctccgaggggacagacgcccacctctcctgcgacgggccagtcgaggtagttgttacgcgagacctaacgttcgccgtacggtaaccagtacgaaggttaaggttcggaccgacggtccctccgacggtctccgtctactttcgttcggttcgtcgtaccgacggtacggccgttcgtcggtacgtccgagttcgaggttcgaggtcgacgacggtcggccgtggacgggtacagtacttctacctctaccactactcgacgtccgactccgtcgacgtacgtaccgtaggtaacgtttagtttacgtacgttttaaacgttttacgttacttacggttaactacgttaaataacgttactaaacgtaggtaccgtcggttacccgtacggttacgttccggtaccgttacgggttacggtacccggtaacggggtaacctaacgggtcggtacggtaaagttaaccggaaaccgtaaaccggtagtacgggtcgtcggtaacccg

SEQ ID NO: 242406 - DNA, 766 bp, Homo sapiens
  misc_feature: GYAE6OF01AG0YO.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccctaccctctccgtagccgacgggccctaggtcgagtacgttggttacgacgagtacctaactttacggcccgtagggtacccaggtaccgtaaggtaaaacggttcggacccgtacggtcctaccccggtacgtcccgttaccctccgtaatttccggtttttcgggccgttccggttacccgtaacggttccgggccccgtcgtttcgggtaccgtccccgtaaggttccgtaggttccgtaggtcggtacgtacggttcggtcgttcggtacggggactacggttacgttccgtaacctcgtacccaaccgacttccgacgcctacgtccgtacgaccgttcggtacgtagtaacgtttagttttcgtacgtttattttacgttacgttcgtacgttaactaacttaaagttagttaacgttacgtcgttcccggtaccgttacggttacggttacgtccgtttacccggttttacgggacccggggtaacggtacccgtaaggtccgggttaacgtagaccgttaaacgaccggtaacgttcggtaccggtctacccggg

SEQ ID NO: 242407 - DNA, 644 bp, Homo sapiens
  misc_feature: GYAE6OF01BF5BA.35.85.H08.1.454.CMB.1.raw
  modified_base (160)..(160): a, c, t, g, unknown or other
  misc_feature (160)..(160): n is a, c, g, or t
  modified_base (173)..(173): a, c, t, g, unknown or other
  misc_feature (173)..(173): n is a, c, g, or t
  modified_base (411)..(411): a, c, t, g, unknown or other
  misc_feature (411)..(411): n is a, c, g, or t
  modified_base (634)..(634): a, c, t, g, unknown or other
  misc_feature (634)..(634): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacncagtctccaaccnctcgtgtctgtgtctaccgagggacagcgccctacttctcctgcgagggccagtcagagttgtacgcagactaacttcgcctaggtaccagacaagtaagtcggacacgtacctaccgaggtcctacctctacgtttcgtttggtcttcgtaccgtacggtacgggcctacggttggtccgtccgacgtcgtacgtcaggtcggctaggtcgggtctacgggaacctggtacgttacnccgttacacacccgtataccgagaccgtcgtactcggtacgagtaccgtagttagtcgttaaccgtttgtaacccgttttagtttagttacttcgttaccgtacgttaattaacgttagtacgttacgttacgtaccggttccgtcgtacgggtctacccgggacgtaacgggtaccggtaggtaacgacgtaaccgacgtacgtggtaccgtcgaagtaccngtccgttacg

SEQ ID NO: 242408 - DNA, 813 bp, Homo sapiens
  misc_feature: GYAE6OF01EJ087.35.85.H08.1.454.CMB.1.raw
  modified_base (176)..(176): a, c, t, g, unknown or other
  misc_feature (176)..(176): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtctaccaaccnctctgtctgtgtctccgagggacagacgcccacctctcctgcgacggccagtcagtagtgtagcagactaacgttcgcctacggtaccagacgaagtaaggttcggaccgacggcctaccgacggtcctcctacgtacgtttcgtttcggtcgttccggtacccgtacggtacgggtcccgtcggttacgggtccgtacccgtacggtaccggtaggtttacggacggttcggacggttaggttcggtcgttacgggtacgggtaacgtacggtaaccgtttaccgacctttacccgtacccgttaacccgtaacgttacccgaaccggtaccgtaaccggttccggtaccgtacgttacgggttacgttaacgggttaacgttttacggtttacgttaaccgtttttaagttttaccgtttacgttacgttaacgtaacgtaaacgttaaattaacgtaacgttacgttaccgggttacccgttaccggtttacgttaacggtttccgttaacgggttttaccggttaccgggtaacccgggtaacggggtaaccgtaacgggtcggtaagggttaaccggtaaaaccgtaaaccggtaaaacggttacggttaccgggtcggtacgtaaacccgg

SEQ ID NO: 242409 - DNA, 906 bp, Homo sapiens
  misc_feature: GYAE6OF01BB4LR.35.85.H08.1.454.CMB.1.raw
  modified_base (127)..(127): a, c, t, g, unknown or other
  misc_feature (127)..(127): n is a, c, g, or t
tcagtacagatcgtcacgaccggtgctcgatttagtatcactcagtcgcgggggaggaactgctcagttaggacccagacggaaccatggaacgccccagcgcagcttctcttcctcctgctattcnggcctcccagatatcactggagaaatagtgatgacgcagtctccaaccactctgtctgtgtctccgaggggacagagcccaccctctcctgcgagggtccagtcgagtagtgttacgcagactaacgttagccgtaggtaccagcaaggtaaacgttggaccaggcctcccgaagggtccttaccgtactaagttccgtttcgggtacgtcggtaccacgttacgggggccctcgtacgggttccgtaccccgtaaggtccgtaacgggtttaccgaagggttcgggacgtaacgggtcgggtcctttacgggtacggggaacctagggttaccggtttaccaacccgttccgtaccgtaaaccgtaacggttaccgaaacggtaccgtaaccggttacccgttaacgggtacccgttaacggggttaccgtttaaacgggttaaacgtttacggttttttaccgggtaaccggttttaacggttttttaaacgtttaaccgggtttaacgttaaccccgtaaacggtttaaaccgttaaaacgtttaaacgtttaaaacggttaccgggttaacccgtttacggggttaacccccgttacccgggttaacgggttttaccggttaacccggttttaaacggtttttacccggggaacccgggtttaaaccgggggaacccgtaaacgggttcccgggtaaacgggtaacggtaaacccgttaaaccggttaaaacccgggttaaacgtcgggtttaacgggtacccggttaacccggg

SEQ ID NO: 242410 - DNA, 1078 bp, Homo sapiens
  misc_feature: GYAE6OF01B7T75.35.85.H08.1.454.CMB.1.raw
tcagtacagatcgtcacgaccggtgctcgatttagtatcactcagtcgcggggaggaactgctcagttaggacccagacggaaccagtggaacgccccagcgcagtcttctcttcctcctgcttattcgcggcctaccagatactcagtaggaagaaattgtacgatcgacgctacgtccacctaacctactcgtgtcctggttacgtccgtaccggaggggaaccacggaacccgtcccctaacccttcgtaccgtacggaccgggtaaccgggcctaagtccgtaaaggtggttaacggttacggacacggtaaaccttaacggtttcgtaccggtaacggtaaccgagaacggtaaaggtaacggtccggaaccgtacggtacccgtaccccgtaaggtcccttacctagttaacgtttcgggtttacggtacgttaccggtacccggaacgggttccggccggttacggtacgggttaccccgtaccgtaacggttaccggttacggttacggagggtccggagtacgggttccgtaacgtcgggtaaacgggacctaacgggtttactaccccggtactttaaccgaaccgtaaccgtaacgtaccgtaacggtaccccgtaacgggttacccgtaacgtaaaccggttaacggttaccgtttaaaagggtttaacgttttaaccgggtttaaaccgtttaaacccgggtttttaacgggtttttaaaccctttaacgggaccggtttaaaccctttaaaacgggtaaacctttttaaaacggttaaaccggtttaaaccggttacccgggttaacccgggtttaaccccggtttaaacccggttttaccgggtaaaccgttttttccccggggtttaaaaccggtttttttaaaccccgggggttaaccccggggggaaaaccggtttaaaccggggggtaaaaccccttaaacgggggttaaaacccgtttaaacgggggaaaaccccgttttaaacccgggtaaaaaaccggttaaacccgggttaacggggtttaaaccgggtccgggtttaaacccccgtaaaaccgg

SEQ ID NO: 242411 - DNA, 834 bp, Homo sapiens
  misc_feature: GYAE6OF01D2CGI.35.85.H08.1.454.CMB.1.raw
tcagtacagatcgtcacgaccggtgctcgatttagtatcactcagtcgcgggggactgcttcagggcagttggtagatgcccctctgggagagatcccccaggggtgacagccatggaccctggaagggcctgggctagggacagggaccagagccagtccagggagaggacagagccaatggacgtggggtgtactgtaacagccctgctggcgagagggaccaggggccacccgtcctaccgagggacgccccgatcgctggcaaggtccgggccaggacggtcgcccctggaaccctgaacggccaaagtcgaacgaaccccaaagaccgaacgggacccgtaaaggttgggggtttacggtacggaaccgtacccccgtggaacgggacgccggtacgggccccgtccgggtccccgaaggccgaggccggccgtccggcccccgtgcccgtcgccgtggtccgttgggtacctcggggaccctaggttccgggtcccgaccccgtacggtcgggtccccgttggtccgttccggacccggtccccgtaaacggtttccgggtttaccggacccgtaacccgggaccggtaaaaccggggtccccgggggaacccccgtaaccgggaacccccggttacgggaacccggtaccccgttaccggttaacgggtttaaccggaaccgggtaccgtaaccgggaccccggtaacgtccccggtaaccggtcccccgggtagggtacccgggacgggtcccggttacggggtcggggaccgtacggggtacccaaccggtacccccggaaacgggtacccccgtaaacccccgg

SEQ ID NO: 242412 - DNA, 760 bp, Homo sapiens
  misc_feature: GYAE6OF01EEJKF.35.85.H08.1.454.CMB.1.raw
  modified_base (176)..(176): a, c, t, g, unknown or other
  misc_feature (176)..(176): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtcctaccaaccnctctgtctgtcgtcctccgaggggacagacgcccaccctctccgtagcgacgggaccagtaccaggtagtggttagcgacgactaacgttacgcccgttaggtaccacggacgaaggtaaacggttcggacccgaacggtccctccgacggtcccttccctacgtacgtttccggtttgggttacgttccgtacccgtacggttacggggccccgtcggttcgggttccgttaccccgtaggtccgttaagggttacgtaggtacgggcctagggtcgggtaccttcgggtaggggaccgtaaggtcggttaccctaccgttccttacccgaaccgtactccgaccgtacgaccgtcccggtagaccttaggtaccgtaagtaacgtttggttttacgcttttaagttttacctttaagttcgtacgtagtaaacttaattaagtacgtacggttccgtaccggtaccgttaccggttagttccggttaccgtttaacggttccgggtaccgggtaaccgggtacctaacgggtcgtaggtaacgtaacgtaaaccgaaacgttgtcggtacggcttaacccgg

SEQ ID NO: 242413 - DNA, 840 bp, Homo sapiens
  misc_feature: GYAE6OF01AT6D6.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtcctccaaccactctgtctgtgtctccgaggggacagacgccaccctctcctgcacgggccagtcagagtgtagcagcaacttagcctggtaccagcaagaaagttcggaccacgggcctaccccgaggtcctcccgtctaacgtttcgtttacgggtgttcgtaccgtaccggtacggggcccgtcgttcgggtccggttccccgtaagtccgttaggggtttaccgaaggttcgggacgtacgggttcgggtccgttacgggttacggggaaacgtacgggtttaacgttaccgtaacccgtttccgtaacccaacccgtaacgtacccgaaaccggtccgtaacccggtcccgttacggaaccgttaacggttccgtaaacggttaaccggtttaggttttaccggtaccgttttaagtttttaaccgtttacgtttaccggttaacgtaacgtaaccgttaaaagttaacgttaaacgttaccggtacccggttaccgggtttacccgttaccggttaaccggttttaccggttaccgttttaaccggggtttacccggggtaaccggtaaacccgggggtaacctaacgggtacccggttaagggtaaaccgttaaaccgttaaaccggtaaaacccggttacggtgggttacccgggtacgttaaccccgg

SEQ ID NO: 242414 - DNA, 812 bp, Homo sapiens
  misc_feature: GYAE6OF01DLZKT.35.85.H08.1.454.CMB.1.raw
  modified_base (147)..(147): a, c, t, g, unknown or other
  misc_feature (147)..(147): n is a, c, g, or t
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctccagatatcactgganaaatagtgatgacgcagtctaccaaccactctgtctgtgtctccgagggacngacgccacctctccgtgcgacggccagtcgagngtgtagacgacgtctaacgttacgccgtaggtaccagacgtaagtaacggttcgaccgacggtcctacccggaggtcccttaccgtactagtttcggtttacggtggttccgtacccgtaacgtacggggccgtacgtcgggttctacccgtagtaccgtggttacgaggtcggtacgtaggtcggtcgtcggtagggtaaccaggttcccgttacgtaccttccgtacccaacgtaactccggaagtacccgtaacgtcccgtacggtaaccgtaagtttaccggtaaggttaaacgtttcgtttttaaccggtaacttttaaacggttttttacgtttaacccgtcggttaccttaaagggtaaccctttaagtttaaacggtacgttaccgggttaccgggttcccgttaacccggtttaccggttaacggtttaccggtttaccggtttaacccgggttttacgggaccccggggtaaaaccgggtaacgtaagggtaccggttaacgggggttaactaaaccggtttaacccggaaaacccgggttagtttcgggtacgggtcccgttaacccgg

SEQ ID NO: 242415 - DNA, 711 bp, Homo sapiens
  misc_feature: GYAE6OF01AW5N7.35.85.H08.1.454.CMB.1.raw
  modified_base (125)..(125): a, c, t, g, unknown or other
  misc_feature (125)..(125): n is a, c, g, or t
  modified_base (240)..(240): a, c, t, g, unknown or other
  misc_feature (240)..(240): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattcnggctcccagatatcactggagaaatagtgatgacgcagtcctaccaacctactctgtctgtcgtctcgaggggacaggacgcccaccctctccgtgcgacgggccagtcgaaggngtacgttagcagtactaacgttacgctcggtaccagcgaaggtaacgtcggcaggcctaccgagtcctctctacttcgtttggacgttcgacctacgtacgggccgtacgtcggtacgtccccgtaagtcgtacgggttcagggtggtacgtcgggtcgtccgttacggtcgggtaaccacgggtttacttacccacccggtttacacctaaccgtctaccgtacggaccgtacgcgttcgtacgttacgggtacgttacggtaagtttacgttttaggtactttaacgttttaattaccgttcgtacgtaacggtaacttaaacgttacgttaacgtacgtccgttacgtccgttaacggttcgtacgtttcccggttacgtttaacccgggacgggaacccggtttagacggtaccggtaaacgggtgtaaaccgtaaacgtaacgtcccggtaggtccgacgtaaccg

SEQ ID NO: 242416 - DNA, 726 bp, Homo sapiens
  misc_feature: GYAE6OF01CX6QI.35.85.H08.1.454.CMB.1.raw
  modified_base (133)..(133): a, c, t, g, unknown or other
  misc_feature (133)..(133): n is a, c, g, or t
  modified_base (589)..(589): a, c, t, g, unknown or other
  misc_feature (589)..(589): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccanatatcactggaagaaatagtgatgacgcagtcacccaaccactctgtcgtgtcgtccaccgaggggacagacgccctaccctctcctgcgaggccagtcaagacgttgtacgcaacgacctaacgttacgccgtacggtaaccacggactaaggtaaacgttccgcccgaacggtccctaccccggtaaggccttacccttacggttacgtttcggtttcgggttcgttaccgttaccctaaccgggttacgggcccgttccggtttaccgggtccgttaccccgtagtccggttaacggttttacggaaggttcggtacggacggtcggtacccggttacgggtacgggtaacacgtttacggtttccaaactttccgaaccacctaactacgcgtacgtacgtctacgactagtacgtagtaagtttagttcgtaagttacgtttaatacgttntacgtaacgtataaacgttagtaacgtcgtcgtacgtacgtacttagttccggtagtttaccgggttaggaccgtaacggggtactaactcggtaacgagtaactaaccggaaacgtacgtaggtcgttacgtaccg

SEQ ID NO: 242417 - DNA, 656 bp, Homo sapiens
  misc_feature: GYAE6OF01C0VRP.35.85.H08.1.454.CMB.1.raw
  modified_base (241)..(241): a, c, t, g, unknown or other
  misc_feature (241)..(241): n is a, c, g, or t
  modified_base (330)..(330): a, c, t, g, unknown or other
  misc_feature (330)..(330): n is a, c, g, or t
tcagtacagatcgtcacgaccggtgctcgatttagtatcactcagtcggcgggggaggaactgctcagttaggacccagacggaaccatggaacgccccagcgcagcttctcttcctcctgcctagttcctggcctccagtatatcgacgtggaagtaaataggtgagtcgaacgcgaagttccaccaacctcttcctgtctgtcgtacgaccggagggactacgacgcctaccctctcgngcgagggcctagtacgagtagtgtacgcagacctacgtacgccgtaggaccagaccgaaggtaacgtcggcctagcctccgagcctctntacgtgttaggacgtctaccgacgtacgggtccgtcgtcggtactcccgtagtccgtaggtcgaggtcggacgtggtacggactacggtcggaactacgtacttaccgactaccgaccgtaaccgtcgtaccgacggacgtacgtccgtagtaccgtagttactaaggttacgttacggtttgtacgttagtttattaccgttgtactagtactaagttacgtaagtacgtacgtcgtaccgtacgtgtcgtactcggttacgacggtaacggacacgtcggacgtacgtaacgtaccgtaaacgtcgtacggtccgtacgtaccg

SEQ ID NO: 242418 - DNA, 813 bp, Homo sapiens
  misc_feature: GYAE6OF01DR049.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctccagatatcactggaagaaatagtgatcgacgcagtctaccaaccactctgtctgtgtctccgaggggacagacgccaccctctcctgcgacggccagtcagagtgtagcagctaactagcctgtaacgagacaagtaaagttcggaccgaggtcctcccgaaggtcctacctctacgttcgtttggtcgtcgtaccaacggttacgggcccgtacgttgggttcgtacccgtaggttcgtaaggtttaccgagggttcgggcgtaacggttcggggaccctacgggttacgggggaacctaaagggttaccgtttacctaacccgttccttaccgaaacccgtacgttaccgaaacggtccgtaaacggtcccgttagggaacccttaacgggtacctttaaagggaaaacgtttacgttttttaccggaacctttaaaggttttttaacctttaacgttcggttaacgtaacgttaacttaaagttttacggtaacgttaaacgtttaaaccggttcgggttacccgttacgggttaccgggttaaccgtttaccgggggaaacccgtaaaaaccgggttaccgggtaaaacggggttacgggaaacccggtttacccggaaaaaccggttaggttccgggtaacggcccgttaacggaccctaaaccgtacgtttaccggg

SEQ ID NO: 242419 - DNA, 903 bp, Homo sapiens
  misc_feature: GYAE6OF01CGJSK.35.85.H08.1.454.CMB.1.raw
  modified_base (190)..(190): a, c, t, g, unknown or other
  misc_feature (190)..(190): n is a, c, g, or t
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
tcagtacagatcgtcacgaccggtgctcgatttagtatcactcagtcggcgggggaggaactgctcagttaggacccagacggaaccatggaagccccagcgcagcttctcttcctctgctattctggctccagatatcactggaagaaatagtgatgacgcagtcctaccaacctactctgtcttggtntcgtccggagggacagcgccctacctctccngcgacggccagtcagtgtagtagacgngacctaacgttacgccgttacgaccgagacgaaaggtaacggttccggacgaccgtacccgtaccgacgggtccctccgtaccgttacgtttccggtttcgggttaccggttaccgttacccggtaaaccgggttaccccggggtccggtttaccggtttacgggggttaccccggttaccccggttaggggttaacccgttccgggggtttaacgaacgggggtttcggtaccgggttagggtcgggtacgtttccggggtaaaggggtaacgtacgggttacctttacccgttaccgtaccgttacccggaacttaaccgtacggaaccggtaccgtaaccggtcccgtcgtaaccgttacgtacggttaacggtttaacgtttaacggtttcggtaaacgttttgttttaaccgtacggttagtaactaacgggtaacctttaaagttaacgttaaacgttccggtaaccggttacccggttacccgttaacgggttaccggttacgggttacccgttttaaaccggggtttacccgaaccgggggaacgggttaacccgtaaacggggtcccgtaaagggtaaaacggttaaacccgtaacggtaaaaccccgggtttaaggttcccgggaaagggtccgtaaaccccggg

SEQ ID NO: 242420 - DNA, 819 bp, Homo sapiens
  misc_feature: GYAE6OF01C8QOF.35.85.H08.1.454.CMB.1.raw
  modified_base (219)..(219): a, c, t, g, unknown or other
  misc_feature (219)..(219): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagttgaatgacgctagtctaccaaccactctgtctgtcgtctccgagggacagacgcctaccctctccngcgacgggccagtcgagtagtaggttacgacacgaccgtaacgttacgccgtacggtaccgagtacgaaggtaaaggttcggccgacggtcctaccccgacggtcctaccgtacgtacgtttccgtttggggtcgttacggttacccgtaacggttaccggggtccgttcgggttacgggttccgtacccccggtaaggttccggttaagggtttcccgtaagggtcgggtacggtacggttcgggtaccgttcggtacgggaacgtaggttacgttccgtaaccttccgtaccctacgtactaccgtacgcgtacggtcccgtaggtacgtacggttacgtacggttaaacgtttaggttttacgtacgttttaacgtttttaacgtttaccggttacttaacgtacggttaaaacttaagttaaaccgtttaagtacgtaccggttaccggttacccgtttcggttaacggtttccgttaccggttaccggtttacgggacccggtaaacggggtaacctaacggggtacgttaacgggtaacggtaacgtaaacccggtaaaacggttaccggttacggtacgggtccgtaaaccgg

SEQ ID NO: 242421 - DNA, 755 bp, Homo sapiens
  misc_feature: GYAE6OF01E36JV.35.85.H08.1.454.CMB.1.raw
  modified_base (165)..(165): a, c, t, g, unknown or other
  misc_feature (165)..(165): n is a, c, g, or t
  modified_base (543)..(543): a, c, t, g, unknown or other
  misc_feature (543)..(543): n is a, c, g, or t
  modified_base (647)..(647): a, c, t, g, unknown or other
  misc_feature (647)..(647): n is a, c, g, or t
  modified_base (748)..(748): a, c, t, g, unknown or other
  misc_feature (748)..(748): n is a, c, g, or t
tcagtacagatcgtcacgaccggtgctcgatttagtatcactcagtcgcgggggaggaactgctcagttaggacccagacggaaccatggaacgccccagcgcagcttctcttcctcctgctattctggctcccagatatcactgggaataagtgagtgacgacngtctccaaccactctgtctcgtgtactccgacgggacgacgacgcctaccctcctccgtacgcgacggccgacgtcgtacgtaggttacggttacgtacgaacgtacgtaaaccgttaaccgtccgtaccggttaccgaacgacgtaacggtaaacggttacggccggaccggtccgtaccccgaccggtccgttcccttccgtaacgtttcgtttcggtttacggcgttaccgtaaccggtacgggtcccgggtcttccgggttagtaccccgtacggttaccgttaaggttccggtaggtcggggtacgtacggtcggtacgttccggtacgggtaggtaacgttaccggtttacaaccttccctaccgtaaaccnccgttacgaccgacgtccgtaccgtcgaccgtagtacgttacgtaaagttcgtttacgttccgttaattttaccgtttacacgttacgaactaataagttaaanaacgttacggtccgttcgcccgttacgtacgttcgttcgttcgttacggcgaaccgggtacagtcggacgtacgacgtacgtaaacgtacgaggtccgtcncgtaccg

SEQ ID NO: 242422 - DNA, 731 bp, Homo sapiens
  misc_feature: GYAE6OF01AYE6N.35.85.H08.1.454.CMB.1.raw
  modified_base (126)..(126): a, c, t, g, unknown or other
  misc_feature (126)..(126): n is a, c, g, or t
  modified_base (179)..(179): a, c, t, g, unknown or other
  misc_feature (179)..(179): n is a, c, g, or t
  modified_base (185)..(185): a, c, t, g, unknown or other
  misc_feature (185)..(185): n is a, c, g, or t
  modified_base (382)..(382): a, c, t, g, unknown or other
  misc_feature (382)..(382): n is a, c, g, or t
  modified_base (515)..(515): a, c, t, g, unknown or other
  misc_feature (515)..(515): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattcnggctccagatatcactggacaaatagtgatgacgcagtctaccaaccactctntctgtntctccaggggacagacgccaccctctcctgcagggccagtcagtagtgtagcagacaacttagcctagtaccgagtcaggtaaagttcggccagggtcctccccgaggtcctcctactattcgtttggtgtcgttcccacggtcgggcccgtgtcgggtcctaccccgtaggtccgtaggttcacggtcggtaccgnggtcggctacggtcggacaggttacgttccgacttccgtactaaccacgtacctaagccgtacgtccctaggtcctacgttcgtaacggaagtttaccgtttacgtacgtttaaacgttttccgttaacggtntttaacgaacctaacgtaaagttaacgttaacggtacgtaccgttacccgggttaccccgttacgggttaaccgtttcggtaccgttttaacccggttttacccggggaaacccgggttacggggttaaccccggaaggtacccggtttacgggaaacgtttacccgtaaacgtaaaaccggggttaccgttagggtacccggtcgttaccccggg

SEQ ID NO: 242423 - DNA, 718 bp, Homo sapiens
  misc_feature: GYAE6OF01ASYVC.35.85.H08.1.454.CMB.1.raw
  modified_base (147)..(147): a, c, t, g, unknown or other
  misc_feature (147)..(147): n is a, c, g, or t
  modified_base (185)..(185): a, c, t, g, unknown or other
  misc_feature (185)..(185): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactgganaaatagtgatgacgcagtctccaaccactctgtctgtntctccgaggggacagacgcccaccctctcctgccgacgggccagtcagtagttgttagcagactaaccgttagcctaggtaccagcaagtaaaggtcgccgaggcctccgagtcctccgtctattcgttgtcgtcgtccgacgtacgggccctcgtggtctacccgtagtcgtaggttcgaggtcggacgtaggtcggtcgttcgtacggggactaggttaccggtttccacgtttaccaccctaacgtactacccgaagtccaaccggtcccgtacggtccgtaacggttcgttaacgggtaacttttaggttttaccgtacgtttaacgttttaaccgttacggttcgtaaccgtaacgtaacgttaaacgtttaacgtaaacgttacggtcgttaccggtcccgttacgtacggttttccgacgttttaccgggttaccggaacccggtaacggggaaccttaacgggcgggttaaacgaacgtttaaccgtaaacggtaaaccttagggttcgtagggttccgtacccg

SEQ ID NO: 242424 - DNA, 906 bp, Homo sapiens
  misc_feature: GYAE6OF01BPCFX.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatgtgatgacgcagtctccaacactctgtctgtgtctccgaggggacagacgcccaccctctccgtgccgacgggcccagtcagtaactgtagcagacctaacttacgccgttggtacctaggaccaggtaaaaggttcgggccaacggtccgtaccccgacgggccttacccgtactacgttccgttttcgggttcgtcggttacccgtaccgttaccggggtccctccggttcgggttccggttacccccgaaggttccggtaacgggtttccgtaagggttcggggtacgtaagggttccgggtaccgttcggttacgggggtaaaccgtaacgggttacgtttacccgaacttccccgttacctaacccgtaacgttcccgaaacggtccaacggtaccccgtaggtacccgaaacggttccgttaacgggttaaagtttacgttttttacggtaacccgttttaagggttttaacctttaacccggttacggtttaacccgtaacgggttaacgttaaaaactttaaacggtttaaaccgttaaccgggtaaccgtttacccgggggttaccccgttaaacccgggttacgggttttaacccggtaaaccccgtttttaccgggtttttaaccgggggaacccccggggttaaaccgggggtaaaacccccggttaaacggttacccggggtaaccggggttaaacgaaaacccgggtttaaccggtaaaaaaccccgggg

SEQ ID NO: 242425 - DNA, 744 bp, Homo sapiens
  misc_feature: GYAE6OF01ADB36.35.85.H08.1.454.CMB.1.raw
  modified_base (139)..(139): a, c, t, g, unknown or other
  misc_feature (139)..(139): n is a, c, g, or t
  modified_base (328)..(328): a, c, t, g, unknown or other
  misc_feature (328)..(328): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggcctcccagatancactggagaaatagtgatcgacgcagtcctccacgccaccctgtctgtgtctccgaggggagagcactcctctcctgcgaggccagtcagagttacgtacggaaacgaacgtagtcgtacggtaccagactaacgaaccgtggaccacggcctaccgcggtccctccctcacttacgttacgtcggtcncgacctaccgaccgaccgggtacctaccgtacgtccgtacccgacgtccgtaaggttcgtaggtcggtacggtagggttcggggtacgtacggggaaccgtagtacccttcaacccgtttctacccaacccgtactaccgaccgccgtaccggtccgtacgacccgttaggtaccgtaaggtaacgttacgtttaagttacggtacgtttaacgtttaccgttaccgtacgttcgtaacgtacggttaaccgttttaagtttaaccgttacgaacccggttccgggacccggtccgtttaccggtttccgtttacgggttaccggggaccggggtaacgggtaccggggttaaacggtacgggtaacgtaaacgtaaacgtaaagggtaccgtggtaccgtcggactaccgtaacg

SEQ ID NO: 242426 - DNA, 751 bp, Homo sapiens
  misc_feature: GYAE6OF01B9S1W.35.85.H08.1.454.CMB.1.raw
tcagtacagatcgtcacgaccggtgctcgatttagtatcactcagtcgcggggaggaactgctcagttaggacccagacggaaccatggaagcccagcgcagcttctcttcctcctgctattctggctccagatatcacgtggagaaatagtgatgacgcagtctaccaacactctgtctgtcgtcgtaccgaggggacagacgcccacctcgtctggcgtacgggccagtcgaggtgttagtacgacgagactaacgttacgccttaggaccagacgaaggtaaacggttcggaccgtacggtccacccggtaacggcccttaccgtccgttacgtttcggtttacggtcggtccggttaccgacggtacgggtcccgtcggtacggttaccgtaccaggttacgtacgggttcgaagggtcggaacgtggtacgggtcgtacgggtcgggtaaccgtaaggtttaccgtcctaacgtttcccgtaaccacccgtaacgtacgtaccgaccgtacgacccggttagaccgttagtaccgtaaaggttaacgttacggttttacgtacggtttaaacttttacggttaacgtgtaacgtaacgttaacgtaaagttacgttaaacgttcgtaccgttacggtacccgttacgttacgttcgtaccgttccggttaccgggacggtacgggtaacctaggtccggttagtaacgtaacgtaaccgtaacggtaagtcgggtagtccgtaccg

SEQ ID NO: 242427 - DNA, 740 bp, Homo sapiens
  misc_feature: GYAE6OF01CULJ0.35.85.H08.1.454.CMB.1.raw
  modified_base (161)..(161): a, c, t, g, unknown or other
  misc_feature (161)..(161): n is a, c, g, or t
  modified_base (216)..(216): a, c, t, g, unknown or other
  misc_feature (216)..(216): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatcgacncagtctaccaaccactctgtctgtctcgtcgaagggacagacgccaccgtctccngactacggccagtcgagagtgttagcgtagacctaaacgttacgcccgtacggtaaccgacgtacgaaggtaaacgttcggaccgaacggtaccgtacccgaacggtccgttaccgtactagttacgtttcggtcgtcgttaccgaacggtacggcccgtggtacggtccgtacccgtaggtaccgtacggttacgaacggttcggaccgtaaggtcggtaccgttacggtacggggtaactacgggtacgtttacccgtaaccttacctaaccgaacgtaacgtaccgacgtaaccgtcgtacctacgcgtaacgttacgtacggtagttacgttacgtacttaacgttttacgtaacgttcgtaactacgtaaacttaagtaagttaacgttcgtaccgtcgtaccgttcgtacgttacgtacgttaccggtttcggaacccgggtaacggtaccaacgggtaccgttacgggaactaaacgtaacgaaaaccggttacgttacgggcgttccgtaaaccgg

SEQ ID NO: 242428 - DNA, 754 bp, Homo sapiens
  misc_feature: GYAE6OF01DZU0T.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtctccaaccactctgtctgtgtctccgaggggacagacgccaccctctcctgcagggccagtcagagtgtagcagacaacttagccgtaggtaccagaccgtaaggtaaaggttcggaccgacgggcctccccgaacggtccttcccgtcgtactttccggtttttagggtcggttaccgtacccgtacggttacggggccccgtcggttcgggttccggtaccccgtaggttcgtacgggttacgagggttcgggacgtaggtcggctcggtagggacctaggtacgttcaccgttcctacgaaccctactacgacgaccgacgtcccgtacgtacgtaacgttacgtaaggtaagttacgtttttacggactttaacggttttaactttaaccgttcgtaacgtaacgtaaccttaaaattaacgttaacgttaacggttaccgttacgggtacccgttaccgggttaagtttccggtacgtttaccgggtttaccgggacccgggtaacggggtaaccgtaacgggtcgtaacggtaacggtaaaccgttaacgaaaacggtaacggttacggtcggtcgtaccgg

SEQ ID NO: 242429 - DNA, 787 bp, Homo sapiens
  misc_feature: GYAE6OF01AU2GU.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtcctccgaggggacaggacgcccacccctctcctgccgagggccagtcagagtgtagcagcaacttagccgtggtaccagcaaggtaagttggccaggcctcccgaggcctcctctattcgtttggtcgtcgtcctaggtacgggcctcgttggtcgtccccgagtccgtaggtttccaggtcgggacaggtggtcccttggtcgggtaacgtaggtaccgtttccgaacgttcccgtaccacctacgttacgaccgaccgtcgtacccgttcggaaccgttacgggttacccgttaaggtaaacgttttacgtttttacggtaccgttttaacggtttttaactttacggtttacggtaaccgttaagttaacccttaaaagtttaaccgttaaagttaccgggttccttaccggggttaacccccgtttcggtttaaccggtttccgttaccccggttttaacgggtttttacccggggaacccggggttaaacccgggaccggttaaacgggtccgttaacgggggtaaccggtaaacccgttaaaccggttaaaacccgggtacgtttaccggggtaacccgggttcggtaaaccccgg

SEQ ID NO: 242430 - DNA, 897 bp, Homo sapiens
  misc_feature: GYAE6OF01A87CC.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtcgtctccgaggggacagacgcccaccctctccgtcgcgacggccagtcagagttgtagacagactaacgttacgccgtacggtaccgacgacgtaaggtaaaggttcggacccgaacggtccctacccgacggtccctaccgttactacgtttccggtttggtcgttacgtaccctacggtacgggccgtcgttcgggtcgtcccgtagtcgttacgggttacgacggtggacgtaggtcgggtaccgtcggtacggggtaacgtacgggttacgtttccgtaaccttccgtaccctaacccgtacgtaccggtaacggtcccgtaaccggtaccccgttggacccgttaagggtttacccttaacgggttaaacgttttaacggtttttaccgggtaaccgtttttaaacgggttttttaaccgtttaccgtttacggttaaccggtaaacgttaaccgtaaaattttaaaccggtttaaagttacccgggttaaccgttacccgggttacccggttacccgggttaagtttaccggttaacccggttttacccgggtttttaacccgggggtaaccccgggttaaaaccgggggtaaacccggttaaaccgggttacccgggtaaaacgggtaaaccggttaaaacccgttaaaccgggttaaaacccccggtaagggtttacccgggttaaccggtaccggttaacccggg

SEQ ID NO: 242431 - DNA, 680 bp, Homo sapiens
  misc_feature: GYAE6OF01AC6U6.35.85.H08.1.454.CMB.1.raw
  modified_base (131)..(131): a, c, t, g, unknown or other
  misc_feature (131)..(131): n is a, c, g, or t
  modified_base (140)..(140): a, c, t, g, unknown or other
  misc_feature (140)..(140): n is a, c, g, or t
  modified_base (171)..(171): a, c, t, g, unknown or other
  misc_feature (171)..(171): n is a, c, g, or t
  modified_base (206)..(206): a, c, t, g, unknown or other
  misc_feature (206)..(206): n is a, c, g, or t
  modified_base (228)..(228): a, c, t, g, unknown or other
  misc_feature (228)..(228): n is a, c, g, or t
  modified_base (261)..(261): a, c, t, g, unknown or other
  misc_feature (261)..(261): n is a, c, g, or t
  modified_base (329)..(329): a, c, t, g, unknown or other
  misc_feature (329)..(329): n is a, c, g, or t
  modified_base (457)..(457): a, c, t, g, unknown or other
  misc_feature (457)..(457): n is a, c, g, or t
  modified_base (577)..(577): a, c, t, g, unknown or other
  misc_feature (577)..(577): n is a, c, g, or t
  modified_base (650)..(650): a, c, t, g, unknown or other
  misc_feature (650)..(650): n is a, c, g, or t
  modified_base (676)..(676): a, c, t, g, unknown or other
  misc_feature (676)..(676): n is a, c, g, or t
tcagtacagatcgtcacgaccggtgctcgatttagtatcactcagtcggcgggggaggaactgctcagttacggaccagacggaaccagtggaacgcccagcgcagcttctcgttcctcctgcttagtccngcctccgantactcactggacaatgtgatgacgcagtccnccgaacactcgtctcgtgtcgtcctccggaggacncgacgtcctaacccgtctccgngtccgacgggaccacgtagacgacgttgttacnccaaggccttaaccgttcgtaccgtacggtaacacgtactaaggtaacgttccggacgaccggtaccncccggtaacggtcctctacgttacgttcgtttcggtacgttcggtacccgtacgtcgggtcccgtacgtcggttacggtccgtacggtcttcggtaccgtgtcgggaactcggtcggtccgttacggnggtaatcgtaagtccctacggactttaccggaaccttggacaacgccgaacgttcacggtacttcgacgtcgtaagttacgtttacacttacgttaactcggtataccattaataacgtntacgtatccgacgttcgacctgtaacgtcctaggtttaccgacggtttaacgcgttaaaggtctaaccgggtntaacccaagttcgtacgactttcggnaccg

SEQ ID NO: 242432 - DNA, 779 bp, Homo sapiens
  misc_feature: GYAE6OF01B3NSW.35.85.H08.1.454.CMB.1.raw
  modified_base (224)..(224): a, c, t, g, unknown or other
  misc_feature (224)..(224): n is a, c, g, or t
tcagtacagatcgtcacgaccggtgctcgatttagtatcactcagtcgcgggggagagctctggggaggaactgctcagttaggacccagacggaaccatggaagccccagcgcagcttctcttcctcctgctattctggcctcccagatatcactggaagaaatagtgatgacgcagtcctacccaaccactctgtctgtgtcctccgagggacagacgcccnccctctccgcgcgacggcagtcaggagtgttagcgagacgtaactacgccgtacggtaccaggacaaggtaaacggttcggaccgacggtcccgtacccggacggtcccttcccgttaccttagttttccggtttttaggtccgtttaccgtacccgtaaccgggttccgggtcccgtccggttcgggttccgtaccccgtaggttccggtacgggtttcgagggtttcggacgtgggttacggtccgttcggtacgggtaaccgtaggttaccgttaccgtaccgtaccgtacctaccgtactaccgacgacaccggtccgttacgacgttacgtacgtacgttaacgtttacgttttacgtacgttttaagttttaccgttacgttagtaccttaagtaacttaaagttaacttaagtaccgtaccggttacggttacccgttaccggttacggtttcgttaccgtttaaccgggttttccgggaaccgggtaaccgggtaaccgtaagggttacggtacgggtaaagttaccggtaaaccggtaaaaccggg

SEQ ID NO: 242433 - DNA, 783 bp, Homo sapiens
  misc_feature: GYAE6OF01BVNPX.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccacctctcctgcgacgggccagtcgagtagtgtagcagctaacttacgccgtaggtaccagacgtaagaacggtcgaccgacggacctcccgaggtccttcctactacgttcgtttgggtcgttaccgtccgtacggtacgggcctcggttcggtcgtcccctaggtaccgtaggttcgaggtcggtacgtacggtcgtccgtccggtagggaacctacgggtacgtttaccaccgttccgtacacctaacgtcgacggactacggtcccgtgacgtacggttagtaaggtaacggttttacgttttaccgtacgttttaaacggttttttaacttaccgtttagtaaccgttaagtaaccctttaaaagtttactttaaaagggttccgtaccgggtttacccgttacccgggttaccggttacggtttaccgttacccggttttaaccgggtttacccggggaaacccgggttaaccggggtaaaccctaacgggttacccggttaggggtaaaacggtaccgttaaacccgtaaaacccgggttacgtacggggtttccgacccggttaacccgg

SEQ ID NO: 242434 - DNA, 804 bp, Homo sapiens
  misc_feature: GYAE6OF01E5HEX.35.85.H08.1.454.CMB.1.raw
tcagtacagatcgtcacgaccggtgctcgatttagtatcactcagtcggcggggtaggaactgctcagttaggaccccagacggaaccataggaagccccagcgcagcttctcttcctcctgctattctggcctccagatatcactggagaaatagtgatgacgcgaggtcctaccaaccgactctgtctgtgtctcccgaggggaccagacgcccaccctctcctgcgacgggccagtccagtagttcgttagcagcctaacgttcgcctaggtacccagaccgaacggaaaggttcgggaccccgaggtcctccccggaggtacccgttccgtaactattcgtttggtgtcggtaccacggttacgggccctacgttcgggtccgtaccccaggtaccgtacgggtttccaaggttccgggactaagggttcgggtacctcgggtacggggtaacgtaaaggtaaccgtttaccaaccgtttcccgtacccgtaacccgtaacgtcccgaacggtaccgtacggtccccgtacggtaccgtacgttacccgttaaggtaacggtttaacgtttttacggtacctttaacggttttactttaaccggttacgttaccgaacgtaacgtaagttaacggttaacgttacggtacccgttaccggttacccgttaccgggttacgttccggtaccgttaacggttacccggtacccggtaaccgggtaacccgaacggtccccctagggtaacccgtaccgtaaaccggtaaccggtaaccgttcggttacccggtcgtacccgg

SEQ ID NO: 242435 - DNA, 1014 bp, Homo sapiens
  misc_feature: GYAE6OF01CWZFL.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctaccaaccactctgtctgtcgtctccgaggggacagacgcccaccctctcctgcgacgggccagtcgagtcggtagttacgcgagtactaaacttacgcccgtagggtaaccaggtacgtaaaggtaaacgttcgggacccgacggtacccgtaccccggacgggtcccttaccccgttaccgtaacgttttccggtttttcggggtacggtttacccgggttaaccccggtaaccgggttaaccggggggtccccggtttaccgggtttacggggttacccggtttaaccccccggtaagggtttacccggttaaccgggggtttaccgtacgggggtttaccggggtaccgttaacggggttccggggttacccgtttccggggttaacggggggtaaaacccccgttaaagggggtttaacccgtttttaaaccccgtccccggttttaacccctaaccccgtaaccccgggttaaacctttacccgggaacggtaaccccgggttaacggtcccccggttacgttacccgggtaacgtttaccggttaagggttaaacgggtttagttttttacgggtaacccggttttaaaggttttttaaccgtttacccggttagttaacccggttaaggtaaaaccgttaaattttaaacgttaaacgggtaccgttaccgggttacccgggttaccccggttttaccggttacggttttaccggtaaccgttttaccggggtttaacggggaaccccggggtaacggggtaaccgtaaacgggtcgggttaacgggaaagttaacccgtaaacgtaaaccggtaggttcggacgttcccggtaaaccgg

SEQ ID NO: 242436 - DNA, 717 bp, Homo sapiens
  misc_feature: GYAE6OF01BKPBD.35.85.H08.1.454.CMB.1.raw
  modified_base (513)..(513): a, c, t, g, unknown or other
  misc_feature (513)..(513): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagtaatagtgatgacgcagtctccaaccacttctgtctgtgtcgtccgagggacagacgccaccctcgtcctgcaggccagtacgagtagtgtacgcacgactaacgttcgaccgtacggtaccagacgtaacgtaaacggttcgaccacggtcctacccgtacggtcctcgtccgtactttcgttcggtcggtcgtacccgacggttacgggccctcggttcggtccgtaccctaggtcgaacggtttcgaggtcggcgttacggtcggtcctacggtacggactaggtaacctttcgaccgttccaccgtaaccgtacgtaccgtacgaccgtacgtccttaggacctgttacgtagtaacgtttnttaccgtaccgttaaccgtagtttacgtcgtaacctaacggtcggttaaccgtacggtaaccggttcccggacccgtaacgtaccggtacgtaccgttaccggtacggaaacccggtaaggtaaacccgtacgggttacggaaggtaaccgaaacgttaaacggtcgttacgggtactaccggttacgtccctacgttacccgg

SEQ ID NO: 242437 - DNA, 753 bp, Homo sapiens
  misc_feature: GYAE6OF01A6D43.35.85.H08.1.454.CMB.1.raw
  modified_base (354)..(354): a, c, t, g, unknown or other
  misc_feature (354)..(354): n is a, c, g, or t
  modified_base (380)..(380): a, c, t, g, unknown or other
  misc_feature (380)..(380): n is a, c, g, or t
tcagtacagatcgtcacgaccggtgctcgatttagtatcactcagtcgcggggaggaactgctcagttaggacccagacggaaccatggaagccccagcgcagcttctcttcctcctgctatctggctcccagatatcactggagaaatagtgatgacgcagtctccaaccactctgtctgtgtctccgaggggaccagacgcccaccctctcctgccagggccagtcagtagtgtagcagactaacttacgccgtaggtaccagtaccgaagtaaacggttcgggaccacggtcctaccccgaggtccctcctacgtactttcgtttggtctcgtaccgtacgtacgggccgngttcggtccgtccagtccgtaggtcnggttcggcgtacggtcggtaccgtggtacggaactaggtaccgttctaacctccgtaccaactcgtccgtaacgcctaccggtcgtacgtacgtaccgttacgtaagttaagtttcgtttaggtaacttttaacgggtttactttacgggtactaccgtaagttaaactaaagttaacgtaacgtacggttacccggttaccgtacccggttacggttacgttacccggttaacccgttttaccgggtttaccgggacccgggttaaacgggggtaaccttaacccgggtagggttaaacgggaaacccctttaacccgggtaaaccggtaaaacgggtttcccggtacggtaaccggttcccgtaaaccccg

SEQ ID NO: 242438 - DNA, 710 bp, Homo sapiens
  misc_feature: GYAE6OF01C1VZ1.35.85.H08.1.454.CMB.1.raw
  modified_base (149)..(149): a, c, t, g, unknown or other
  misc_feature (149)..(149): n is a, c, g, or t
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (398)..(398): a, c, t, g, unknown or other
  misc_feature (398)..(398): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctatctggcctccagatactcaacgtgganaaatgtgatgacgcagtcctaccaacactcgtgtctgtgtcctacggagggacacgacncccaccctctccgngtccgaggacctagtcgaggtagttgtaacgcgaagcctaacgttacgcgtacggtaccagacgtaaggtaacggtcgaccgtacggcccttcccgacggtccttccgtattacgtttcgttttgggtacttcggtacccgtacggtcgggtaccgttcgtcgggtacccgtccgngtcgtacggttcgaggtcggaagtcggtcgcgttacgggcggtaactcggttaactcctaaccttccgactaaccgactccgacgtctacggtcctcggacgttagtacgtaagttaacgtttatttcggtacgtttaacgttttaacttcgggttactaacgtagttaaactaataaactaggtaacggttcgtaccggttaccgtacggttcgttaccgttacgttaccggtttggaaccggtacggaacgtacgtacggaggtaactaaacgtaaccgtaaacggttacgtaggtccggtcgtaaccgg

SEQ ID NO: 242439 - DNA, 739 bp, Homo sapiens
  misc_feature: GYAE6OF01BRV2W.35.85.H08.1.454.CMB.1.raw
  modified_base (180)..(180): a, c, t, g, unknown or other
  misc_feature (180)..(180): n is a, c, g, or t
tcagtacagatcgtcacgaccggtgctcgatttagtatcactcagtcgcgggggaggaactgctcagttaggacccagacggaaccatggaacgccccagcgcagccttctcttcctcctgctattctggcctcccagatatcactggaagaaatagtgatgacgcagtcctaccaaccnctctgtctgtgtctcggaggggacagacgccctaccctctccgtgcgacggccagtcgaggtacgttgtacgacacgtactaacgttacgccgtacggtaccaagtacgaaagggtaaggtcggaccgacggtaccctacccgacggtcccttcctacgtagtttccgtttggtcgttaccgtacccgtacggtacggggtcccgtcgttacgggtccgtcccgtaggttaccgtaggttccgagggtcggacgtacggtggcgttacggtagggactagggtccttacctaccgttccgtaccactacgtccgaacggcctaccggtccttaggaccgtagttacttaaggtaacgtttacgttttacgtacgtttaagtttacttacgttacgtactaacgtaacttaaagttaacgtaacgttacgtaccggttaccggtaccgttcggtacgtttaccgtaccgttacggttaaccggggacggtaaccgggtaactacgggtcaacgggtaacgtaacgtaaccggaaacgttggtacggtacgtcgtaaccgg

SEQ ID NO: 242440 - DNA, 864 bp, Homo sapiens
  misc_feature: GYAE6OF01CXRK2.35.85.H08.1.454.CMB.1.raw
  modified_base (150)..(150): a, c, t, g, unknown or other
  misc_feature (150)..(150): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctcggctcccagatactcacgtggaanaaatagtagatgacgcgatcctaccaacctctctgtctgttcgtccgtcggaggggacaggaccgcccctacccttctccgtggaccgacgggtcctaggtccgagtaggtacgtacgacgacgtacctaacgttcggtacccgtggtaaccagacgtaaaggtaacggttcggaccgacggtccctcccggacgtccctccgtacgttacgtttgtttcgggttacgtccgtacccggtacggtccgggtcccgtcgttaccgggttccgtaccccgtaggtcggtacggttcgtgggtcgtcggtacggtcgtccggtacggacggtacgtacggttaccttaccgtaccgttcctaccgtaccgacttaccgaaccgggtacctaccgggtacccgtacggttaccggtaagtttaacccgggtaggtttaacgtttttacgtttaacgggttacctttaaaggtttttaccgttacgttacgggtaaactaaacgtttacgttaaaaccgttacggttaacgttaccgggttccgttaccgggttaaacccccgttgggtttaaccggttaacccggtttacgttttacccggggttacggggtaacccggtaacggggttaccggttaaaccgggtcgtaacgggttaaactacccggttaaaacctaaccggggtttcgggaaacgttcccgggttcccgtaaaccgg

SEQ ID NO: 242441 - DNA, 767 bp, Homo sapiens
  misc_feature: GYAE6OF01ER4UL.35.85.H08.1.454.CMB.1.raw
tcagtacagatcgtcacgaccggtgctcgatttagtatcactcagtcgcgggggaggaactgctcagttaggacccagacggaaccagtggaacgccccagcgcagcttctcttcctcctgctattctcggcctcccaagatatcacgtggaagtaaatagtgatgacgcagtcctaccaacctctctgtctgtgtcctaccgagggacacgcgcccacctctcctgcgacgggccagtcaggtagtgtacgcgagacctaacgttacgccgtacggtaccgagacaaggtaacgtcggccgaggacctcccgacggtcctctcgtacgttcgtttcggtcgttcgtccctaaaacggtcggtcccgtcgttcgggttaccgtaccgtcggttacgtacggggttacgtacggtacgggtacgtacggtcggtcgttacggtacgggaactacggtacggttacctaacgttccctaacccgtaccgtaactaccgtaacggcctaaccggtcccgtacgtacgttaaccgtacgtaacggttaacgttacgttttacgttacgtttaacggttttaacttacggtttagtaccgtaacggtaaacttaaacttaaacgttaaacgtaccgtttaccgggttacccggttccttaccgggttacggtttaacggttccgtttaccggttacgggtacccggtaacgggtaaccgtaggtacggtacgtagtaaccgtaacgtaaacgtggttaacgcggtcgtaccg

SEQ ID NO: 242442 - DNA, 898 bp, Homo sapiens
  misc_feature: GYAE6OF01ET8V1.35.85.H08.1.454.CMB.1.raw
tcagtacagatcgtcacgaccggtgctcgatttagtatcactcagtcgcggggaggaactgctcagttaggacccagacggaaccatggaacgccccagcgcagccttctcttcctcctgctattctggcctcccagatactcactggaagtaaagtagtgagtacgacgctagtcctacccaacctactcgtacgtcgtgtcgttccgtcgacggggacacggccgacccaccctcgtccgtggccgacggaccacgtacgacgtaggttagttacgcgagaccttaacgttacgccgttacggaccgtaacggaacaaaggtaacggtcggaccgtacgggtccctacccggacggttccctccttacgtacgtttccggtttggttccgttacggtacccgtacggttaccggggtccgttccggttacggttaccgttcccggtaacggttccgtaacggttcgacgggttcggacgtacgggtcgtacggttcggtaacggggtactaacgggttaccgttaccgtaccgttaccggaaccctaaccgtaccgtaaccggtacccgtcgtaacccggttacccgggtacgttaaccgttaaccgggttaccgtttaacggttaaaccgttttacgggttttaacgtttaaacccgttttaacgttttaaccggttttaacccgtttaacggtttcgaaaacgtttaaccgttaaacgttaaacggtaacgtttaccggtaaccgtttccggtaaacccgttccggttaagtacccggttaaccgttttaccgggtcccggggtaaacgaccggggtaaacgttaccggtcgggtaaaccggttacgtaaacgttaaacccgggtaacggttagtacggtccgtacgtacccgg

SEQ ID NO: 242443 - DNA, 769 bp, Homo sapiens
  misc_feature: GYAE6OF01AI4S4.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatactcactggagaaatagtgatgacgcagtctccaaccactctgtctgtgtcctccgaggggacagacgccaccctctcctgcagggccagtcagagtgttagcagcaacttagcctggtaccagcaagtaagttggccaggcctcccaggctccgtcattcctttggtgtcgtccgaacgttacgggcccgtcttgggtcgtcccctaggttccgacggtttccaggttcgggctacgggttcgggtccgtcggtacggggaacctagggtacgttttaccccgactttcccgtacctaaccctacgttaccgaacggtaccgtaacggtcccttcggtaacccgtacggtttcccgttaaggtaaaccgggtttacgtttttaacggaccgttttaacggtttttaacgtttaccgtttacggttaccgtaacggttacctaaaagttaacgttaaacgttacgttcccgttacgggttaccccgttccggttaacggttccgttaccgtttaaccggttttaccgggaacccgggtaccgggggtaacccgtaacggtcccggttagggtaacgttaaaccgttaaccggaaaaccgttaaccgttacgggttaccggtaccggttaccgg

SEQ ID NO: 242444 - DNA, 644 bp, Homo sapiens
  misc_feature: GYAE6OF01ACHL6.35.85.H08.1.454.CMB.1.raw
  modified_base (149)..(149): a, c, t, g, unknown or other
  misc_feature (149)..(149): n is a, c, g, or t
  modified_base (175)..(175): a, c, t, g, unknown or other
  misc_feature (175)..(175): n is a, c, g, or t
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
  modified_base (251)..(251): a, c, t, g, unknown or other
  misc_feature (251)..(251): n is a, c, g, or t
  modified_base (405)..(405): a, c, t, g, unknown or other
  misc_feature (405)..(405): n is a, c, g, or t
  modified_base (463)..(463): a, c, t, g, unknown or other
  misc_feature (463)..(463): n is a, c, g, or t
  modified_base (477)..(477): a, c, t, g, unknown or other
  misc_feature (477)..(477): n is a, c, g, or t
  modified_base (504)..(504): a, c, t, g, unknown or other
  misc_feature (504)..(504): n is a, c, g, or t
  modified_base (636)..(636): a, c, t, g, unknown or other
  misc_feature (636)..(636): n is a, c, g, or t
tcagtacagatcgtcacgaccggtgctcgatttagtatcactcagtcggcgggggaggaactgctcagttaggacccagacggaaccatggaacgccccagcgcagcttctcttcctcctgctattctggcctccagatatcactgganaaatgtgatgacgcagtcctccaacncttctagtctgtntcctccgagggacngacgccctacccttctccgtagccgaacgggccaaggtcagtaggtttntacggcctaagtctaaacgtgcccgttagaccagcaaggttaatcgaccaggtcctccgagccctcctagtcttgtttaggtcgtaccgtacacggtcgggccttgtcgggtacctcccgagtccgtaggttcaggttcgcaggttcgctacgnggtacagttacttcccgattccgtcaacgtctacgaccgtcgactctcgactaccggngttaacgtacgttntttaaccgtctttaaggtttacctcgngttaaccgagttacgtaagtagttacgtgttaccggtacgtcgtaacggtcttcggaactttcggacggttacgacgggtactaggtacgttaggtacctaacggtaaccgaacccgtttggctaaacggtntaacccgg

SEQ ID NO: 242445 - DNA, 660 bp, Homo sapiens
  misc_feature: GYAE6OF01BIOSI.35.85.H08.1.454.CMB.1.raw
  modified_base (186)..(186): a, c, t, g, unknown or other
  misc_feature (186)..(186): n is a, c, g, or t
  modified_base (454)..(454): a, c, t, g, unknown or other
  misc_feature (454)..(454): n is a, c, g, or t
  modified_base (497)..(497): a, c, t, g, unknown or other
  misc_feature (497)..(497): n is a, c, g, or t
  modified_base (641)..(641): a, c, t, g, unknown or other
  misc_feature (641)..(641): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtctccaaccactctgtctgtntctccgaggggacagacgcccaccctctcctgccgaggccagtcagtgtgtagcagtactaacttagccgtggtaccagctaaggtaaggtcggaccgaggaccctccgacggtccttcctctatttcgtttggtgtaccgtcccgtaacggtacggggccgtcgttgggtacctcccgtaggtccgtaaggtttcgaggtcggtcgtaggtcggtccttcggtacggggaaccaaggttcttacccacgttaccctaccaaccgtanccgtaacggcctacggcctagaccgtagtctaaggtaagtttnttcgtacttaagtttactaccgttggtactaagactaaactagttaacgtcgttctccggttcctaggttagttaccgtcttacggtttcggaaacccggtacgggtaacacggttcctaagggaatactaaccgaaaacgttnttacgggcgtaagtacccg

SEQ ID NO: 242446 - DNA, 724 bp, Homo sapiens
  misc_feature: GYAE6OF01CRDGZ.35.85.H08.1.454.CMB.1.raw
  modified_base (380)..(380): a, c, t, g, unknown or other
  misc_feature (380)..(380): n is a, c, g, or t
tcagtacagatcgtcacgaccggtgctcgatttagtatcactcagtcggcgggggaggaactgctcagttaggacccagacgaaccatggaagcccagcgcagcttctcttcctcctgctattctggctcccagatatcactaggaagaaatagtgatacggacgctagtctacccaaccactctgtctgtcgtctccgaaggggacagacgccctaccctctcctagcgacgggtaccagtcgaagtagttggtagacagactaacgttacgccgtaggtaaccagacgaaggtaaaagtcgggaccgacggtccaccgaggtcctcctactattcgtttggtcgttcgtacccgacgttacgggccgtcgttcgggtntacccgacgttacgtacggttctacggtcggtacgaggtcggtaccggtacgtacgggaactacggttaacgtttccaaaccgtttccaactacccgtaacgtacgacgtaccgtcgaccctagtaccgagttacgttagtaacggttatttacgttacttagttttaactttaccgttattagaacgttaagtaaattaagtaacgtaccgttaccgtcgttacccgttaaggttcgttaacgtaccgtttaccggtttacggggaaccggtacgggtaaccgtaggtaaccgaagggtaacgtaaactaaccggtaaaacgtaccgtttggcggtactacgg

SEQ ID NO: 242447 - DNA, 788 bp, Homo sapiens
  misc_feature: GYAE6OF01BRNLZ.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtcctccaaccactctgtctgtgtcctccgaggggacagacgcccaccctcctcctgcgacgggccaggtcaggtagtgttacgcgacgactaacgttaccgccgtacggtaacccagacgaaaggtaaacggttcgggaccgtacgggccctaccccgacggtcccttccgttaccgtacgtttccgggttttgggtcgttaccgttacccgacgggttaccggggtccccgttcggttcggggttacccgttccccgtagggttcccgttacgggtttccgaggggttccggcgttaggttccgggaccgtttccgggtaggggaacctagggttacgttaccaccttaccctaccgtacctacgtacgacgaccgtacgcctacggtctaggtactaggttaacgtttagtttcgtaacgttttaaggtttacttacgttcggtactaaggtaacttaagttaacgtaacgttacggtaccgttcccggtacgtttaaccggttcgttacgttacccgttttaccggttaccgggtaacccgggtaccggggtaacctacgggtccggtaaaggacggttaaacgtaccggtaaacggttagttcgggtacggtccggtaccg

SEQ ID NO: 242448 - DNA, 745 bp, Homo sapiens
  misc_feature: GYAE6OF01BSAQS.35.85.H08.1.454.CMB.1.raw
  modified_base (123)..(123): a, c, t, g, unknown or other
  misc_feature (123)..(123): n is a, c, g, or t
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
  modified_base (395)..(395): a, c, t, g, unknown or other
  misc_feature (395)..(395): n is a, c, g, or t
tcagtacagatcgtcacgaccggtgctcgatttagtatcactcagtcgcgggggaggaactgctcagttaggacccagacggaaccatggaacgccccagcgcagcttctcttcctcctgctnttctggcctccagatactcacgtaggaagtaaataggtgagtcgaccgctacgtcctaccaaaccgtcttctgtctgtcgtcctcggagggacacgccnccctacctctccgtgcgtacggcagtcgaggtagtntacgcgacgtactacgttacgccgacgtacgacgagtaaggtacggtccgacgtacgcctaccgagttccctactcttacgtttcgtggtcgtacgtccgtaggccggcgtcgtcggtccacgtagtacgagttcgnggtcgtcgaggtcgtcggtacgtaggcgtacgttcttacccgactcccacgtaacgaccgttacgacgtacctccggttacgtacgtacgtacggttaacgtaggttacgttttacgtttcgtacgttttaacgtttcgtaaccttggtaaactaaccgttagttaaaacttaaccgttacgggttaactcccgggtttaccgggttaaccgtaccggttacggtttaccgttacgttttacccggggtcccggtaaacgggtacggtaaccgttaaggtccgggtaaaccgttaaaggttaaaccgtaaccggtaaacgggttcgggttaccggtgttaacccggtaac

SEQ ID NO: 242449 - DNA, 634 bp, Homo sapiens
  misc_feature: GYAE6OF01EYC1B.35.85.H08.1.454.CMB.1.raw
  modified_base (134)..(134): a, c, t, g, unknown or other
  misc_feature (134)..(134): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (525)..(525): a, c, t, g, unknown or other
  misc_feature (525)..(525): n is a, c, g, or t
tcagtacagatcgtcacgaccggtgctcgatttagtatcactcagtcggcggggaggaactgctcagttaggacccagacggaaccatggaacgccccagcgcagcttctcttcctcctgctatctgcctccanatatcactggaataaatagtgatgacgctagtcctccaaccactctcgtctgtcgtcgtccgaggggacagacgccccaccctctccgtcgccgacgggccagtcagtgtagttacgcacggtactactacggcctaggtacccagacgaagtaacgttcggacccgaggtccctccggacggtccttccgtcgtactttccggtttggcttcgtacccgtacggtacgggcctcgggtgtccgtcctagtcgacggttcnggtcgntggtcgcttcgacgggactacgtactccgtaacttcaccgaactacgtcaccggtcacgtacccgtagtaccgtcgtacgttaagtacgtttaacgtttagtccgttagtttaacgtcttacgntaacgtactaataccgtaagttacgtcgttacgtccgtgtagttcaccttcggttacgacggacggtagacgcgtacgacgacgtaacccgaatacgtcggtagcctcg

SEQ ID NO: 242450 - DNA, 828 bp, Homo sapiens
  misc_feature: GYAE6OF01DOCVJ.35.85.H08.1.454.CMB.1.raw
  modified_base (181)..(181): a, c, t, g, unknown or other
  misc_feature (181)..(181): n is a, c, g, or t
  modified_base (224)..(224): a, c, t, g, unknown or other
  misc_feature (224)..(224): n is a, c, g, or t
tcagtacagatcgtcacgaccggtgctcgatttagtatcactcagtcgcgggggaggaactgctcagttaggacccagacggaaccagtggaacgccccagcgcagccttctcttcctcctgctattctggctcccagatatcactggaagaaatagtgatgacgcaagtccaccaaaccntctcgtctgtgtccgtccgaaggggaccagacgccctaccctntcctgccgagggcccagtcagtagtgtagcgatactaacttcgccgtaggtaccagacgaaggtaagttcggaccgacggtcctaccccgaggtccgttcccctacgtagtttccgtttggccgttctacccgtaacggtcggccgtcgtcgggtccgccgtaggtcgtaggttcgaggtgacgtcggcgtcgtaggtacgggaactagttacgtacctaccttaccacctaacgtaccgtaccgacggtaccgacggtcccgtacggtaccgtaagttaccggtaacggttaacgtttacgttttcggtaaccttttaagttttaacgtttaaccgttacgtttaaccgtaaacggttaaaccgttaaatttaaacgttaacgttaccggttacccggtttaccccgggttaacccgttaccgggttaaccggtttcccggtttaaccggttttacccgggttttaacccggggaaacccgggttaaaccggggtaaacccgtaaacggggttccggttaaacgggtaacccgtaaacccggttaaaaccggtaaaacccgggttaaggtttacccggggttaaccggtacccgttaaccggg

SEQ ID NO: 242451 - DNA, 720 bp, Homo sapiens
  misc_feature: GYAE6OF01COJNZ.35.85.H08.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (252)..(252): a, c, t, g, unknown or other
  misc_feature (252)..(252): n is a, c, g, or t
  modified_base (426)..(426): a, c, t, g, unknown or other
  misc_feature (426)..(426): n is a, c, g, or t
tcagtacagatcgtcacgaccggtgctcgatttagtatcactcagtcgcgggggactgcttcagggcagttggtagatgcccctctgggagagactccccaggggtgacagccatcggaccctggaagggcctgggcgtagggacaggggaccagacgccagtccgagggagaggacgagagccaatggacgtggggtntactgtaacngcctgctggcgagagggaccaggcaccgtcctaccgagggacnccatgctgcaggtcggccaggacggtcgcccgtagaacctaggaacggccaaagtggaacgaaccccaaggtaaccgaacgggtacccgaagggtttggggttacgacggaccggtaccccgtgggaacggacggtccgtcggggtcccctagggtccccagggtccacggtcnccggtccggcccgtgcctcgtccgtcggtggtacgggtccgtacgccgtaggtcgtacccgtccgtacggtcgccggagtcccgtcggaccctaccgttggtcggtaccggaccgaaccggaaccggtaaccggaccgggaacccgcggtaacccggtgaccgggtactcggtacggtaacggcgaccggaccgtaccgtcgtaccgccggtcccgtagggccggacggtcggtaacgggccgggtaccgacggtaaccgacccggaaacccgtacccggaacccccgtacccg

SEQ ID NO: 242452 - DNA, 698 bp, Homo sapiens
  misc_feature: GYAE6OF01B0JPB.35.85.H08.1.454.CMB.1.raw
  modified_base (175)..(175): a, c, t, g, unknown or other
  misc_feature (175)..(175): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggaagaaatagtgatgacgcagtctaccaaccncttctgtctgttgtctccgaggggacagacgccaccctctcctgcgaggccagtcagtagttgtaagcagactaacttacgccgtacgtaccagacaagtaacggttcggaccacggtcctacccgcggtaccttacctcgtacgttcggtttcggtagtcgtaccgtacggtacgggcctcggtcggtctacccgtagtcgtacggttacgaggtcgcgtaggtcggacgtcggtacgggagtacggttacgtacctaccgttccgacctaaccgtacttaccgaagtcccgtaacggtccgttcggtacctacgggttaccgtagtttaaacgttacgttttaacggtaccttttaggttttaacttacgtacgttaacacgtaacttaaggttaacttagtacgtacgttaccggttcctacgtgttcgtaccgtttacggttccggaacggtacggtaacccgtaggtaccgtaggtaacgtacgtaaaccgtaacggtaggtcgtacggcgtaaccgg

SEQ ID NO: 242453 - DNA, 776 bp, Homo sapiens
  misc_feature: GYAE6OF01E3WYK.35.85.H08.1.454.CMB.1.raw
  modified_base (250)..(250): a, c, t, g, unknown or other
  misc_feature (250)..(250): n is a, c, g, or t
  modified_base (689)..(689): a, c, t, g, unknown or other
  misc_feature (689)..(689): n is a, c, g, or t
tcagtacagatcgtcacgaccggtgctcgatttagtatcactcagtcgcgggggactgcttcagggcagttggtagatgcccctctgggagagactccccaggggtgacagccatggaccctggaacggcctgggctaggggacagggaccagacgccagtccgaggagagacagacgccaagtggacgtggggtcgtactagtaacacgccctggctcggcgaggacgggaccaggggccacccgtccnccgagggccccatcgctgccaacggtccggcaggacggtcgtcccccgtagaacccgtcggaaacggcccgtaaacgtcggaaccgaaccccaaacggacctaaccgggacctaaagggttcgggttaggtacggaaccgtccccgtaggaacgggacggtcccgtacggggtccccggtcgggtacccgacggaccgaccgggccggtcccgtccggtacccccgtgggcctcggcttacgggtcccggttaggggtcccgtcgggtcccgttacgggttcccggcccgggtaaccctcgggtccgtcccgtcggtacccgtccggacccgtacccgtaggtcggttccgaccgacccggaacgaaacccggggtcccgggaacccgacggtaccccgacggggaccaccggttacgtaacgggtacgaacccggtancccgggactcctacccgacggcctcgggtccacgggttcgacgggtcgggacgcggaccccagtaccccgtaaccgcccctaacccg

SEQ ID NO: 242454 - DNA, 822 bp, Homo sapiens
  misc_feature: GYAE6OF01BVPUG.35.85.H08.1.454.CMB.1.raw
  modified_base (229)..(229): a, c, t, g, unknown or other
  misc_feature (229)..(229): n is a, c, g, or t
tcagtacagatcgtcacgaccggtgctcgatttagtatcactcagtcgcggggaggaactgctcagttaggacccagacggaaccatggaacgcccagcgcagcttctcttcctcctgctattcctggcctccgagatactcacgtggagtaaatagtgactcgacgctacgtcctaccaacctactctcgtctgtcgtctaccgagggacaggacgccaccgtctccncgacgacggcctagtcgagtacgtagttacgacacgtacaacgttacggaccgtaacggttaaccaggtaccgtaaaaggtaaacggtcggaaccgtaacggtccctaacccgacggtacccgtacctacggtaacgttttccggttgggtaccgttaccgtaccggtaaccggtacgggcccgttcggtaggtcgtaaccccgtgtacggttacggttacgaacggttcggacgttaacgggtcgtaccggtacggtacgggtaacctaggtaacggttacctaccgtacgtaccaaccgtagttaccacggtaccgcggtaaacccttcggaaaccgttacggttaacgtaacggttaaagttccggtttaactacccgggtttaattttaaccggttctaaacggtacgttaacgtaacgttaaaactaacgtagtaaccggtaccgtacgtaacccgttaggttaacgttacctaaccggtttacgttaacgggacccggttaaacgggaaccggtttaacgaacggggtttaaccgaagttaacccgtaaccggttaaacggaaggtttacggccggaacttaaccgg

SEQ ID NO: 242455 - DNA, 949 bp, Homo sapiens
  misc_feature: GYAE6OF01BW8O8.35.85.H08.1.454.CMB.1.raw
  modified_base (335)..(335): a, c, t, g, unknown or other
  misc_feature (335)..(335): n is a, c, g, or t
tcagtacagatcgtcacgaccggtgctcgatttagtatcactcagtcgcgggggactgcttcagggcagttggtagatgcccctctgggagagactccccgaggggtcgacacgccagtcggacccgtgggaacgggcgtcgggcgtagggacgacgggaccaggacgccgtacggtccggaagggagaacggacgacgacgaccgaagtcgggtacggtgggggttactaacgttaacggtaaccaccgtcccgtcggtaccggtcgggacggaagggaacggggaaccggacgggacccgtacccgtcccggtaccggacgggaccgacccgngtccgcgtacggacgaacgggtcggaccgacggacggtccgccccgtaggtaaccgacgtaaccggaccaacggtacgaaccggaaccccgaacggtaacgaaccgggtacggtaacggggttcgggtttcgggaaccggtaaccggtaccccggtagggacgggacggtccccgggttccgggtacccgtccgggtaccccggtacggccgacggcccgtacccggtccccggtcccgtcgtccggtcggtccgtcgggttaccggtccgggttccgtacgggtacccggtccgggttcccggtaccccggacccgtccgggttccggtacccgttcccggtccggtaccccggccggttaacccggtacggtttacccgggttacccgacccggaaacccggtaccggggaacccccggtcccggggaacccgtacccgggtaacccggttccggacccgtttaccggtacggtaaccggtacggaccgtaccgcccggtacccgtacgacccggtacggcccggtccggcggttaaccggcggttcgggcccgggtacggtacccggacccggaacccggtccccggaaaccccggtccccgtaaacccgg

SEQ ID NO: 242456 - DNA, 862 bp, Homo sapiens
  misc_feature: GYAE6OF01BCJS8.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtcgtctccgaggggacagacgcccaccctctcctgcacgggcctagtcaggtagtgttagcagactaacttgcctggtaccagcaaggtaagttcggaccgaggtcctcccgaggcctcctctacgttcgttttgggtcgttcgtacccgtacggtacgggtcccgtacgttcgggtccgtacccgtaggtccgtaggttccgagggtcggacgtaggtcggtccgttcggtacgggactacggttacgtttaccaccgttcccgtaccaacccgtagttaccgacggaccgtacggtccccttaggaccgtaacgggttaccgtaacgggttaaacgtttcgttttaccggtaaccgttttaacgggtttttaaccctttacggtttaccgggtaaccttaacggtaaccctttaaaagtttaacgtttaaaccgttaccggtttaccgggttacccgggttaaccccgttacccggggtttaacgttcgggtttaacccccgttttaccggggtttttaaccgggggaaacccccgggttaaacggggggttaaaccccgttaaaggggtccccgggttttaaacgggggaaacccgtttaaaccggtaaaaccccgggtaaaacgggtttaaacccgggttcggggttaacccgggtaacccggtttaaacccggg

SEQ ID NO: 242457 - DNA, 741 bp, Homo sapiens
  misc_feature: GYAE6OF01B7GTJ.35.85.H08.1.454.CMB.1.raw
  modified_base (175)..(175): a, c, t, g, unknown or other
  misc_feature (175)..(175): n is a, c, g, or t
  modified_base (242)..(242): a, c, t, g, unknown or other
  misc_feature (242)..(242): n is a, c, g, or t
tcagtacagatcgtcacgaccggtgctcgatttagtatcactcagtcggcggggaggaactgctcagttacggacccagacggaaccatggaacgccccagcgcagccttctcttcctcctgcttattctcggctcccagatatcctacgtaggaagtaaattagtgatcggacncagtcctaccaacctcttctgtcctagttcgtacctccggagggaccagccgtacccacctctccgngacggacgggcctaaggtacgaggtagtttgtacgcacgtaacgtaacttacgccgtacggtaaccgacgtacgtaaggttaaacgggtcgacgtacggtcccgtaccgacggtccccttcgtaccgttagtttcggtttggctaccgtaccgacggtaccgggccgttcggtcgggtacctaccgtacggttacggtaacggttcgaacggtacggacgtacgttcgggtccgtggtaacgggaacttaggtaacgttactaacccgtcttaaccgaccgtactaccgaaggtcccagtccgtagacgtacgttagtaacgtaagtttaccgtttagtaaccgttttagttacttacgtgtaactctaaagtaatttaagaccgttagaccggttaccgacgttcttgggtacccttacgttaccgttacgggaaccgagggtaaccctaaggcgtaacgggtacaaagttaaacccggacttaaggcgtcgcgtacc

SEQ ID NO: 242458 - DNA, 663 bp, Homo sapiens
  misc_feature: GYAE6OF01CFL0A.35.85.H08.1.454.CMB.1.raw
  modified_base (167)..(167): a, c, t, g, unknown or other
  misc_feature (167)..(167): n is a, c, g, or t
  modified_base (658)..(658): a, c, t, g, unknown or other
  misc_feature (658)..(658): n is a, c, g, or t
tcagtacagatcgtcacgaccggtgctcgatttagtatcactcagtcgcggggaggaactgctcagttaggacccagacggaaccatggaagccccagcgcagcttctccttcctcctgctattctggcctccagatactcactggaagaaatagtgatgaccgacngtcctaccaaccacttctcgtctggtcgtctccgaggggacagacgcccacctctcctgccgacggccagtcaggtagtgtagctacgactacttgaccgtcggtaacagacaaggtaacgttcggccaacggcctcccgaacggccttcctatacgtttgtttacgtcggtaccgtaccctacggtaccggggccgttccggtggttacccgtcccgtaggtcgtacgggttgcggtcgtacggacggtcggtacttacggacgggtaacaggtccgttacaccttccgacctaaccgtagtaccgtaccgacgacgtcctacgtacgtgtaccgtagttacgttagttttacgtactttacgtttaccgttacgtacttacaccgtaataattagtaacctgtcccgtacgtcgttacgtggtacctagttcgttacggccggtacgggactaggtccgtagaccgtagtaaccgtaagtcgtagcgtntaccg

SEQ ID NO: 242459 - DNA, 933 bp, Homo sapiens
  misc_feature: GYAE6OF01C3URC.35.85.H08.1.454.CMB.1.raw
tcagtacagatcgtcacgaccggtgctcgatttagtatcactcagtcgcgggggaggaactgctcagttacggacccaggacggaaccagtggaacgcccagcgcagcttctcttcctctgcttactctgctccagtactaccactaggaagaaattagtcggtatcggaaccgcgtacgttcctaccgaaccggtcccacccgttggtcttgtttacgtccggtaaccgggaggggggaaactaccgtcctaccgttcccctttccgtacggacggacgggtaccggggtacctaaggttacgaaggttaacggttacgttaaccgggaaacgtaacggtttgttaaccgtacgtaaaccgcggtaaccaaacggtaccgtcggaccccggacgtaccctcccggtacggtccctactacttaaggtccgttaggtcgactacctaccgtccggaaccggtggacccgttaacttacggtaccccacggtaccgggtacccggtttagtacgtacccggggaggtttacccggtaggggttcggttaacggttacgggaacctaacttttacccggtaccttaacggtaccccaacgttaccctataccgaacgtaccgtaccgtaccggttacgaccgttacggtacgtaaacgtaacgttcgttaacttaggtttaaccgttacgtttaactaccgttacgtaacgggtactttaacggttaacgtttacggttaccggttaaccgggtcccggttaccggtcccggttaccggttcgtttaacccgggttaccgggttaaccgggggtaccggggttaacgggaaaccggggtttacgggaacgggttaaaccgggttaaacgtaaacccgggttaggttaaccgggttaccgggttattaacccgacgtacccgtaaacggtttcccg

SEQ ID NO: 242460 - DNA, 776 bp, Homo sapiens
  misc_feature: GYAE6OF01AT38U.35.85.H08.1.454.CMB.1.raw
tcagtacagatcgtcacgaccggtgctcgatttagtatcactcagtcgcggggaggaactgctcagttaggacccagacggaaccagtggaagccccagcgcagcttctcttcctcctgctattctggcctcccagatatcactggagaaatagtgatgacgcagtctccaaccactctgtctgtgtctccgaggggacagacgccaccctctcctgcacgggcctagtcagagtgttacgcgagcaacttgcctcggtaccagcaacggtaaagttcggacctaggcctaccccgaggccttccgtacacgtttcgttttacgggtgttccgttacccgtaacggttaccgggtcccgtcgttcgggttccgtaccccgtaggtccgtacggtttccgaaggtcgggtcctacggttcggcccgttcggtacggggaactacggtacgttcccctacgttccgtaccaccgtactccgagtccgacgtcccgttgaccgtcgtaccgtaaggtaactttacgttttccgagttttaaccgttttataccgttgtacctaacggtactaaagtttaaccttaaacggttcggtacccgttccggttaaccccgttacccggtaagttttcccggtaacgttttacccggtttaccgggaaccccgggtaccgggggtaacccttaacgggtcccgtttaggggaaacccgttaaacggttaaccccgggaaaaccggttaaccggtttcgggtaacccggttacccgttaaccggg

SEQ ID NO: 242461 - DNA, 680 bp, Homo sapiens
  misc_feature: GYAE6OF01AGW6B.35.85.H08.1.454.CMB.1.raw
  modified_base (370)..(370): a, c, t, g, unknown or other
  misc_feature (370)..(370): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagtaaatagtgactgacgctagtcctccaacctactctgtcctgtgtcctccgaggggacacgacgtcccaccctctccgcgtcgacgggtcagtcaggtagttcgtagctagactaacgttgcctaggtaccagactaggaagtcgccgtagcctaccgagtctcctgtacttcgtttgcgtctcccacgtcgggtcctgtccgtacgtcctagtcgtaggttnacggttggcgtaggtcggtctacggtcgggaactaggttaccgtttccacgtttactaccccgaactacgtacgacgttacccggtacgtccgtaccgttacgtacgttacggttaaggtaacgtttattttaacgggcttttaacggtttaactaacgtacgtacggtaacgttagtaacgttaacgttaacgttccggtaacgttccgtaaccgttacggtaccgttactacccgtttacgttacgggaacccggtacgtacgtacgtccgtagaccttacgtactaacgtgtaccgtgtaccgtacg

SEQ ID NO: 242462 - DNA, 874 bp, Homo sapiens
  misc_feature: GYAE6OF01CI6GR.35.85.H08.1.454.CMB.1.raw
tcagtacagatcgtcacgaccggtgctcgatttagtatcactcagtcgcggggaggaactgctcagttaggacccagacggaaccatggaacgccccagccgcagtccttctccttcctcctgtacttattcgtcggcctcccgaagactactccacgtaggaagtaaatggtgatgacgctagtcctacccaacctccttcgtgtcgttgtcgtccgtacggaacgggacacgccgtaccctacccttcgtacccgtgaccggacgggtcctaacggtcgtaaggttagttacgtacgaactacgtaacctacggtttaacgccgttacggtaccaagtaacgtaacggtaaacgttccggacccgtacggtacccctccgtcggtacccctttcgtacgtttaggttttccggtttacggttcggttacccggtaccggttaaccgggtccgggttcccgttaaggttcggttacccccgttacgtacggttacggttaccgggtttacgacggggttccggtaggttccgggttaccggttaccgttaacggggtccggtaaaggttaccgtttccgttaacccgttaccctaccctacccggtaccgtaacgtaccggtacggtaccaccggtaccgtacgtaccggttagttacgtaacgtttaggttacttttaggtaccgtttaagtttaccgttacgtacgtacgttaacgtaagtaaattaacggtaacgttccgtaccgttccggttacgttcggtaacgtttcggtccgttacggttaccggaccgggtaaccggtacgtacggaccgttaagtaaccgtacgttaaaccgggtaacgttacggttaacgcgttacgtaacgg

SEQ ID NO: 242463 - DNA, 840 bp, Homo sapiens
  misc_feature: GYAE6OF01AQB5H.35.85.H08.1.454.CMB.1.raw
  modified_base (128)..(128): a, c, t, g, unknown or other
  misc_feature (128)..(128): n is a, c, g, or t
tcagtacagatcgtcacgaccggtgctcgatttagtatcactcagtcgcgggggaggaactgctcagttaggaccccagacggaaccatggaacgccccaccgcagcttctcttcctcctgctattcnggctcccagatatcactggagaatagtcgatcgacgcagtcctaccaacctacgtctgtctgtacgtcctccgaggggactaggacgcccaccgtctccgtgcgtacggccagtcgagtacggttgtacgaccagtacctaacgttcgccgtacggtacccagtacgtaagggtaacggtccggtaccgacgggtaccctccccggaggttccccctacctacgtttacgtttacgtttcgggaccgtttccgacccgtaagggttcccgggccgtcgttaccgggtccgtacccgtaggttacccgtagggttaccaacgggtcggtaccggtacgggtccgggtttacccggaccggtttacggggggaaattaccccgggttaggtttacccccgtaaacccgtttcccggtaaccctaacccgggttaacgtacccgtaaccggtcccggtacccggtcccgtacgtaccggttaccgttaccgttaaaggtacgtttacggttttaccgtaacggtttacgtttacgttacgttacggtactaacgttaactaacgttaactaacgttcggtaccgttccgtacgttaccggtcgttaccgttacgtacggttaccggtaccggtaccgggtaaccgacggttacggtacggtaaaccgttacggaaccgtaaacggtccggtaggtcccttcggtaacgtacccgg

SEQ ID NO: 242464 - DNA, 828 bp, Homo sapiens
  misc_feature: GYAE6OF01BTX2U.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctaccaaccactctgtctgtgtctccgaggggacagacgccaccctctcctgcgagggccaggtcagagtcgtagcagactaacttagcccgtggtaccgagacgtaaggtaaacgttcggaccgaggcctacccgacggtccttcccgtacgtactttccgttttcggtggttcggttacccgtacgtaacggggtcccgtccgttcgggttaccgtacccgtacggttccgtaacgggttacgtacggtcgggacgtaggtcggcgttcgtacggggtaactacggtacgttaccacttccgtacctacctaataccgacgtaccgacgtcccgttcggtacgtaacgttccgttaagggttaacggtttacgtttttaaggtaccgtttaagtttttaacgttttaactacggtttaccgtaacggttacctaaagtttaaacgtaaaaggtttaaccgtaaccgggtacccgggttacccgttacccgggttaacggtttaaccggtacgttttaaccccgggtttaccggggttacccggtaaccggggggaaaccccgttaaaacgggccggggttaaccgggtaaaggttaaaccggttaaacccgtaaaacggggtttaaacccgtttagggttaacccgggtccgttaaccccgg

SEQ ID NO: 242465 - DNA, 814 bp, Homo sapiens
  misc_feature: GYAE6OF01C2LXT.35.85.H08.1.454.CMB.1.raw
  modified_base (152)..(152): a, c, t, g, unknown or other
  misc_feature (152)..(152): n is a, c, g, or t
tcagtacagatcgtcacgaccggtgctcgatttagtatcactcagtcgcgggggaggaactgctcagttaggacccagacggaaccatggaacgccccagcgcagtcttctctttcctcctgcttattctggcctccagatatcactggaanaaaatgtgatgacgcagtcctaccaaccactctgtctgtcgtccgtacgaggggacagacgccctaccctctccgtgcgacggcctagtacgagtagttgtacgacacgtaccgtaacgttacgcccggtaggtaacccgagtaacgtaaacggtaaacggttcggaccgaaccggtcctaccccggacggtcccttaccctacttaggtttccgtttagggtcgttaccgtacccgtaggtacgggtccgtcggttacgggtccgtaacccgtaggttaccggttacggttacgtacggggtcgtacggtacggttcggttccggtacggtaacggggtactacgggtttacgttacctaacccgttaccctaccgtaaacctacgtacggtaccgtaccgaacccgttccgtacggtaccgttaggttaaccgttaaggtaacgttttacgttttacggtacgttttaacgtttttacgttacgtacggtacgtaagtaactttaaattaagttaacgttccgccggttaccgttacccgtaggttaccgttcggttacccgttaacggtttccgggaaaccgggtacgggaacctaacgggttcggaacggtacctaaacggtaaaccgtaacgtacggtcggttacggtcgtaacccg

SEQ ID NO: 242466 - DNA, 729 bp, Homo sapiens
  misc_feature: GYAE6OF01CK77O.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaataggtgatgacgcagtcctaccaaccactctgtctgtcgtcctccgaggggacagacgcccaccctctcctgccgacggcctagtcagtagttgtagcagactaactcgccgtaggtaccagacaaggtaaacgtcgaccgacggtcctacccgaggtcctcccgtctagtttcgtttcggtcgtcgtacccgtacggtacgggcccgtggtacggtcctaccggtagttacgtacggttacgtgggtacggtacgtacgggttcgtccgtacggggttacggaactacggtaacgttcccgtaactcccgtaccactaagtccgaagtccgacgtcccgtagcgtaagtcgaagttaacgttgttttacgacgttttaacgttttctaaggttcgaccgtaagttaacttaaacgtaagttaaacgtacgggtccttacggggtaacccttcggttaacgtttcgttcccgggttaaacggtttaccgggaacccggttacggggaaccttacgggtacttggggaaaaacttccctaaaagggttaaccctaagggttcggaccgtaccgtaaccg

SEQ ID NO: 242467 - DNA, 946 bp, Homo sapiens
  misc_feature: GYAE6OF01AG91S.35.85.H08.1.454.CMB.1.raw
tcagtacagatcgtcacgaccggtgctcgatttagtatcactcagtcgcgggggaggaactgctcagttaggacccagacggaaccatggaacgccccagcgcagcttcctcttcctcctgcttattctggcctcccagatactcacgtggaagtaaatagtagatgaccgcacgtcctacccaacctactctcgttctaggttcgtaccgtccggaacggggacagaccgccctaccccgtctccgcgcgacggccagtcaggtagttcgttacgactacgacttaaccgttacggtcccggtacggtaccacgacgaaggtaacggtccggaccacggtcccgtaccggtacctcccgttaccctagttaccgttcggtttcggttaccggttccgtaacccggcgggttacccgggtaccgttcgggttaccgggttcccgtacccgttaagggtcccggttacggtcgtaggggttacgcggttcggtaccggtccggtacgggaacggtacgttaaccggtacgttacccgtaccgtccccgttaccgaaccttaccgaacggtacccggtaccgaccgggtcccgaacgggtccggtttaggacggggttttaaccgttacggttttaacggtttaccggtttacgttttaagttttaccccgtttaaggttaccggaacttaaacggtacctttaaaacggggttatttaaaccgggtaccggggttacccgtacccggttttaccccgggtttaacggtttcccgggtttcgttttaaaccgggttttacccgggttaaccccgggggaaccgggggttaacggaccccgggttagggtaacccggttaaccggggttaaacccgtaaacccgggttttaaaaccccgggaagtttaaaccccggggtccggttaaacccggtccggtaaaccccggg

SEQ ID NO: 242468 - DNA, 746 bp, Homo sapiens
  misc_feature: GYAE6OF01D3YKI.35.85.H08.1.454.CMB.1.raw
  modified_base (94)..(94): a, c, t, g, unknown or other
  misc_feature (94)..(94): n is a, c, g, or t
  modified_base (166)..(166): a, c, t, g, unknown or other
  misc_feature (166)..(166): n is a, c, g, or t
tcagtacagatcgtcacgaccggtgctcgatttagtatcactcagtcggcgggggagaactgctcagttaggacccagacggaaccatggaacncccagcgcagcttctcttcctcctgtacttattcgtggccttaccagtattacgtctaagtggaagtaaacngttcgaatgacggcagtcctaccgaacctcgttctggtaccttggtctaccgtacccggaggggacaggcctccaccttcacgtgaccgagggcctaacgacgtagtacggttagtacgacctaagtacctaattcgaccgttacgacgaactacggtaacgtaacgtccggaaccgacgttacccgacgtaccggtcctactccgttacgttcggttttaaggtcgttcgtacccggtaggcggtccggtcgtcggttacgtccgaggtcggttaactgacgggtcgaccgtaggttccgacggtcgggacgtacgtacgtcgttacaccggtaccacggtaacacgtacgactccgtacgtccgtacgttcggaacgtacgttaacggtaatttaccgtagttagttttacgtttactacgttacgtactagtaaactaatacgtaagttaccgtcgtaccggttacgttacgtacgtttacggtccgttaggtttaccggaacggtccggtaagttacggtacgtaacgggtaaactacgtaaaccgggtaacgtagggttacctcgtggtaaaccc

SEQ ID NO: 242469 - DNA, 692 bp, Homo sapiens
  misc_feature: GYAE6OF01ECWJL.35.85.H08.1.454.CMB.1.raw
  modified_base (124)..(124): a, c, t, g, unknown or other
  misc_feature (124)..(124): n is a, c, g, or t
  modified_base (135)..(135): a, c, t, g, unknown or other
  misc_feature (135)..(135): n is a, c, g, or t
  modified_base (246)..(246): a, c, t, g, unknown or other
  misc_feature (246)..(246): n is a, c, g, or t
  modified_base (356)..(356): a, c, t, g, unknown or other
  misc_feature (356)..(356): n is a, c, g, or t
  modified_base (481)..(481): a, c, t, g, unknown or other
  misc_feature (481)..(481): n is a, c, g, or t
  modified_base (569)..(569): a, c, t, g, unknown or other
  misc_feature (569)..(569): n is a, c, g, or t
tcagtacagatcgtcacgaccggtgctcgatttagtatcactcagtcgcgggggaggaactgctcagttaggacccagacggaaccatggaacgccccagcgcagcttctctcctctgctatcngctccagatancacgtaggaataaagtaggtgagtcggacacgtagtcctaccaacctctctggtctgtcgtaccgcggaggggacacgccgaccctcctcgtacgtcgccggacggaccgngtacgaggtaagttcgtacgagtacgtactaacgtactccggtacgtaccaggtacaagtacggtcggacgacgtcctacggacgtcctactcgttagttccgttggtanccgtacgtcgacgggtcgtacgttacgggtccaccgtaggtacgttcggtacggacggttcggacgttagggtcctacgttacggggagacgtaaacgtcgttacgtaccctacgcgttaaccgntaaccgcgccgacgtctagtaccgtagttacgtaagttacttgtttagtcgtttaaattaccgtcgacgtgtaaacaataacgttaancggttacgcgttcgtaccgtagtacgtcgttacggttacggtaacggacggtaccggtaaagcgggtaccgaggtaaacgttaaggtacgtaaacccggttggtaccggtacgctaacccggg

SEQ ID NO: 242470 - DNA, 656 bp, Homo sapiens
  misc_feature: GYAE6OF01A2I46.35.85.H08.1.454.CMB.1.raw
  modified_base (491)..(491): a, c, t, g, unknown or other
  misc_feature (491)..(491): n is a, c, g, or t
  modified_base (536)..(536): a, c, t, g, unknown or other
  misc_feature (536)..(536): n is a, c, g, or t
  modified_base (545)..(545): a, c, t, g, unknown or other
  misc_feature (545)..(545): n is a, c, g, or t
  modified_base (595)..(595): a, c, t, g, unknown or other
  misc_feature (595)..(595): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcacgtcctaccaaccactcttcgtctgtgtcctccgagggacagacgccctaccctctcctcggccagggccacgtcgagtaggttcggtacgacacgaccgtaaacttcgtccgtacggtaaccgagaacgtaaggtaaacggttcgggaccgacgtcccgtaccccgacggcccttccgtacgtacttttcggtttcgggttgttccggtaccctaacgggtggggcccgttacggtggtcccgtccgtacggtcgtacgggttctaagggtcggcgtaggtcggtacgcggttacgggactagggtacttcgacctcgaccctaacncgtacacgcgtacggctcgtacgtctagtacgtaagtttcgtttntacgttttnttacgttactcgtacgtataactataagtacgtcgtcgttcgtctcggtntgtcttacggttacgcggtacggatacggctaaggcaagacgttacgagttcgtgtactcg

SEQ ID NO: 242471 - DNA, 835 bp, Homo sapiens
  misc_feature: GYAE6OF01CB9AG.35.85.H08.1.454.CMB.1.raw
  modified_base (203)..(203): a, c, t, g, unknown or other
  misc_feature (203)..(203): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctaccaaccacgtctgtctgtgtcgtccaggggacagngcccaccgtctcctgcagggccagtcagagttgtacgctagactaacgttgccttggtaaccagtacgaagtaagttggaccgaggcctacccgaggctccgtcagtttccgtttggtgtacgttaccgacggtacgggcccgtacgttcgggttcgtaccccgtagggttacctagggtttccgaagggtttcgggactaggtcggtcccttaccgggttaggggaaacctacgggtacgtttaccgaacgtttccgtaaccgtaacccgtacgttaccggaaacggtccgaaccggttacccgttacgaccggttaaagttccgttaagggttaacgtttaagttttaccggtacctttaaggttttttaaccgttaaccgttaggggtttaacctaacggttaacctaaaatttaaacccggttaagttaacccggtccgtttaaccgggtttaacccccgttccggtaaacgggttttcccgggttaaccggtttacccggttttaaaccgggggaccccggttaaaagggggtaacccttaaaccggggtacggtttaaccgggaaaccggtacgttaaaccgggtaaaaaccgtaccggttttaccgggaggttaacccggtaccg

SEQ ID NO: 242472 - DNA, 764 bp, Homo sapiens
  misc_feature: GYAE6OF01EMLHV.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctccgagatatcacgtggagaaatagtgatgacgactacgtctaccaacctacttctgtctgtcgtcctaccggaggggacagacgtcccacccttcctccgtagccgagggcctacgtcgaaggtacgttgtagcacgactaacggtttacgccgttaggtaccaacgtactaaaggtaacgtcggaccgacgtccctccgacgtcctaccgtcgttagtttccgtttggacgttcgtacctaccggtacgggcccgttacgtggtccgttccgacggttcgtacggttagacggtgtacgtacggtcggtcccttagggtacggacgtacggttaccgtttacgtaacccgttcccgttaaccgaccgttagttaccggaaccggtactaccggtccgttaccgaccgttacgtacggtttacggtaattttacgtttagttactttaacgtttacgtttctaacgtccgtaagtaactaagtacgtaacgtacgttcggttaccgtccgtttacgtacggttacgttaccgtttaccgggtaccggtaccggggtaaccgtacggtacccgttaggtaaccgtaagttaaccggtaaaccgttaacgtacggttacgtcgtacgtaacccgg

SEQ ID NO: 242473 - DNA, 770 bp, Homo sapiens
  misc_feature: GYAE6OF01EJ2CX.35.85.H08.1.454.CMB.1.raw
  modified_base (220)..(220): a, c, t, g, unknown or other
  misc_feature (220)..(220): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattcgtaggcctccagatatcactggagtaaatagtgatgacgcagtctaccaaccactctgtctgtcgtcctcgaggggacagtacgcccacctctcgngcgaggccagtcgagcgttgtacgcagactaacgttagccgtagtaccagacaaggtaaagttcggaccgtacggcctaccgtacggacccttaccgtactaacgtttcggtttacgggttacgttacgtaaccccgtagggttaaccgggtcgtaccgtttcgggttacccgtaaccccgtaagtacccggttagggttacgtacgggttacggaacgtacgggttacggtccttacgggtacggggaaactacggggttaacctttcccgtaaccgttacctacccgaacctacgtaccgaacgtacgtacgtacccttacgtaccgtagttacgtaaggtaacgtttacgttttagacccgttttaaggtttactacgttacgttaacacggtaaactaaagttaacgttaacgtacggttaccgtacgggtaccccttacgggttacgttacgtaccgtttaccgtttaccggaccgggtaacggtaacgacggtacgtaggaacgtaccttaaacggaaaccttaggtcggtccgtcgtaacccg

SEQ ID NO: 242474 - DNA, 862 bp, Homo sapiens
  misc_feature: GYAE6OF01D6YYC.35.85.H08.1.454.CMB.1.raw
  modified_base (154)..(154): a, c, t, g, unknown or other
  misc_feature (154)..(154): n is a, c, g, or t
  modified_base (561)..(561): a, c, t, g, unknown or other
  misc_feature (561)..(561): n is a, c, g, or t
tcagtacagatcgtcacgaccggtgctcgatttagtatcactcagtcgcgggggaggaactgctcagttaggacccagacggaaccatggaacgccccagcgcagcttctcttcctcctgctatctggctccagatatcacgtggaataatgtnagtgacgcacgttccacaaaccgtcttcctggtcctgtacgtcctaccggacggggacacgaccgcccctacctccgttccggcgacggacgggtcctagtcgaaggttagtacggttacgactaagtacccgttaaacgttcggtacccgtaacggtaaccgaggtaaccgaaagggtttaaacggttccggaacccgttcggtaccctacccggtaccggttacccttcctaacgtttacgttttcgggttttaccgggttggttacccgttaacccggtacgggtttccgggtcgttccggtttcggtaaccccgttaccgtaggtaccgttaacggttcgacggttcgggacgttacgggtggacccgttacgggtaaggacttaacgggtaccggtttaccncctaccgttacccacgtaacgtccggtaacctccgtccgtaccgtgtaaccgttacgttaccgttaaggttaacggtttacgtttacggtaccttttaacggtttaccgttacgggtaaccttgggtaacgtaacgtttaacggttaacgttaacgggtaccgttccggtcccgtaaccgttccgtttaaccgttcccggttacggttaccgggtaccgggtaaacggtacggtaggaccggtaacgtaaccggtaacgtaaacggttccggagttaccggtccgtcgtaccgttaacccg

SEQ ID NO: 242475 - DNA, 664 bp, Homo sapiens
  misc_feature: GYAE6OF01B6E6Z.35.85.H08.1.454.CMB.1.raw
  modified_base (339)..(339): a, c, t, g, unknown or other
  misc_feature (339)..(339): n is a, c, g, or t
  modified_base (653)..(653): a, c, t, g, unknown or other
  misc_feature (653)..(653): n is a, c, g, or t
tcagtacagatcgtcacgaccggtgctcgatttagtatcactcagtcggcggggaggaactgctcagttaggacccgagacggaaccagtggaacgccccagcgcagccttctccttcctcctgcttattcgtgcctccagatatcagtggaagaaattagtagagtacgacgacgagttccaccaaacctcgttctcgtacgtgttcgtcgtccggaagggacaacggaccaccctcctcgccgtggacggaccgcgtagacgagtaggttcgtagacgtaacgtacgtaacttcgacgtacgtacagtaagtaacggtaaggtcgacgaccggtccncgacgtctacgtatgttacgtgtatcgtacacgtcggcgtagtcgtacacgtaggtcaggttcgaggttcggacgtaggtccgtcgtacggtacggtacgtaaagtccgttacgtaccctacgtacacgtacgtacgacgacgtcgaccgtacgaccgttagtaccgtaagttacgtttacgtttacgtaccgtttaagtttacgtaacgtcggtaactaagtaacttaaagtactacgttacgacgttacgtcgtacggtgtacgttacgtacgtcgaggacgagtcggacgtagacgaacgtcgaaagtcgngtcgtctaccg

SEQ ID NO: 242476 - DNA, 825 bp, Homo sapiens
  misc_feature: GYAE6OF01EDA1N.35.85.H08.1.454.CMB.1.raw
  modified_base (126)..(126): a, c, t, g, unknown or other
  misc_feature (126)..(126): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattcnggcctccagatatcactggagaaatgtgatgacgcagtcctaccaaccattctgtctgtcgtctaccgaggggacaggacgcccaccttctcctggccgtacgggcctaggtcaggtacgttggttacgacgtacggtaccttaaaccgttcggtacccgttaggttaacccgagaccggtaaaagggtaaacggtttccgggaccgtaacggtcccgtaccccggtacggtacccttcccgttactacgtttcggttttcgggttcgtacccggttaccgtaacgggttacgggcccgttcgttcgggtccgtaccgtagtaccggtacggttcgacggtggaccgtaggtcgcgttacggtacgggacgtacggttcgttaccgtaccttaccgtaccgtaccgtaacgttaccgacggtaccgtacggtcccgttcggtaacgtacgtttacggtaacggttaacgttttcgtttacggttaacgtttaacgttttaacgttacgttacgtacgtaacgtacgttaaacgttacgttaacgtacgtccgttacccgggtactttaccgggtcgttactaccggttacggtttacccggtaaccgggtaacgggttaaccgtaacggttcgggaacggtaaaccggttaaaccggtaacgtaaacggtaaccggtgggttcccggtacgtaaccggg

SEQ ID NO: 242477 - DNA, 686 bp, Homo sapiens
  misc_feature: GYAE6OF01DTWD0.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcacgtcctaccaaccactcgtgtctgtcgtccgtaccgaggggacaggacgccctacccgttctccgtggcgacgggccagtcgagtagtgtagcagacctaagttacgccgtacggtaccgagacgtaaggtaacgttcggacgacggctccgagtcctccgtacgtgttcgtttaggtcgtcgtaccgtacggtacgggtccgtcggttcggtcgtccgtagtcgtacggtttacgaggtcggacgtacggtcggtactcggtagggaacgtagttacgttctaccgtctaccctacgtactacgacgtacgacgtccgtagacgtacgttcgtaaggttaagtttacgttttaggtacgttttaacgtttagtttaccgttaggtactaagtaaactaattaacgtaagtacgtacgttacggtaccgtacggtacgttccgtacgttcggttacggaccggtaacgggaactaggtcggtacgaacgtaacgtaaccgtaacgtaggtacgtcgcgtaacgg

SEQ ID NO: 242478 - DNA, 739 bp, Homo sapiens
  misc_feature: GYAE6OF01EP1E7.35.85.H08.1.454.CMB.1.raw
  modified_base (521)..(521): a, c, t, g, unknown or other
  misc_feature (521)..(521): n is a, c, g, or t
tcagtacagatcgtcacgaccggtgctcgatttagtatcactcagtcggcgggggaggaactgctcagttaggacccagacggaaccatggaacgccccagcgcagcttctcttcctcctgctattcgtggctccagatatcagtgaagaaatagtgatcgacgcgagtcctacccaacctactctcgttcgtcgtcgtccgtaccggaggggtacagaccggccccacccgttctaccgtgaccgacggccgtaggtacgtaggtacgttagtacgcaacggtacctaacgttacgaccgtacggtaacccgagacgtaaacggtaaggtccggaccggtaacggcccgtaccccgtaaccggtcccgttaccgtacttacgttttcggtttcgggtcgtttaccgtacccggagggtaccgggccgtcgttcgggtccgtacccctgggttacctagggttcgtaacggtcggtcgtacggttgggccgttacgggaagtacgtaaggttcgtttaccncctttcgaaccttaacgactcgacgctacgcttcggaatcgtacgttagtactttagttccgtattatttacgagttacgagaataactaagttacgacgttacgtcggttaccgccttaccgggttaatccggttagttaccggaccgggtaccggtaacggacgtaggcggtaacgtaaacggaccgttaaacgtaactggtgtaccgtcgtaccg

SEQ ID NO: 242479 - DNA, 769 bp, Homo sapiens
  misc_feature: GYAE6OF01BJQC5.35.85.H08.1.454.CMB.1.raw
  modified_base (469)..(469): a, c, t, g, unknown or other
  misc_feature (469)..(469): n is a, c, g, or t
  modified_base (509)..(509): a, c, t, g, unknown or other
  misc_feature (509)..(509): n is a, c, g, or t
tcagtacagatcgtcacgaccggtgctcgattttagtatcactcagtcgcgggggaggaactgctcagttaggacccagacggaaccatggaacgccccagcgcagcttctcttcctcctgcttattctggctcccagtatatcacgtggaagaaattagtgatgaacgtctagtcctaccaacctacttcgttcgttcttgttcgttaccgtccggacggggtacacggaccggcccctacccgttcctccgtaggtaccggacgggtccgtagtccgaaggtaggttcggttaacgaccgagtacctaaccgttacggtcccgttaacggtaccgaagaccgtaaaggttaacgtcggacccgtacggccgtccgacgtccttctactgtttcgtttcggtagtcgtacccgtacggtcggtccgtgttacgggtccttaccgtacgtcgtcggtttacgaggtcgngggttacggtcgtcgtcggttcggaagtacgtcgttaccnccttccgactaccgttactacgaccgtcgtacgtccgtgtaccgttaggtacgtaagtttacgtttacgttttgtaacgttttacgttttacgttagtcgtacgtcgttaataaggttaattaaccgtccgttcggttacccgtcgtttacgtacgttccgttacgttccgggtttaacccgggacgggtaaccgtacggagttcgggaagtaaacccgtacggttaaaccgaacgttcggtggtacccggtgtaaccgg

SEQ ID NO: 242480 - DNA, 489 bp, Homo sapiens
  misc_feature: GYAE6OF02IUDU8.35.85.H08.1.454.CMB.1.raw
  modified_base (323)..(323): a, c, t, g, unknown or other
  misc_feature (323)..(323): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccnctggtgtcccagtcaggttcagtggcagtgctctgggacagagttcactctcaccatcagcagcctgcagtccgaagattttgctagtttattactgtcagcaatataatagctgcctcgagttgctactttggcctagggaccagctggagactacaacgtaacg

SEQ ID NO: 242481 - DNA, 512 bp, Homo sapiens
  misc_feature: GYAE6OF02H8RNR.35.85.H08.1.454.CMB.1.raw
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
  modified_base (344)..(344): a, c, t, g, unknown or other
  misc_feature (344)..(344): n is a, c, g, or t
  modified_base (508)..(508): a, c, t, g, unknown or other
  misc_feature (508)..(508): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccacctctcctgcagggccagtcagagtgttagcagcaacttagcctggtaccagcagaaagttggccaggctccaggctcctcatctttggntgtccactagggccnctggtcgtcccagtcaggttcagtggcagtggctngggcagagttcactctcacatcagcagcctgcagtctgaagtatttgtctagtttattactgtactagtactaatataatagtctggtcctcgagttgctacgttttcggccgtaaggggaccaaggtcgtaggagtacgtacgaaacgtaacgtggttacggntacg

SEQ ID NO: 242482 - DNA, 495 bp, Homo sapiens
  misc_feature: GYAE6OF02HB2FF.35.85.H08.1.454.CMB.1.raw
  modified_base (311)..(311): a, c, t, g, unknown or other
  misc_feature (311)..(311): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccggcagaaagttggccaggctcccaggctcctcatctttggtgtgtccactagggccnctggtgtcccagtcaggttcagtggcagtggctcgtgggacagagttcactctcaccatcagcagcctgcagtctgaagtattttgctagtttattactgtcagcaatataatagctggcctcgagttgctactttggccgtaggggaccaaggcgtaggagatacaaacgactggtggctgcc

SEQ ID NO: 242483 - DNA, 488 bp, Homo sapiens
  misc_feature: GYAE6OF02JAFUA.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctctgggacagagttcactctcaccatcagcagcctgcagtctgaagattttgctagtttattactgtcagcaatataatagctgcctcgagttgctacttttggccgtaggggaccaaggctggagatcaaacgactgtggctcg

SEQ ID NO: 242484 - DNA, 488 bp, Homo sapiens
  misc_feature: GYAE6OF02FG2FW.35.85.H08.1.454.CMB.1.raw
  modified_base (196)..(196): a, c, t, g, unknown or other
  misc_feature (196)..(196): n is a, c, g, or t
tcagtacagatcgtcacgaccggtgctcgatttagtatcactcagtcgcggggaggaactgctcagttaggacccagacggaaccatggaagccccagcgcagcttctcttcctcctgctactctggctccgaggaaccactggagaaacagtgatgacgcagtctccagccatcctgtctgtgtctccagggganagagccaccctctcctgcagggccagtcagactattagtaccaacttagcctggtatcagcagaaacctggtcaggctcccaggctcctcatctatggtgcatccaccagggccactggtatcccagccaggttcagtggcagtgggtctgggacagagttcactctcaccatcagcagcctgcagtctgatgtattttgctagtttattactgtcagcattatgataactgcctcgtgacgttcgcaggaccgaaggtggaagtccgaacgaacgtgtggctgcaccatcg

SEQ ID NO: 242485 - DNA, 522 bp, Homo sapiens
  misc_feature: GYAE6OF02HPRNN.35.85.H08.1.454.CMB.1.raw
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (329)..(329): a, c, t, g, unknown or other
  misc_feature (329)..(329): n is a, c, g, or t
tcagtacagatcgtcacgaccggtgctcgatttagtatcactcagtcgcggggagagctctggggaggtaactgctcagttaggacccaggacggaaccataggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttgccaggctcccaggcctccncatctttggtntgtccacgtaggggcccntggtcgtcccagtcaggttcagtggcagtggctgtgggacagagttcactctcaccatcagcacgcctgcagtctagtaagtattttgcttagtttattactgtacagctaaattataatagtctggccttcgtagttcgacttactttcggccgtaggggtaccaaggtcgtagggagtactacgtaaacgg

SEQ ID NO: 242486 - DNA, 243 bp, Homo sapiens
  misc_feature: GYAE6OF02GW2AI.35.85.H08.1.454.CMB.1.raw
  modified_base (214)..(243): a, c, t, g, unknown or other
  misc_feature (214)..(243): n is a, c, g, or t
tcagtacagatcgtcacgaccggtgctcgatttagtatcactcaggtcgcggggaggaactgctcagttaggacccagacggaaccatggaagccccagcgcagcttctcttcctcctgctattctggctcccaggaactgtggctgcaccatctgtcttcatcttcccgccatctgaacgatctgtactgagcgggctggcaaggcgcatagnnnnnnnnnnnnnnnnnnnnnnnnnnnnnn

SEQ ID NO: 242487 - DNA, 482 bp, Homo sapiens
  misc_feature: GYAE6OF02IG5LL.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggccaggctcccaggctcctcatctttggtgtgtccactagggccgctggtgtcccagtcaggttcagtggcagtgctctgggacagagtcactctcacatcagcagcctgcagtctgaagattttgctagtttattactgtcagcaatataatagctgcctcgagttgctactttggccagggaccaagctaggagactcaaacg

SEQ ID NO: 242488 - DNA, 498 bp, Homo sapiens
  misc_feature: GYAE6OF02H8UB7.35.85.H08.1.454.CMB.1.raw
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (385)..(385): a, c, t, g, unknown or other
  misc_feature (385)..(385): n is a, c, g, or t
  modified_base (493)..(493): a, c, t, g, unknown or other
  misc_feature (493)..(493): n is a, c, g, or t
tcagtacagatcgtcacgaccggtgctcgatttagtatcactcagtcgcggggaggaacgtgctcagttaggacccagacggaaccatggaagcccagcgcagcttctcttctcctgctattctggctccagatatcactggagaaatagtgatgacgcagtctccaaccactctgtctgtgtctccaggggacagagccaccttctcctgcaagggccagttcagagtgttagcagcaacttgcctggaccagcagaagttggccaggctccaggctcctcatctttggntgtaccattagggccnctgggtgtacccagtcaggttcagtgcagtgcttcagggcagngttcactntcacatcagcagcctgcagtctgaagntttgctagtttattactgtctagctaatataatagcttgcctccgagttgctacttttcggcgtaggggacctaaggcttacggagtatcgaaacgaacgtagtcggntacgg

SEQ ID NO: 242489 - DNA, 498 bp, Homo sapiens
  misc_feature: GYAE6OF02IZUBD.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattcgtggctcccagatatccactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctctgggacagagttcactctcaccatcagcagcctgcagtctgaagtattttgctagtttattacttgtcagcaattataatagctggtcctccgtagttgctacttttggccgtaggggtaccaagctggagactcaaacgactgtggctcg

SEQ ID NO: 242490 - DNA, 610 bp, Homo sapiens
  misc_feature: GYAE6OF02I70UQ.35.85.H08.1.454.CMB.1.raw
  modified_base (293)..(293): a, c, t, g, unknown or other
  misc_feature (293)..(293): n is a, c, g, or t
  modified_base (356)..(356): a, c, t, g, unknown or other
  misc_feature (356)..(356): n is a, c, g, or t
tcagtacagatcgtcacgaccggtgctcgatttagtatcactcagtcggccgggggagggaacctgctcagttaggacccagacggaaccactcggaagccccagcgcgacgcgttctcttccgtcctcgctattcctggctcccaggatatccacctaggagaaaggtaggttgatgacgcagtcgtccaaccactctgttcctggtgtctcccaaggggtaccagagcctacccgtctcctagcacgggcccagtcgacgagtcgttagcagcaacttagcctggtaccgngccagaaagttcgcccaggcctccaggctccgtcactcgtttggtgtgtccacgtaggggccncgtggtcgttcccagtcaggttcagtggacagtggctcgtgggactaggtagttcacgttctacgactacgtcgacgcgacgccctagcgacgtcgacgaacgtactttacgctagtttacttacttcgtctacgcctaacttactaattacgtcttacgtcctccggtacgttcgcgttacgttttacgggacccgaacggggtaacctaaggcgtggaacgtacgtacgaaacgacgtcggtacggctacgg

SEQ ID NO: 242491 - DNA, 496 bp, Homo sapiens
  misc_feature: GYAE6OF02ITOCC.35.85.H08.1.454.CMB.1.raw
  modified_base (296)..(296): a, c, t, g, unknown or other
  misc_feature (296)..(296): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccactagggccgctggtgtcccagtcaggttcagtggcagtggctctgggacagagttcactctcaccatcagcagcctgcagtctgaagtattttgctagtttattactgtcagcaatataatagctgcctcgagttgctacttttggccgtaggggaccaaggctaggagatacgaaacgtactggtggctcgg

SEQ ID NO: 242492 - DNA, 216 bp, Homo sapiens
  misc_feature: GYAE6OF02HWHCS.35.85.H08.1.454.CMB.1.raw
  modified_base (214)..(216): a, c, t, g, unknown or other
  misc_feature (214)..(216): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccaggaactgtggctgcaccatctgtcttcatcttcccgccatctgaacgatctgtactgagcgggctggcaaggcgcatagnnn

SEQ ID NO: 242493 - DNA, 501 bp, Homo sapiens
  misc_feature: GYAE6OF02FILWK.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactaggggccgctggtgtccccagtcaggttcagtggcagtggctcgtgggacagagttcactctcaccatcagcagcctgcagtctgaagtattttgctagtttattactgtcagcaatataatagctggcctcgagttgctacgtttggccgtaaggggaccaaggcgtggagatacgaaacgtactgtaggctcgg

SEQ ID NO: 242494 - DNA, 524 bp, Homo sapiens
  misc_feature: GYAE6OF02I3IBL.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccacgtagggccgctggtgtcccagtcaggttcagtggcaggtggctcgtgggacagagttcactctcaccatcagcacgcctgcagtctagaagtattttgcttagtttattacttgtacagtacaattaataatagtcgttggcctccgagttgcttacgttttcggaccgtacggggaccaaggtcgtaggagtacgtacgaaaccgtacgtagtggcgtcg

SEQ ID NO: 242495 - DNA, 507 bp, Homo sapiens
  misc_feature: GYAE6OF02GXTQN.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcatctttggtgtgtccactagggccgctggtgtcccagtcaggttcagtggcagtggctcgtgggacagagttcactctcaccatcagcagcctgcagtctgaagtatttgctagtttattactgtcagtacaatataatagtctggcctcgtagttgtactacgtttgaccgtaggggtaccacggtcgtaggacgtatagtaaacgg

SEQ ID NO: 242496 - DNA, 496 bp, Homo sapiens
  misc_feature: GYAE6OF02GKJBO.35.85.H08.1.454.CMB.1.raw
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
  modified_base (493)..(493): a, c, t, g, unknown or other
  misc_feature (493)..(493): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagtggccaggctccaggctctcatcttggtgtgtccactagggccnctggtntcccagtcaggttcagtggcagtggctcgtgggactagagttcactctacaccatcagcagcctgcagtctagaagtatttgctagtttattactgtcagacaatataatagctggcctcgagttgctacgtttggccgagggacctaaggcgtaggagatacaaaccgactggtcggntcg

SEQ ID NO: 242497 - DNA, 491 bp, Homo sapiens
  misc_feature: GYAE6OF02GATO6.35.85.H08.1.454.CMB.1.raw
  modified_base (296)..(296): a, c, t, g, unknown or other
  misc_feature (296)..(296): n is a, c, g, or t
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
  modified_base (488)..(488): a, c, t, g, unknown or other
  misc_feature (488)..(488): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctctcatctttggtntgtccactagggccnctggtgtcccagtcaggttcagtgcagtggctntgggacagagttcactctcaccatcagcagcctgcagtctgaagtatttgctagtttattactgtcagcaatataatagctgcctccgagttgctactttggccgtaggggaccaaggctggagactacgaaacgaactgtggntcg

SEQ ID NO: 242498 - DNA, 637 bp, Homo sapiens
  misc_feature: GYAE6OF02JPCGA.35.85.H08.1.454.CMB.1.raw
  modified_base (188)..(188): a, c, t, g, unknown or other
  misc_feature (188)..(188): n is a, c, g, or t
tcagtacagatcgtcacgaccggtgctcgatttagtatcactcagtcgcggggactgcttcagggcagttggtagatgcccctcttgggagagatcccagggtgacagccatggaccctggaaggcctgggctaggacagggaccagagccaggtccagggagaggacagagccaatggactggggtntacgtgtaacgagccctgctggcgagagggaccagggccaccgtccgtccagggacgcccatggctcgcaaggtcggccagacggtcgcccgtgaacctgaaggccaagtgagacccaagacaggccaagtcggtagtgagaccccgtgacggagcgtgggcccgtggtcccgaggcagcggctcggccctgctgctggctgggtctggccgagtcggtccgcccgagtcggcccgtggcgtcggccgcccgaagtcggttacgccgacccgcgaaacggccggggaacccacggacccgtacgggaccggtcccgtcgtaacgggttcggaacgaccgacgaccgaacgtcccgaaggtcccgtacggaccggtacggacccggttcggtaccgggggaccgtacggggtccgaccggaccccggaaccggacccccgaaacccccgg

SEQ ID NO: 242499 - DNA, 491 bp, Homo sapiens
  misc_feature: GYAE6OF02HKDY7.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacgtagggccgctggtgtcccagtcaggttcagtggcagtggctctgggacagagttcactctcaccatcagcagcctgcagtctgaagtatttgctagtttattactgtcagcaatataatagctgcctcgtagttgctacgtttggccgagggaccagcgtggagatacgaaacgtacgtgtggctcg

SEQ ID NO: 242500 - DNA, 560 bp, Homo sapiens
  misc_feature: GYAE6OF02IQ94M.35.85.H08.1.454.CMB.1.raw
  modified_base (256)..(256): a, c, t, g, unknown or other
  misc_feature (256)..(256): n is a, c, g, or t
  modified_base (302)..(302): a, c, t, g, unknown or other
  misc_feature (302)..(302): n is a, c, g, or t
  modified_base (554)..(554): a, c, t, g, unknown or other
  misc_feature (554)..(554): n is a, c, g, or t
tcagtacagatcgtcacgaccggtgctcgatttagtatcactcagtcgcgggggaggaacgtgctcagttaggacccagacggaaccatggaagcccagcgcagcttctcttcctcctgctattctggctcccagatatcactggagaaatagtgatgacgcagtctccaaccactctgtctgtgtctccgaggggacagagccacctctcctgcagggccagtcagagtgttagcagcaacttagcctggtaccngcagaaagttggccaggctcccgaggctccctcagttctttgggtntgtacccactaggggcccgcttgggtacgtccccgaggtccgtaagggtttcccagggttgggcctagggttcggcttcgtggggaccaggtacgttcgacttctcaccatcgagcagctgcagtcagagtatttgctagtttatactgtcagctaagtactaatagctggtaccctcgtaagttcgcttacgtttggccgaaggggtaccaagtcggtacgagtacgtacgaaacgtaacgtgttaccggnttacgg

SEQ ID NO: 242501 - DNA, 502 bp, Homo sapiens
  misc_feature: GYAE6OF02G6WAQ.35.85.H08.1.454.CMB.1.raw
  modified_base (498)..(498): a, c, t, g, unknown or other
  misc_feature (498)..(498): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacgtagggccgctggtgtccccagtcaggttcagtggcagtggctcgtgggacagagttcactctcaccatcagcagcctgcagtctagaagtatttgctagtttattactgtcagcaatataatagctgcctcgagttgctacgtttggccgtaggggaccaaggtcgtaggagatacgaaacgtacgtggtcggntacg

SEQ ID NO: 242502 - DNA, 540 bp, Homo sapiens
  misc_feature: GYAE6OF02GYR5O.35.85.H08.1.454.CMB.1.raw
  modified_base (315)..(315): a, c, t, g, unknown or other
  misc_feature (315)..(315): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtgtccacgtaggggccnctggtcgtcccagtcaggttcaggtggcaggtggctcgtgggacagtagttcactctcaccatcagcagcctgcagtctgaagtatttgctagtttattactgtcagtactaattataatagtcgtcggtccttaccgtagttcgtcttacgttttcggaccggtaacggggaacctaaggtcgtagggagtacgtacgaaacgtaacgtaggtacggcgtacgg

SEQ ID NO: 242503 - DNA, 506 bp, Homo sapiens
  misc_feature: GYAE6OF02HTUSU.35.85.H08.1.454.CMB.1.raw
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcattctttggngtgtccacgtagggcccnctgggtcgtccccagtcaggttcaggtggcaggtggctcgtgggacagtgttcactctcaccatcagcagcctgcagtctgaagtatttgctagtttattactgtcagcaatataatagctgtcctcgagttgctacgtttcggccgtagggacctaaggcgtggagtatacgaaacgtacgtggtcggctcg

SEQ ID NO: 242504 - DNA, 497 bp, Homo sapiens
  misc_feature: GYAE6OF02HNP9Q.35.85.H08.1.454.CMB.1.raw
  modified_base (493)..(493): a, c, t, g, unknown or other
  misc_feature (493)..(493): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctcgtgggacagagttcactctcaccatcagcagcctgcagtctgaagtattttgctagtttattactgtcagctaatataatagctggcctcgagttgctactttggccgaggggaccaaggctaggagatacgaaacgactggtcggntacg

SEQ ID NO: 242505 - DNA, 495 bp, Homo sapiens
  misc_feature: GYAE6OF02GSCP6.35.85.H08.1.454.CMB.1.raw
  modified_base (312)..(312): a, c, t, g, unknown or other
  misc_feature (312)..(312): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccnctggtgtcccagtcaggttcagtggcagtggctcgtgggacagagttcactctcaccatcagcagcctgcagtctgaagtatttgctagtttattactgtcagcaatataatagctgcctcgagttgtctacgtttggccgtagggaccaaggcgtaggagatacgaaacgacgtgtggctcg

SEQ ID NO: 242506 - DNA, 561 bp, Homo sapiens
  misc_feature: GYAE6OF02JAC92.35.85.H08.1.454.CMB.1.raw
  modified_base (297)..(297): a, c, t, g, unknown or other
  misc_feature (297)..(297): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctatggtncatccaccagggccactggtactcccagcctaggttcaggtggcaggtgggtctgggacagagttcactctcaccatcagcacgcctgcagtctgatgtattttgctagtttattacttgtcagtctattatgtattaacgtcggtcccttcggtcggtaccggttaccggtacccggtaaacggggaacccgtaaacgggttacggaacggttacccgaaaccggtaaccggttaggttacgggaccgttacggcctaacccg

SEQ ID NO: 242507 - DNA, 214 bp, Homo sapiens
  misc_feature: GYAE6OF02FM29N.35.85.H08.1.454.CMB.1.raw
  modified_base (213)..(214): a, c, t, g, unknown or other
  misc_feature (213)..(214): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccaggactgtggctgcaccatctgtcttcatcttcccgccatctgaacgatctgtactgagcgggctggcaaggcgcatagnn

SEQ ID NO: 242508 - DNA, 516 bp, Homo sapiens
  misc_feature: GYAE6OF02HKS1L.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcattcctttggtgtgtccacgtagggccgcttggtcgtccccaggtccaggttcagtggcagtggctcgtgggacagagttcactctcaccatcagcagcctgcagtctgaagtatttgctagtttattactgtcagtacaatataatagctgtcctacgtagttcgtctacgtttggccgtaggggaccaaggcgtaggagtacgtacgaaacgtactggtggctacg

SEQ ID NO: 242509 - DNA, 517 bp, Homo sapiens
  misc_feature: GYAE6OF02I01K6.35.85.H08.1.454.CMB.1.raw
  modified_base (358)..(358): a, c, t, g, unknown or other
  misc_feature (358)..(358): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttaagcagcaacttagcctggtaccagcaagaaagttggccaggctcccaggcctcctcatctttggtgtgtccactagggccgctggtcgtcccagtcaggttcaggtggcaggtgctcgtgggacngagttcactctcaccatcagcacgcctgcagtctgaagtatttgctagtttattactgtcagactaatataatagctcggcctccgagttgctacgtttggaccgtacggggaccaaggtcgtaggacgtactaccgaaacgaacgtggtacggctcgg

SEQ ID NO: 242510 - DNA, 555 bp, Homo sapiens
  misc_feature: GYAE6OF02IJ6E0.35.85.H08.1.454.CMB.1.raw
  modified_base (233)..(233): a, c, t, g, unknown or other
  misc_feature (233)..(233): n is a, c, g, or t
  modified_base (314)..(314): a, c, t, g, unknown or other
  misc_feature (314)..(314): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggcagagccaccctctcctgcagggccagtcagagtgtagnagcaattagcctggtaccaggcagaaagttggccaggctcccgaggcctcctcattctttggtgtgtccagtacggggccnctggtcgtccccagtccaggttcagtgcaggtgctcgtgggactagagttcacgttctcgaccatcagcagcctgcagtctgaagtagtttgctagttttattactgtcagtcaattataagtagtctgcccgtcggagtttcgacttacgttttcgggcccgtaaggggtacccgtaaaggtccgttagggtaacgtacgttaaccgaaaaccggttaacgttacgttacgggcttacgg

SEQ ID NO: 242511 - DNA, 509 bp, Homo sapiens
  misc_feature: GYAE6OF02HR88M.35.85.H08.1.454.CMB.1.raw
  modified_base (294)..(294): a, c, t, g, unknown or other
  misc_feature (294)..(294): n is a, c, g, or t
  modified_base (311)..(311): a, c, t, g, unknown or other
  misc_feature (311)..(311): n is a, c, g, or t
  modified_base (505)..(505): a, c, t, g, unknown or other
  misc_feature (505)..(505): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggngtgtccactaggggccncgtggtgtccccagtcaggttcagtggcaggtgctcgtgggacagagttcactctcacatcagcagcctgcagtctgaagtatttgctagtttattatgtctagactaatataatagtctgccctacgtagttcgctacgttttcggaccgtaggggaccagtcgtaggagactacgaaacgtacgtgtcggtntcgg

SEQ ID NO: 242512 - DNA, 525 bp, Homo sapiens
  misc_feature: GYAE6OF02HCBTY.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtgtccacgtaggggccgctgggtcgtccccagtcaggttcagtggcaggtggctcgtgggacaggtagttccactctcaccatcagcagcctgcagtctagaagtatttgctagtttattactgtcagactaatataatagctcgtcctcgtagttgctacgttttcggaccgtacggggaccaacggtcgtaggagacgtacgaaacgtaacgtaggtacggctacg

SEQ ID NO: 242513 - DNA, 215 bp, Homo sapiens
  misc_feature: GYAE6OF02F7N48.35.85.H08.1.454.CMB.1.raw
  modified_base (214)..(215): a, c, t, g, unknown or other
  misc_feature (214)..(215): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccaggaactgtggctgcaccatctgtcttcatcttcccgccatctgaacgatctgtactgagcgggctggcaaggcgcatagnn

SEQ ID NO: 242514 - DNA, 502 bp, Homo sapiens
  misc_feature: GYAE6OF02I4FB8.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctttctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctctgggacagagttcactctcaccatcagcagcctgcagtctgaagatttgctagtttattactgtcagcaatataatagctgcctcgagttgctacttttcggccgtacgggaccaaggcgtaggagtagtacgaaacgtacgtggtcggtctgacc

SEQ ID NO: 242515 - DNA, 493 bp, Homo sapiens
  misc_feature: GYAE6OF02GLVLI.35.85.H08.1.454.CMB.1.raw
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (490)..(490): a, c, t, g, unknown or other
  misc_feature (490)..(490): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggntgtccactagggccgntggtctcccagtcaggttcagtggcagtggctcgtgggacagagttcactctcacatcagcagcctgcagtctgaagtatttgctagtttattactgtcagcaatataatagtctgtcctcgtagttgctacgtttggccgtagggaccaggcgtaggagactacgaaacgactgtcgntcg

SEQ ID NO: 242516 - DNA, 574 bp, Homo sapiens
  misc_feature: GYAE6OF02I4574.35.85.H08.1.454.CMB.1.raw
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
  modified_base (359)..(359): a, c, t, g, unknown or other
  misc_feature (359)..(359): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtntgtccactagggccnctggtgtcccagtcaggttcagtggctaggtggttcnggggacagacgttcactctcacatcagcagcctgcagtctagaagtatttgctagtttattactgtacagtactaattaattaagttaacgtacgttcggtacccgttaccggtacggtttacggtacgttaccgtttttcgggacccggtaacgggggtaacccgtaacggtaccggttagggtaacggtaacgttaccgtaaacggtaaccgg

SEQ ID NO: 242517 - DNA, 529 bp, Homo sapiens
  misc_feature: GYAE6OF02ICO8Q.35.85.H08.1.454.CMB.1.raw
  modified_base (318)..(318): a, c, t, g, unknown or other
  misc_feature (318)..(318): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggaccagcaagaaagttggccaggctccaggctcctcattctttggtgtgtcccacgtacggggcccgtnttgggtcgtccccagtcctaggttcaggtggcaggtggctcgtgggacagtagttcactctcacatcagcagctgcagtctagaagtatttgactagtttattactgtcagactaatataatagcgtcgtcctacgtagttcgtactacgttttggaccgtaacgggaccaaggcgtaggagtacgtacgaaacgtaacgtggtcgctacg

SEQ ID NO: 242518 - DNA, 490 bp, Homo sapiens
  misc_feature: GYAE6OF02HZT7T.35.85.H08.1.454.CMB.1.raw
  modified_base (487)..(487): a, c, t, g, unknown or other
  misc_feature (487)..(487): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccactagggccgctggtgtcccagtcaggttcagtggcagtggctctgggacagagttcactctcaccatcagcagcctgcagtctgaagtatttgctagtttattactgtcagcaatataatagctgcctcgtagttgctactttggccgtaggggaccaaggctggagatacgaaacgaactgtcggntcg

SEQ ID NO: 242519 - DNA, 529 bp, Homo sapiens
  misc_feature: GYAE6OF02JNUR1.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccgaggctcctcatctttggtgtcgtccacgtagggccgctggtcgtcccagtcaggttcagtggcagtggctcgtgggacaggagttcacgtctacaccatcagcacgcctgcagtctgaagtatttgctagtttattactgtactagactaatataatagtcgttgtcctacgtagttgtactacgtttcggaccgtaacggggacctaaggtcgtaggacgtactacgaaacgtacgtacggttcggctacg

SEQ ID NO: 242520 - DNA, 498 bp, Homo sapiens
  misc_feature: GYAE6OF02HWO98.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacgtagggccgctggtcgtcccagtcaggttcagtggcagtgctcgtgggacagagttcactctcaccatcagcagcctgcagtctgaagtatttgctagtttattactgtcagacaatataatagctgcctcgagttgctacgtttcggccgaggggaccaaggcgtggagagtacaaacgtaactggtggctcg

SEQ ID NO: 242521 - DNA, 554 bp, Homo sapiens
  misc_feature: GYAE6OF02JVW92.35.85.H08.1.454.CMB.1.raw
  modified_base (408)..(408): a, c, t, g, unknown or other
  misc_feature (408)..(408): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctcccaggcctcctcattcctttggtgtcgtccagtacgggccgtctggtcgtccccaggttccgtaggttcaggtggcaggtcggctcgtgggacagagttcactctcaccatcagcagcctgcagtcagagtntttgcttagtttactactgtacagtctaatataagtagtctagcccttacgtagttcgtacttacgtttggaccgtaaggggtacctaaggtccgttagggaacgtacgttaacgaaaaccggtacgttacgggtacggtactacg

SEQ ID NO: 242522 - DNA, 519 bp, Homo sapiens
  misc_feature: GYAE6OF02ITX73.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctcgtgggacagagttcactctcaccatcagcagcctgcagtctgaagtatttgctagtttattactgtcagacaatataatagctggtcctacgtagttgtctacgttttcggccgtaacggggtaccaaggtccgtaggaagtagtacgaaaacgtaacgtggtacggcgtacgg

SEQ ID NO: 242523 - DNA, 510 bp, Homo sapiens
  misc_feature: GYAE6OF02IHT3O.35.85.H08.1.454.CMB.1.raw
  modified_base (296)..(296): a, c, t, g, unknown or other
  misc_feature (296)..(296): n is a, c, g, or t
  modified_base (347)..(347): a, c, t, g, unknown or other
  misc_feature (347)..(347): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcatctttggngtgtccactagggccgctggtcgtcccagtcaggttcagtgcagtgctcgngggacagagttcactctcacatcagcagcctgcagtctgtaagtattttgctagttttattacttgtcagctaatataatagcgtgtcctcgtgttgctacgttttggccgtaggggacctaaggcgtaggagtacgtacgaaacgtactggtacggtctacg

SEQ ID NO: 242524 - DNA, 702 bp, Homo sapiens
  misc_feature: GYAE6OF02JLXFS.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttgccaggctccaggcctcctcacttcgtttggtgtgtccacgtaggggcccgctcgggtcgtccccgagttccgaggtttccaggtgggacctaggtcggcttcgtggggacctagtacggttccacgttcctacaacccgtataccgtagcctaacgcccgttggacctaacggttccttaaggtaacgttagtttttcggaccgttaaggttttactttaccgtttaggtacctaaggtcttaaaggtttttaaacgtacggttaccgttccggggtaccccgtccgttccgtttaccgttccgtttttccgggggaccgggttaacggggtaacccggtaaacggggttacgggaacggtaaccgttaacggtaaaaaacggtaacccgttcggggttaccggtaaccggttacgtaccggtaacccgttaagg

SEQ ID NO: 242525 - DNA, 506 bp, Homo sapiens
  misc_feature: GYAE6OF02GLOG8.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcatctttggtgtgtccactaggggccgctggtcgtcccagtcaggttcagtggcagtggctcgtgggacagagttcactctcaccatcagcagcctgcagtctgaagtatttgctagtttattactgtcagcaatataatagtctgcctcgagttgctacgtttcggccgtacgggaccaggcgtaggagtacgtacaacgtaacgtggtacggctacg

SEQ ID NO: 242526 - DNA, 567 bp, Homo sapiens
  misc_feature: GYAE6OF02JZC91.35.85.H08.1.454.CMB.1.raw
  modified_base (328)..(328): a, c, t, g, unknown or other
  misc_feature (328)..(328): n is a, c, g, or t
  modified_base (423)..(423): a, c, t, g, unknown or other
  misc_feature (423)..(423): n is a, c, g, or t
tcagtacagatcgtcacgaccggtgctcgatttagtatcactcagtcgcgggggaggaactgctcagttaggacccagacggaaccatggaagcccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaaagttcggccagggctcccgaggcctcctcgattcgtttgggcgttggtcccacgttacggggcccncttgggtcgtcccaggtccaggttcaggtggcaggttcggctcgtgggacaggatttccacttctccacatcagcacgcctgcagtctagaagtntttcgtctagtttacttactgtacagtactaatactaatagtacgttcgccttacgtagttcgtacgtacgttttcggaccgtacggggtaacctacggtacgtacggagtacgttacgaaacgtacgtaggtacggacgtacg

SEQ ID NO: 242527 - DNA, 505 bp, Homo sapiens
  misc_feature: GYAE6OF02IY67O.35.85.H08.1.454.CMB.1.raw
  modified_base (315)..(315): a, c, t, g, unknown or other
  misc_feature (315)..(315): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtgtccacgtagggccgntggtgtccccagtccaggttcagtggcaggtggctcgtgggacagtagttcactctcaccatcagcagcctgcagtctagaagtatttgctagtttattactgtcagctaatataatagctgcctcgagttgtctacgtttcggacgtacgggaccaggtctaggagatacgaaacgtactggtgctacg

SEQ ID NO: 242528 - DNA, 506 bp, Homo sapiens
  misc_feature: GYAE6OF02HIDWP.35.85.H08.1.454.CMB.1.raw
  modified_base (296)..(296): a, c, t, g, unknown or other
  misc_feature (296)..(296): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccactagggccgctggtcgtcccagtcaggttcagtggcagtggctcgtgggacagagttcactctcaccatcagcagcctgcagtctagagtatttgctagtttattactgtcagcaatataatagtcgtcgtcctccgtagttgctacgttttggaccgtagggaccaagcgtaggagacgtacgaaacgaacgtagtggctcg

SEQ ID NO: 242529 - DNA, 539 bp, Homo sapiens
  misc_feature: GYAE6OF02HV5GR.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagtggccaggctcccaggctcctcatctttggtgtgtccacgttacggggcccgtcgtggtcgtccccgagttccagggtttcaggttggcaggtggctcgtgggacaggacgttcactctcaccatcagcacgcctgcagtctagaagtatttgtctagtttattactgtacagtacaatataatagtcgtcggtccgtcgtagttcgcttacgtttcggccgaacggggtaccaaggtcgtaggagactacgaaacgtaacgtggtacggctacgg

SEQ ID NO: 242530 - DNA, 488 bp, Homo sapiens
  misc_feature: GYAE6OF02HWV15.35.85.H08.1.454.CMB.1.raw
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccactagggccnctggtgtcccngtcaggttcagtggcagtggctctgggacagagttcactctcaccatcagcagcctgcagtctgaagtatttgctagtttattactgtcagtacaatataatagctgcctcgagttgctatttggcgagggaccaaggctggagagtacaaacgaactgtggctcg

SEQ ID NO: 242531 - DNA, 497 bp, Homo sapiens
  misc_feature: GYAE6OF02IOFYW.35.85.H08.1.454.CMB.1.raw
  modified_base (391)..(391): a, c, t, g, unknown or other
  misc_feature (391)..(391): n is a, c, g, or t
  modified_base (493)..(493): a, c, t, g, unknown or other
  misc_feature (493)..(493): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctctgggacagagttcactctcaccatcagcagcctgcagtctgaagtnttttgctagttttattactgtacagctaatataatagctggcctcgagttgctactttggccgaggggaccaaggtctaggagatacgaaacgacgtgtagntacg

SEQ ID NO: 242532 - DNA, 515 bp, Homo sapiens
  misc_feature: GYAE6OF02HNWSO.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctccctcattctttggtgtgtccacgtaggggccgctggtcgtccccagtcaggttcaggtggcaggtggctcgtgggacagagttcactctcacatcagcagcctgcagtctagaagtatttgctagtttattactgtcagactaatataatagctcgcctcgagttcgctacgtttggaccgtacggggaccaggtcgtaggagtacgtacgaaacgtacgtggtggctacg

SEQ ID NO: 242533 - DNA, 526 bp, Homo sapiens
  misc_feature: GYAE6OF02H3RM7.35.85.H08.1.454.CMB.1.raw
  modified_base (287)..(287): a, c, t, g, unknown or other
  misc_feature (287)..(287): n is a, c, g, or t
  modified_base (315)..(315): a, c, t, g, unknown or other
  misc_feature (315)..(315): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctccctnattctttggtgtgtccacgtaggggccnctggtcgtcccagtcaggttcaggtggcaggtggctcgtgggacagtagttcactctcaccatcagcagcctgcagtctgaagtatttgcttagtttattactgtcagactaattataatagtcgtcgtcctacggagttgaccttacgtttcggaccgtaggggacctaaggtcgtaggagacgtacgaaacgtacgtggtcggctacgg

SEQ ID NO: 242534 - DNA, 541 bp, Homo sapiens
  misc_feature: GYAE6OF02FS6BR.35.85.H08.1.454.CMB.1.raw
  modified_base (314)..(314): a, c, t, g, unknown or other
  misc_feature (314)..(314): n is a, c, g, or t
tcagtacagatcgtcacgaccggtgctcgatttagtatcactcagtcggcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagtaaagttggccaggctcccaggctcctcatctttggtgtgtccacgtagggccnctggtctcccagtcaggttcaggtggcaggtggctcgtgggactagacgtttccaacttcctcaacctatcgagcgagcctgctaggtctagtaagttattttgctagtttattactgttcagtctattatgtattacgtcgtccgtcggtcggtacgttcgtaccgaacggaccgtaaggtaggaacgtaccgaacgaacgtgtacggtctcgacctacctatccg

SEQ ID NO: 242535 - DNA, 535 bp, Homo sapiens
  misc_feature: GYAE6OF02G09D1.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtgtccacgtaggggccgctgggtcgtccccagtccaggttcagtggcaggtggctcgtgggacaggtacgttcacttctcaccatcagcagcctgcagtctagaagtatttgcttagtttattacttgtcagtactaattataatagtcgtcggtcctccgtagttcgtcgttacgttttcggaccgtaacggggacctaaggtcgtaggagactacgaaacgacgtggtggctacg

SEQ ID NO: 242536 - DNA, 555 bp, Homo sapiens
  misc_feature: GYAE6OF02ISTHI.35.85.H08.1.454.CMB.1.raw
  modified_base (550)..(550): a, c, t, g, unknown or other
  misc_feature (550)..(550): n is a, c, g, or t
tcagtacagatcgtcacgaccggtgctcgatttagtatcactcagtcggcgggggaggaactgctcagttaggacccagacggaaccatggaagccccagcgcagcttcctcttcctcctgcctattctggctcccagatatcactggagaaatagtgatgacgcagtctccaaccactctgtctgtgtcctccaggggacagagccaccctctcctgcagggccagtcagagtgttaagcagcaacttagcctggtaccagcagaaagttggccaggctccaggctcctcattcgtttggtgtgtccacgtacgggccgcgttggtcgtccccgagttcaggtttcaggtggcaggtggctcgtgggacaggagttcactctacaccatcagcagcctgcagtctagaagtattttgtacttagttttacttactgtcagtactaatataatagtcgtgggtcctcggtaagttcgtacttacgttttcggcccgtaaggggaaccaaggtccgtaggaagtactaccgaaaccgtaacgtggtacggntccgg

SEQ ID NO: 242537 - DNA, 507 bp, Homo sapiens
  misc_feature: GYAE6OF02F3JC2.35.85.H08.1.454.CMB.1.raw
  modified_base (296)..(296): a, c, t, g, unknown or other
  misc_feature (296)..(296): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccacgtagggccgctggtgtcccagtcaggttcagtgcagtggctcgtgggacagagttcactctcaccatcagcacgctgcagtctgaagtattttgcttagtttattactgtcagcaatataatagctgtcctcgagttgctacgtttggccgtacggggacctaaggtcgtaggagacgtacgaaacgtactggtcggtctacg

SEQ ID NO: 242538 - DNA, 507 bp, Homo sapiens
  misc_feature: GYAE6OF02H5KVT.35.85.H08.1.454.CMB.1.raw
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcattcttggntgtccatagggccnctggtgtcccagtcaggttcagtgcagtgctcgtgggacagagttcactctcaccatcagcagcctgcagttctgaagtagttttgctagttttattactgtacagactaataataatagcgtgcctcgagttcgctacgtttggccgtagggaccaaggcgtaggagtagtacgaaacgtactaggtcggtcgtacg

SEQ ID NO: 242539 - DNA, 586 bp, Homo sapiens
  misc_feature: GYAE6OF02IIQX7.35.85.H08.1.454.CMB.1.raw
  modified_base (322)..(322): a, c, t, g, unknown or other
  misc_feature (322)..(322): n is a, c, g, or t
  modified_base (369)..(369): a, c, t, g, unknown or other
  misc_feature (369)..(369): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggcctcccgaggtctccctcattcgtttggtcgtcgtccacgtagggccncgtgggtctcctagtcgtaggttcaggtggcaggtcgctcgtggacngtacgttcactcctacaccactcgacgcacgccgtcgctagtctaggtaagttagtttcgacttagtttacttacgtgtacgacgtactaattactaagtacgtcgttacgtaccgtaccggtagttcgtacgttacgttttcggaccggtaacggggaacctaacggtccgtaggtacgtacgtaacgtaaaccgtacggtcggttacggctacgg

SEQ ID NO: 242540 - DNA, 512 bp, Homo sapiens
  misc_feature: GYAE6OF02IR0GK.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgactcagtctccaaccactctgtctgtgtctccaggggacagagccaccctctcctgcagggccagtcagagtgttagcagcaacttagcctggtaccagcagaaagttgccaggctccaggctcctcatctttggtgtgtccacgtagggccgctggtcgtcccagtcaggttcagtgcagtggctcgtgggacagagttcactctcaccatcagcacgcctgcagtctgaagtatttgctagtttattactgtcagcaatataatgctgcctcgtagttgtctacgtttggaccgtaggggtaaccaaggtcgtagggagtacgtaacgtaaacgacgttaggtcggactacg

SEQ ID NO: 242541 - DNA, 763 bp, Homo sapiens
  misc_feature: GYAE6OF02JTW3J.35.85.H08.1.454.CMB.1.raw
  modified_base (298)..(298): a, c, t, g, unknown or other
  misc_feature (298)..(298): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctccaggcctcctcatcgtttggngtcgtccacgtacggggcccgcgttcgggtcgtccccgaggttcctaacgggtttccagggtcgggtacaggttcgggccttcgtggggaacctaggtacggtttccaacgttccttacgaaccctacgttaccgacgcgtaaccggtccttcggtaccgtaacggttaccgttaggtaaacggttacgtttttacggtaccgtttaacggttttaacttttaaccgttacggttaccgttaacggtaaccttaaaagtttaacgttaaaagttaggtacccgttaacgggtaccccgtttacccgggtaacgttttacgggttaccgtttacccggtttttacgggaccccggttaaccggggggtaacccttaaacgggttaccggttacggggtaacggttaacggttaaccggtaaaaacccggttaaccggttacgggttaccggtacggttaacccggg

SEQ ID NO: 242542 - DNA, 519 bp, Homo sapiens
  misc_feature: GYAE6OF02GV4L1.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccacgtagggccgctggtcgtcccagtcaggttcagtggcagtggctcgtgggacagagttcactctcaccatcagcagcctgcagtctgaagtatttgcttagtttattactgtcagctaatataatagctggcctcgtagttgacttacgtttcgggccgtaacggggaacctaaggtcgtaggagtacgtacgaaacgtaacgtggtacggctacgg

SEQ ID NO: 242543 - DNA, 526 bp, Homo sapiens
  misc_feature: GYAE6OF02HFZC6.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtcgtgtccacgtagggccgctggtcgtcccagtcaggttcaggtggcagtggctcgtgggacaggagttcactctcaccatcagcagcctgcagtctagagtatttgactagtttatacttgtcagacaatataatagtactcggacctccgtaagttcgacttacgttttggacccgtaaggggacctaaggcttaggagtactacgaaacgtaacgtggtacggctacg

SEQ ID NO: 242544 - DNA, 520 bp, Homo sapiens
  misc_feature: GYAE6OF02HE71K.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtgtccactagggccgctggtgtccccagtcaggttcagtggcagtgctcgtgggacagagttcactctcaccatcagcacgcctgcagtctgaagtattttgactagtttattactgtcagctaatataatagcttggccctccggtagttcgtcttacgttttggacccgtaggggacccaaggtccgtaggagactacgaacgaacgttcgtggctacgg

SEQ ID NO: 242545 - DNA, 491 bp, Homo sapiens
  misc_feature: GYAE6OF02GYNLJ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctctgggacagagttcactctcaccatcagcagcctgcagtctgaagattttgctagtttattactgtcagcaatataatagctgcctcgagttgctactttggccgaggggaccaaggctggagatacgaaacgtaactgtggctcg

SEQ ID NO: 242546 - DNA, 528 bp, Homo sapiens
  misc_feature: GYAE6OF02IWEYY.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattcgtttggtgtgtccacgtaggggccgcgtgggtcgtccccagtcaggttcaggtggcagtggctcgtggacagagttcactctcaccatcagcagcctgcagtctgatgtactttgctaactattactgccaactattacacgtctactttactttctcgtttcggcgggtacggaccgtaaggtacggactagtacaagtaaccgaacgttggtacggccgtcgacctacctattcg

SEQ ID NO: 242547 - DNA, 599 bp, Homo sapiens
  misc_feature: GYAE6OF02G9W2E.35.85.H08.1.454.CMB.1.raw
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccggtcctccagggacgcccatgctgcaagtcggccagaggtgcccctgaacctgaagccaatgagacccaagacaggccaagtggtgtgagacccctgacggagcgtgggccctcggtcccaggcagcgctcggcccctgctgctcgctgggtctggccagtcggtcgcccagtcggcctggcctcgccgcccgaagtcgggttcgccgtacccggacgaaaccggccgggggaacccacggaccccgtcgggacgccctcgacgttcggaacgcaacggccgagtcccaggccccgtaggccggtacgtcccgtgggtcggggacctacggggtaccgaccggaccccgtaacggcccctaaaccccgg

SEQ ID NO: 242548 - DNA, 665 bp, Homo sapiens
  misc_feature: GYAE6OF02I3GQP.35.85.H08.1.454.CMB.1.raw
  modified_base (125)..(125): a, c, t, g, unknown or other
  misc_feature (125)..(125): n is a, c, g, or t
  modified_base (147)..(147): a, c, t, g, unknown or other
  misc_feature (147)..(147): n is a, c, g, or t
  modified_base (175)..(175): a, c, t, g, unknown or other
  misc_feature (175)..(175): n is a, c, g, or t
  modified_base (221)..(221): a, c, t, g, unknown or other
  misc_feature (221)..(221): n is a, c, g, or t
  modified_base (249)..(249): a, c, t, g, unknown or other
  misc_feature (249)..(249): n is a, c, g, or t
  modified_base (435)..(435): a, c, t, g, unknown or other
  misc_feature (435)..(435): n is a, c, g, or t
tcagtacagatcgtcacgaccggtgctcgatttagtatcactcagtcggcggggaggaactgctcagttaggacccagacggaaccatggaagccccagcgcagcttctctcctcctgctattcnggctcccagatagtcactgganaatagtgatgacgcagtctaccaaaccncgtctaggtctgtgtcctccgagggaccaggacgccaccctgtccnggcacgggtccaggtccaggtatgtacncagtcaacttgctaggtacagccaagaacgttcgcctaggcctccgaggtctcctacgtactttcgttggtcgtcgtacccgtaacgttacggggcctcgttggtccggtcccacggttcgaccggtttcaaggtcggtcgtaacggtcggtcgtccgttagggaaccagtacgttaccacgttcncaacctactcacgcgacgtccgcgctacgtcgtacgaacgttagtttcgtacgtacgtttattacttcgtacctagtacaattacttaagtaacgtccgtcggtaccgtaccgttaacggttcgtacgtacgttttacggaccgtaacgggtaacccgtaaacggtccgttaacggtacgtaacggttaacccgtaaaaccggtaacgtacggtccggtacgtaacccgg

SEQ ID NO: 242549 - DNA, 537 bp, Homo sapiens
  misc_feature: GYAE6OF02I993K.35.85.H08.1.454.CMB.1.raw
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
tcagtacagatcgtcacgaccggtgctcgatttagtatcactcaggtcgcgggggaggaactgctcagttaggacccagacggaaccatggaggccccagccgcagcttctcttcgtcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaaggcctacccaggctcctcatctttggtgtgtccactagggcctgtggtcgtcccagtcaggttcagtggcagtggctgtgggacagagttcacttcncacatcagnacgctgcagtctagagtatttgactagtttattactgtactagctaactataatagtcttacggcctacgtagttcgacttacgttttggaccgtaaggggtacctaagggtccgttaggagtacgtacgaaaccgtagtacggtacggtactacgg

SEQ ID NO: 242550 - DNA, 217 bp, Homo sapiens
  misc_feature: GYAE6OF02JW5VP.35.85.H08.1.454.CMB.1.raw
  modified_base (212)..(217): a, c, t, g, unknown or other
  misc_feature (212)..(217): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccaggaactgtggctgcaccatctgtcttcatcttcccgcatctgaacgatctgtactgagcgggctggcaaggcgcatagnnnnnn

SEQ ID NO: 242551 - DNA, 490 bp, Homo sapiens
  misc_feature: GYAE6OF02I68O8.35.85.H08.1.454.CMB.1.raw
  modified_base (227)..(227): a, c, t, g, unknown or other
  misc_feature (227)..(227): n is a, c, g, or t
  modified_base (311)..(311): a, c, t, g, unknown or other
  misc_feature (311)..(311): n is a, c, g, or t
  modified_base (487)..(487): a, c, t, g, unknown or other
  misc_feature (487)..(487): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagngtgttagcagcaacttagcctggtaccagcagaaagttggccaggctcccaggctcctcatctttggtgtgtccactagggccnctggtgtccccagtcaggttcagtggcagtggctcgtgggacagattcactctcaccatcagcagcctgcagtctgaagtattttgctagtttattactgtctagcaatataatagctgcctcgagttgctactttggccgaagggaccaagcgtgagactcaaacgaactgtggntcg

SEQ ID NO: 242552 - DNA, 507 bp, Homo sapiens
  misc_feature: GYAE6OF02HT6T2.35.85.H08.1.454.CMB.1.raw
  modified_base (310)..(310): a, c, t, g, unknown or other
  misc_feature (310)..(310): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaattagcctggtaccagcagaaagttggcaggctccaggctcctcattctttggtgtgtccactagggccnctggtgtcccagtcaggttcagtgcagtggctcgtgggacagagttcactctcaccatcagcagctgcagtctgtaagtatttgctagtttattactgtctagactaatataatagtctgcctcgagttcgctacgtttcggaccgtaggggaccaaggcgtaggagtacgtacgaaacgtaacgtagtgacgtacg

SEQ ID NO: 242553 - DNA, 508 bp, Homo sapiens
  misc_feature: GYAE6OF02G1CD3.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacgtaggggcccgcgtggtgtccccagtcaggttcagtggcaggtggctcgtgggacagagttcactctcaccatcagcagcctgcagtctagaagtatttgctagtttattactgtcagcaatataatagctgtcctcgtagttgctacgtttggaccgtaggggaccaaggcgtaggagacgtcgaaacgtacgtgtcggctacg

SEQ ID NO: 242554 - DNA, 567 bp, Homo sapiens
  misc_feature: GYAE6OF02IDTMH.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggcctcccgaggtcctcctcattcgttttggtgtcgtccacgtaggggcccgcgtgggtcgtcccagtcaggttcaggtggcaggtgctcgtgggacaggtacgttcactctccaccatcagcacgcctgctagtctagtaagtatttgcttagtttattacgttgtacagtactaaattaataaagttacgtcgtcggtccgttaccggtagttcgtaccttacgttttacggcccgtaacggggtaccgtaacggtcgtagggacgtacgtacgtaaaccgg

SEQ ID NO: 242555 - DNA, 694 bp, Homo sapiens
  misc_feature: GYAE6OF02HQIJB.35.85.H08.1.454.CMB.1.raw
tcagtacagatcgtcacgaccggtgctcgatttagtatcactcagttcggtcggggggaggaactgactcgagttaggacccaggacggaaccataggaagccccgagcgcagccttctcttcctccttgctatttctggctccgagtatatcacgtggaggaaatagtgatgacgcagtctccaacactctgtctgtgtctccgaggggacaggagcccaccctctcctagcgacgggccacgtcaggagtgttagtcagacaacttacgacctaggtaaccagactaagaaagttggacccaggcctacccgaaggcctaccctcgactttccgtttagggtcgttcgtaccctacgttaggggtcccgtgttcgggtacgttaccccgtaaggttccgtacgggtttccagggtacggctacggtggtcgtcgtaggggactaggacgttcacgtctcgaacctatacacgactacgcctgacgtacgtcgtagtaagtacgtttagacgttagttttacttacgttcgttacgtagtactaaagttaacgtaagtacgtacgttacgtaccgttacggtacgtttcgttaccgttacgttttcgggaacccggtaaggggtaacccgtaagggtacgttacgggaacgtacgtaaccggtaaacgtaacgttacggtacggtacctacgg

SEQ ID NO: 242556 - DNA, 525 bp, Homo sapiens
  misc_feature: GYAE6OF02IWKU8.35.85.H08.1.454.CMB.1.raw
tcagtacagatcgtcacgaccggtgctcgatttagtatcactcagtcggcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttgggtgtcgtccacgtagggccgctggtcgtcccagtcaggttcagtggcaggtggctcgtgggacagtagttcactctcaccgatcagcagcctgacagtctagaacgttatttgacttagtttattactgtctagctaatataactgtctacggtctacgtagtgtcctagtttcggaccggtagggaccaggtccttaggatacgtacaaacgacgtggtacgtctacgg

SEQ ID NO: 242557 - DNA, 494 bp, Homo sapiens
  misc_feature: GYAE6OF02IX9PA.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccacgtagggccgctggtgtcccagtcaggttcagtggcagtggctcgtgggacagtagttcactctcaccatcagcagcctgcagtctgaagtatttgctagtttattactgtcagtacaatataatagtctgcctcgtagttgctacgtttcggcgtacgggaccagctggagatacgaaacgtactgtgctcg

SEQ ID NO: 242558 - DNA, 586 bp, Homo sapiens
  misc_feature: GYAE6OF02JT0CL.35.85.H08.1.454.CMB.1.raw
  modified_base (227)..(227): a, c, t, g, unknown or other
  misc_feature (227)..(227): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
  modified_base (351)..(351): a, c, t, g, unknown or other
  misc_feature (351)..(351): n is a, c, g, or t
tcagtacagatcgtcacgaccggtgctcgatttagtatcactcagtcgcgggggaggaacgtgctcagttaggacccagacggaaccatggaagcccagcgcagcttctcttcctcctgctattctggctcccagatatcactggagaaatagtgatgacgcagtctccaaccactctgtctgtgtctccaggggacagagccacctctcctgcagggccagtcagngtgttagcagcaacttagcctggtaccagcagaaagttggccaggctccaggctcncatctttggngtgtccagtagggccngtggtctcccagtcaggttcagtggcaggtgctcgtgggacngtagttcacgtctacacagtcagcagcctgcacgttcctagaagtagttttcgtacttaggttttattacttgtctaggtactaatacttaagtacgtcgttacggtcccttaccgtagttacgtccgttacgtttttcggacccggttaaggggtaacccttaacggtccgttaagggtacgtaacgttaccggaaaaccggttaacgtttacgggtaccggtacggttaccgg

SEQ ID NO: 242559 - DNA, 490 bp, Homo sapiens
  misc_feature: GYAE6OF02FSQ9I.35.85.H08.1.454.CMB.1.raw
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
  modified_base (487)..(487): a, c, t, g, unknown or other
  misc_feature (487)..(487): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggcaggctcccaggctcctcatctttggngtgtccactagggccnctggtgtccccagtcaggttcagtggcagtggctctgggacagagttcactctcaccatcagcagcctgcagtctgaagtattttgctagtttattactgtcagcaatataatagctgcctcgagttgctacgtttggccgaggggaccaaggctggagatacgaaacgactgtggntcg

SEQ ID NO: 242560 - DNA, 503 bp, Homo sapiens
  misc_feature: GYAE6OF02H09SL.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccaggggacagagccaccctctcctgcagggccagtcagagtgttagcagcaacttagcctggtaccagcagaaagtggccaggctccaggctcctcattctttggtgtgtccacgtacggggccgcgtgggtcgtccccagtcaggttcagtggcaggtggctcgtgggacagagttcactctcaccatcagcagctgcagtctgaagtatttgctagtttattactgtcagtacaatataatagctgtcctcgtagttgctacgtttcggcgacgggaccaagcgtagagactacaaacgacgtagtggctacg

SEQ ID NO: 242561 - DNA, 527 bp, Homo sapiens
  misc_feature: GYAE6OF02GQ2QE.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacgtaggggccgctgggtcgtcccagtcaggttcagtggcaggtggctcgtgggacagtagttcactctcaccatcagcagcctgcagtctgaagtatttgctagtttattactgtcagtctaatataatagcttcggcctccgtagttgctacgttttcggaccgtaacggggtacctaaggtcgtagggagtacgtacgaaaccgtacgtaggtcggctacgg

SEQ ID NO: 242562 - DNA, 497 bp, Homo sapiens
  misc_feature: GYAE6OF02G0BOL.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctgggtgtccccagtcaggttcagtggcagtggctctgggacagagttcactctcaccatcagcagcctgcagtctgaagtattttgctagtttattactgtcagcaatataatagctggtcctccgtagttgtctacttttggccgaggggaccaaggctggagatcgaaacgactgtggctacg

SEQ ID NO: 242563 - DNA, 532 bp, Homo sapiens
  misc_feature: GYAE6OF02H4RR7.35.85.H08.1.454.CMB.1.raw
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggngtgtccactagggccnctggtgtcccagtcaggttcagtggcagtggctcgtgggacagagttcactctcaccatcagcacgcctgcagtctcgtaagtattttgtactagtttatttactgtcagtactaatataatagtctgtcctaccgtagttcgtctacgttttcggaccgacggggtaaccgaacggtacgtcggtaagtacgtaccgtaaacgtaacgtggtcggcgtacg

SEQ ID NO: 242564 - DNA, 528 bp, Homo sapiens
  misc_feature: GYAE6OF02FU2LJ.35.85.H08.1.454.CMB.1.raw
  modified_base (288)..(288): a, c, t, g, unknown or other
  misc_feature (288)..(288): n is a, c, g, or t
  modified_base (315)..(315): a, c, t, g, unknown or other
  misc_feature (315)..(315): n is a, c, g, or t
  modified_base (361)..(361): a, c, t, g, unknown or other
  misc_feature (361)..(361): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctcccaggcctccncatctttggtgtgtccacgtagggccntggtcgtccccagtccaggttcaggtggcagtggctgtgggacagngttcactctcaccatcagcagcctgcagtctagaagtatttgcttagtttacttacgtgtcagtactaataataatagtctaggcctacgtagttgcttacgtttacggaccgtaacggggaacctaaggtcgtaggagactacgaaacgtactggtacggcgtacg

SEQ ID NO: 242565 - DNA, 525 bp, Homo sapiens
  misc_feature: GYAE6OF02HUYJO.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctccaggctcctcattctttggtgtgtccacgtacgggccgcgtggtcgtccccagtcgtaggtttcaggttggctaggtggctcgtgggacaggagttcactctcaccatcagcagcctgcagtctgaagtatttcgatagtttatacgtgtcagtactaatataatagcgtcgcctacgagttgccttagtttcggacgaagggtaccaagcgtaggagtacgtacgaaacgtacgtggtcggatacgg

SEQ ID NO: 242566 - DNA, 512 bp, Homo sapiens
  misc_feature: GYAE6OF02GTU46.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctcgtgggacagagttcactctcaccatcagcacgcctgcagtctagaagtatttgacttagtttattactgtcagtactaattataatagcttgcctcgtagttgctacgtttggccgtagggacctaaggcgtaggagtacgtacgaaacgtacgtggtcggctacg

SEQ ID NO: 242567 - DNA, 499 bp, Homo sapiens
  misc_feature: GYAE6OF02H5GUP.35.85.H08.1.454.CMB.1.raw
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccacttagggccnctggtntccccagtcaggttcagtggcagtggctcgtgggacagagttcactctcaccatcagcagcctgcagtctgaagtatttgctagttttattactgtcagcaatataatagcttgcctccgagttgtctacttttggcgaggggaccaaggtctggagactacaaacgaactggtggctacg

SEQ ID NO: 242568 - DNA, 604 bp, Homo sapiens
  misc_feature: GYAE6OF02H9950.35.85.H08.1.454.CMB.1.raw
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaacactctgtctgtgtctccaggggacagagccaccctctcctgcagggccagtcagagtgtagcagcaacttgcctggtaccagcagaagttggccaggctccgaggctcctcattctttggngttgtccacgtaggggcccngtacggtcgtcccaggttccaggttcaggttggacaggttcgggcttcggtaggggactaggtagtttccacttctaccaccatcgacgcacgccttgctagtcgtagtaagttactttgcttagtttacttacgtgtactagtactaattataatagtcgtacggtcctacggacgttgcttacgtttcggaccgtagggaccacggtcgtaaccggggtttaaccggtaaccggttaaccggtaaaccgggttaaccggtttacgggttaccggtaccgtttaaccggg

SEQ ID NO: 242569 - DNA, 529 bp, Homo sapiens
  misc_feature: GYAE6OF02GY16E.35.85.H08.1.454.CMB.1.raw
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggccaggctcccaggctcctcatcttggntgtccactagggccnctggtcgtcccagtcaggttcagtggctagtggctcgtgggacagagttcactctcaccatcagcagcctgcagtctgaagtatttgctagtttacttactgtctagtcaattataatagtactcggtccttaccggtagttcgacgtacgttttcggacccgtacggggacctaaggtccgtaggtagacgtacgaaacgtaacgtcggtggactacgg

SEQ ID NO: 242570 - DNA, 552 bp, Homo sapiens
  misc_feature: GYAE6OF02GQKJI.35.85.H08.1.454.CMB.1.raw
  modified_base (279)..(279): a, c, t, g, unknown or other
  misc_feature (279)..(279): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagtgccaggctccagctcncatcttggtgtgtccactagggcctcgtggtgtcccagtcaggttcagtggcagtggctgtgggacagtagttcactctcaccatcagcagcctgcagtctagagtatttgcttagtttattacttgtctagtactaaattataattagtcgttacggtccctaccgtagtttcgtacgttacgttttcggaccggtaacggggtaacccgtaacggtacgttacgggagtaacgttaccgaaaccgtaaccgttacggtacggtacgtacgg

SEQ ID NO: 242571 - DNA, 502 bp, Homo sapiens
  misc_feature: GYAE6OF02FFMAR.35.85.H08.1.454.CMB.1.raw
  modified_base (440)..(440): a, c, t, g, unknown or other
  misc_feature (440)..(440): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctccctgcagggccagtcagagtgttagcagcaacttagcctggtaccagcagaaagttggccaggctcccaggctcctcatcttttggtgtgtccacgtagggccgctggtgtccccagtcaggttcagtggcagtggctcgtgggacagagttcactctcaccatcagcagcctgcagtctgaagtattttgctagtttattactgtcagcaatataatagctgcctcgngttcgctacgtttggaccgtaggggaccaaggcgtggagatacgaaacgactgtggcgtacg

SEQ ID NO: 242572 - DNA, 528 bp, Homo sapiens
  misc_feature: GYAE6OF02HVZCF.35.85.H08.1.454.CMB.1.raw
  modified_base (427)..(427): a, c, t, g, unknown or other
  misc_feature (427)..(427): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttagcctggtaccagcagaaagttggccaggtctccaggctcctcattcgtttggtgtgtccacgttaggggcccgtctgggtcgtccccagtcaggttcaggtggcaggtggctcgtgggacagtagttccactctcaccatcagcacgcctgcagtctagaagtagtttgctagtttattactntacagactaatataatagtctcgtcctacgtagttgctacgtttggaccgtacgggaccaaggtcgtaggagactacgaaacgtaacgtacggtagctacg

SEQ ID NO: 242573 - DNA, 688 bp, Homo sapiens
  misc_feature: GYAE6OF02J3N62.35.85.H08.1.454.CMB.1.raw
  modified_base (670)..(670): a, c, t, g, unknown or other
  misc_feature (670)..(670): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggagaaatagtgatgacgcagtctccaaccactctgtctgtgtctccgaggggacagacgccaccctctcctgcacgggccagtcagagtgttagcagcacttagcctggtaccagcaagaaagttcggaccaggcctccccgaaggtcctaccctcagttccgtttggcgttcgtccgacgtacggggccctgtcgggtcgtccccgaggttccgtaaggttcaggttcggctaggttcgggccttcggtacggggactaggtacggtttccaccgttctaccaccgtatacccgaggtccaacgggtcccttggacctacggttcgttagggaacggttaccttttacggaccctttaaacgtttcgttacccgtacgtaccctaaaagtaacgttacttaaacgttaccgtttacccctaacgtttaaccgttccggggacggaaaccgggtaacctaacgggttacgaacgaacccggtaaaaggttcgtcggttaccgggacttacgaccgtacaccgtttnacgtttcctaccttaccg

SEQ ID NO: 242574 - DNA, 508 bp, Homo sapiens
  misc_feature: GYAE6OF02IVZVN.35.85.H08.1.454.CMB.1.raw
  modified_base (370)..(370): a, c, t, g, unknown or other
  misc_feature (370)..(370): n is a, c, g, or t
  modified_base (406)..(406): a, c, t, g, unknown or other
  misc_feature (406)..(406): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggggacagagccaccctctcctgcagggccagtcagagtgttagcagcaacttagcctggtaccagcagaaagttggccaggctcccaggctcctcatctttggtgtcgtccactaggggccgctggtcgtcccagtcaggttcagtggcagtgctctgggacagngttcactctcacatcagcagcctgcagtctgaagtnttttgctagtttattactgtacagtcaattaataatagctgcctcgtagttcgactacgtttgccgtagggaccaacggtctaggaagtacgtataaaccgg

SEQ ID NO: 242575 - DNA, 865 bp, Homo sapiens
  misc_feature: GYAE6OF02GEFS0.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctatctggctcccagatactcgactaggtagaaattagtgaactggtacgccgacgtcctcctaaccctactctcgtacggtagtgtcctacccaggggtaccaggacgccgacccctacgtccctaggccgtaggggtaccacgggttcccaagggtaccggttgggtttaaccgaccgaaggaccgtaaacctttagggccctaggggtacccacggacgacgtaaacgtttcgggacccctaaggggtcctaccccgtaagggtccctacccgttaccgtaaacgttccggttttcgggtacgttcgggtaccccgtaaccggttaccggggacccggtccgttacgggggtttcgtacccccggtagggtccggtaacggggtttccgaaggggttcgggaccgtacgggtttcgggaccgttccgtaggggaaccctaaggtacgtttaccgaccttaccgttcccgaaccgaacgttcccgtaaggtaccgtaacggttcccgtacgttaccgttaacgtttaccgttacggtaaacgttagttttacgacgttacggttttaacgttacgttacgttaccggtaagttaccgtaaacgtttaacgtaacgttaacggtaccgttaacgggtacccggttaacgtaacggttaacgaccgttacgtttacgggaccgttacgggaaccctaacggacgttcggacgtacgtaccgaacgtacgttccggtacgtctacgg

SEQ ID NO: 242576 - DNA, 512 bp, Homo sapiens
  misc_feature: GYAE6OF02FZRP2.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacgtaggggccgctgggtcgtccccagtcaggttcaggtggcaggtggctcgtgggacagagttcactctcaccatcagcacgcctgcagtctgaagtatttgctagtttattactgtcagcaatataatagctgcctcgtagttgtctacgtttcggccgtaggggaccaaggcgtaggagtactacgaaacgtacgtgtcggtctacg

SEQ ID NO: 242577 - DNA, 584 bp, Homo sapiens
  misc_feature: GYAE6OF02JULY4.35.85.H08.1.454.CMB.1.raw
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacgcccatcgctgcaagtcggccagaggtgccctgaacctgaaggccaatgagaccaagacaggccaagtggttgtgacgacccgtgacggagcgtgggcccgtggtcccgaggcaggcgcgtcggccctgctgctgcgtgggtctcggccagtcggtccgcccgagtcggcctgctcgcgccagtggttcgcgacgcgaacgccgggacccacgacccgtggaccgccgtcgacggttacggaacgccgacgaccgactccgacgccggtcggaccggacgtccgttacgggccgggacgtacgggtaccgaccggtacccggaccggccccgtaaaccccg

SEQ ID NO: 242578 - DNA, 537 bp, Homo sapiens
  misc_feature: GYAE6OF02IZ3SP.35.85.H08.1.454.CMB.1.raw
  modified_base (376)..(376): a, c, t, g, unknown or other
  misc_feature (376)..(376): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtattcggaacaacgtagtctggtaccagcagaaacctggccaggcctcccaggctcctcatctatggtgcatccaccagggccacgtggtactcccgagccaggttcagtggcagtgggtctgggacagacttcactctcacatcancagcctgcagtctagaagtattatgtctaagttttatcactgtaccagtactaagttttaataggtctcggtccccgcgtcttctccgtttcgggcgggaacgggtaccaagggtaggaagtacgtaacgaaaacgtacgtaggtacggactcgctaaccg

SEQ ID NO: 242579 - DNA, 519 bp, Homo sapiens
  misc_feature: GYAE6OF02GY0DX.35.85.H08.1.454.CMB.1.raw
  modified_base (116)..(116): a, c, t, g, unknown or other
  misc_feature (116)..(116): n is a, c, g, or t
  modified_base (175)..(175): a, c, t, g, unknown or other
  misc_feature (175)..(175): n is a, c, g, or t
  modified_base (184)..(184): a, c, t, g, unknown or other
  misc_feature (184)..(184): n is a, c, g, or t
  modified_base (288)..(289): a, c, t, g, unknown or other
  misc_feature (288)..(289): n is a, c, g, or t
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (396)..(396): a, c, t, g, unknown or other
  misc_feature (396)..(396): n is a, c, g, or t
tcagtacagatcgtcacgaccggtgctcgatttagtatcactcagtcggcgggaggaacgtcgctcagttaggaacccagacggaacctatggaagcccagcgcagcttctactcncctgctatctgctccgagatatcacgttggagtaaatgtgtaatgacgcagtctcaacntctgtctgngtctcgaagggcagagcctaccctgtcctgcagggcctagtcagtgtgtacgcagctaagttagccttgacagcagaacgtgcagctccgagcactcatctggnngtccagtggccngtgtcgtaccagcaggtcagtgcagtgctgaggcagntcgatcgnaccatcagcagcgnacagtnacganattgactagttatactagcgtacgnaattataaacgtagtaccgtggtacctacgtacgttagttcgaccgttttaggaccgtaacgggaaccgtaacggaccgtaggacgtacgtacgtaaacgtaacgttacggacggtacgtccg

SEQ ID NO: 242580 - DNA, 531 bp, Homo sapiens
  misc_feature: GYAE6OF02HVM8U.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccagctcctcattctttggtgtgtccacgtagggccgcgtggtcgtcccagtcaggttcaggtggcaggtggctcgtggggacagagttcactctcacactcacgcacgcctgcacgtcgtgtaagtatttgtcttagtttattactgtcagactaatataatagtactgtcctcgagttgtcttacgttttcggaccggtacgggtaaccgaaggtcgtacggagtacgtacgaaaccgtacgtaggtggctacg

SEQ ID NO: 242581 - DNA, 750 bp, Homo sapiens
  misc_feature: GYAE6OF02JNE2A.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcaagtgtgtacgcagactaacgttacgccgtaggtaaccagacgaaaggtaaacggttcggacccgacgggtccctacccggacggtcccttacccgtctacgtttccgtttggtcgttccgtaccgacggtaccggggtcccgtcggtttgggtccgtacccgtaggttaccggtacgggttccgaggggttcgggaacgttcgggttcggtaccgttcgggtacgggaacgtacggtaccgtttaccgaaccttttccgtaacccaaccgttaacgtaccgtaacggaccgtaccggtcccgttacggacgtacggttaccgtaagttaacgtttagtttccggtactttaaacgttttacttacgttacggtactaagtaactaaagttaattaacgtagtccgtcgtaccgtacggtagtttaccgtacgttttacgttaccgggaccggtaacgggtactaacgggtaccgtaaggaacgtaccgtaaacggtaacgttaacggtgttacggtacgtaccg

SEQ ID NO: 242582 - DNA, 490 bp, Homo sapiens
  misc_feature: GYAE6OF02JAWAB.35.85.H08.1.454.CMB.1.raw
  modified_base (416)..(416): a, c, t, g, unknown or other
  misc_feature (416)..(416): n is a, c, g, or t
  modified_base (487)..(487): a, c, t, g, unknown or other
  misc_feature (487)..(487): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctcgtgggacagtgttcactctcaccatcagcagcctgcagtctagaagtatttgctagtttattactgtcagnaatataatagctcggcctcgagttgctactttggccgagggtaccaagctaggagatcgaacgagtgtggntcg

SEQ ID NO: 242583 - DNA, 578 bp, Homo sapiens
  misc_feature: GYAE6OF02F2QQF.35.85.H08.1.454.CMB.1.raw
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctcggccctgctgctgctgggtctgggccagtcggtcgcccagtcggcctgcctcggccgcccaagttcggttcgcctaccggacgaaacggccggggaacccacggacccgtgggacgcccgtcgacggttaggaacgtcgacgcccgatcccgagcccgtggaccggacgccgtgggtcggggcacgggtccgacggaccccgacggcccctaaccccg

SEQ ID NO: 242584 - DNA, 618 bp, Homo sapiens
  misc_feature: GYAE6OF02HMGX4.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcaggtagtttagcagctaacttagcctggtaccagcaagaaagttggaccaggcctccgaggcctcctcattcgtttggtgtcgtccacgtacgggcccgtcgtggtcgtcccgtagtcgtaggttcaggtggcgaggtcggcttcggtgggactaggtagttaccacttccgtaccacctatacgacgacacgtcctcgcgtacgtctagaagtagttttgacgttagtttatttacgttcgtcgtagactaaataattaaagtagtcgtacggtaccttaccggtagttcgtcgttacgttttacgggaccggtaacggggaaccgtaaggcggttacggaagtaacgtaccgtaaacggtacgttacgggtacggtaccgtacgtaacccg

SEQ ID NO: 242585 - DNA, 553 bp, Homo sapiens
  misc_feature: GYAE6OF02HK6KX.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatcgtttggtgtgtccactaggggccgcgtggtcgtcccagtccaggttcaggtggcaggtggctcgtggggacaggagttcactctcaccatcagcagcctgcagtctgaagtattttcgacctaaccttacttatttcgtacctaaacgagtaagtttaacacgttaccgcccgacgactcagtccttacggaccgaagggaccaacggacgtagggaagtaacgttaaaagacgttaggtacggtacgtacggaccaccgtac

SEQ ID NO: 242586 - DNA, 496 bp, Homo sapiens
  misc_feature: GYAE6OF02IPEBX.35.85.H08.1.454.CMB.1.raw
  modified_base (353)..(353): a, c, t, g, unknown or other
  misc_feature (353)..(353): n is a, c, g, or t
  modified_base (491)..(491): a, c, t, g, unknown or other
  misc_feature (491)..(491): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctcgtgggacngagttcactctcaccatcagcagcctgcagtctgaagtattttgctagtttattactgtcagcaatataatagctgcctccgagttgctactttggccgtaggggaccaggctaggagactacgaaacgactggtggntacgg

SEQ ID NO: 242587 - DNA, 517 bp, Homo sapiens
  misc_feature: GYAE6OF02GXUJS.35.85.H08.1.454.CMB.1.raw
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (393)..(393): a, c, t, g, unknown or other
  misc_feature (393)..(393): n is a, c, g, or t
  modified_base (513)..(513): a, c, t, g, unknown or other
  misc_feature (513)..(513): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggngtcgtccacgtgggccnctggtctcccagtcaggttcagtggcagtgctcgtgggacagagttcactctcacatcagcagcctgcagtctagtaagtntttgcttagtttatacgtgtacagactaattatatagtctgtcctcgagttcgcttacgtttcggaccggtacgggtaaccaggtcgtacggagtacgtacgtaacgtacgtcgtacggntacg

SEQ ID NO: 242588 - DNA, 503 bp, Homo sapiens
  misc_feature: GYAE6OF02HBR7M.35.85.H08.1.454.CMB.1.raw
  modified_base (500)..(500): a, c, t, g, unknown or other
  misc_feature (500)..(500): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacgtaggggccgctggtcgtccccagtcaggttcagtggcagtggctcgtgggacagagttcactctcaccatcagcacgcctgcagtctgagtatttgctagtttattactgtcagcaatataatagctcgcctcgtagttgctacgtttcggccgtacgggaccagtcgtaggagtacgtacgaacgtacgtgtggntcg

SEQ ID NO: 242589 - DNA, 607 bp, Homo sapiens
  misc_feature: GYAE6OF02J0OLW.35.85.H08.1.454.CMB.1.raw
  modified_base (337)..(337): a, c, t, g, unknown or other
  misc_feature (337)..(337): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (480)..(480): a, c, t, g, unknown or other
  misc_feature (480)..(480): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacaggacgtccaccctctcctgcacgggccaggtccagagttgttaacgcagacaacttagcctggtaccagcagaaagttcggaccaggctaccgaggcctccctgacttcgttggtcgtcgtccacgtacggggccctntgggttctccccgagtccgtagggttcacggtggcaggtcggctcgtgggacagtagttcactctcaccntcagtcacggtcctgacncgtactggaacgtatttgacttaggtttactacttgcctagactaagtattaaancgtacttcgggaccttggagtttcgacgttacgtttacgggccggtaacggggtaaccagggttaccgttaggaaccgggttaactaccggtaaaaccgttacggttcggtacgggtaccttaccgg

SEQ ID NO: 242590 - DNA, 500 bp, Homo sapiens
  misc_feature: GYAE6OF02IKD58.35.85.H08.1.454.CMB.1.raw
  modified_base (497)..(497): a, c, t, g, unknown or other
  misc_feature (497)..(497): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtcgtcccagtcaggttcagtggcagtggctcgtggacagattcactctcacatcagcagctgcagtctgaagtatttgctagtttattactgtcagtcaatataatagtctgccgtacgtagttcgtctacgtttcggccgagggaaccaggcgtggagtactacgaaacgacgtagtggntcg

SEQ ID NO: 242591 - DNA, 609 bp, Homo sapiens
  misc_feature: GYAE6OF02I7EES.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtcgtctccgaggggacagacgccaccctctcctgcagggccagtcagagtgttagcagcaacttagcctggtaccagcaagaaagttggccaggcctccgaggctcctcatcgtttggtcgtcgtccacgtacggggccgtcgtggtcgtccccgagtccgtaggttcaaggttgggctaggtggcctcgtaggggactaggtacgttcaccgtctccaaccgtatacgtacgcacgccgtgcctagtctaggtaacgttagttttcgacgttagttttattacttgtactagtactaaacttaataaacgttaagtacgttacggtccttacggtacggttcggtactttacggttttacggaccggttaacggggaacctaaggtacgttaggaacgtacgtaacgtaaacgg

SEQ ID NO: 242592 - DNA, 804 bp, Homo sapiens
  misc_feature: GYAE6OF02GTHOS.35.85.H08.1.454.CMB.1.raw
tcagtacagatcgtcacgaccggtgctcgatttagtatcactcagtcgcgggggaggaactgctcagttaggacccagacggaaccatggaagccccagagcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttcggccaggctcccaggcctcctcattcgtttggtgtcgtccacgtacggggcccgtcgttgggtcgtccccgaaggttccgtaagggtttccgaagggttcggggaccgtaagggtttcgggtccgttaccggttgggggtaaccgtaaggtacgggttttaccaacccgtttccgttacccaacccgtaacgttaccgaacggtaccgtaaccggtcccgtacggtacccgtaacggttaccgttaacgggtaaaacggtttaacgtttttacggtaccgtttaaacggtttttaacgttttaaccgttacggtttaaccgtaacggttaaccgtaaaagtttaaacgtttaaagttaacggtaccgttaccgggtaccccgttaccggtaacggtttacgtacccgtttaccgttttttaccggggacccggttaaacgggggtaacccgtaacgggtaccgttaacgggtaacggtaaccgttaaccggtaaaaccggttaaccgttacgggttaccgggtaccgttaaccggg

SEQ ID NO: 242593 - DNA, 570 bp, Homo sapiens
  misc_feature: GYAE6OF02HJXXR.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatcctttggtgtgtccactagggccgctggtcgtcccagtcaggttcagtcggcaggtggctcgtgggacagagttcactctcaccatcagcagcctgcagtctgaagtatttcgctagtttacttacttgtacagtactaattaataattacgacgttcggtacccttacgtaacgtttcgtacgttaccgtttttcgggacccggtaagggggtaaccctaaggtccgttagggtaacgtacgttaaccggtaaacgtaacgttaggtacgggtacgtaccgg

SEQ ID NO: 242594 - DNA, 495 bp, Homo sapiens
  misc_feature: GYAE6OF02GARSF.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctcgtgggacagagttcactctcaccatcagcagcctgcagtctgaagtatttgctagtttattactgtcagcaatataatagctgcctcgagttgctacgtttggccgtaaggggaccaaggcgtaggagatacaaacgactggtggctacg

SEQ ID NO: 242595 - DNA, 492 bp, Homo sapiens
  misc_feature: GYAE6OF02GAUJU.35.85.H08.1.454.CMB.1.raw
  modified_base (489)..(489): a, c, t, g, unknown or other
  misc_feature (489)..(489): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccagtctcctcatctttggtgtgtccactaggggccgctggtgtcccagtcaggttcagtggcagtggctcgtgggacagagttcactctcaccatcagcagcctgcagtctgaagtattttgctagtttattactgtcagctaatataatagctgcctcgtagttgctactttggccgagggaccaggctaggagatacgaaagactggtgntcg

SEQ ID NO: 242596 - DNA, 518 bp, Homo sapiens
  misc_feature: GYAE6OF02HZGPA.35.85.H08.1.454.CMB.1.raw
  modified_base (291)..(291): a, c, t, g, unknown or other
  misc_feature (291)..(291): n is a, c, g, or t
  modified_base (514)..(514): a, c, t, g, unknown or other
  misc_feature (514)..(514): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagtggcaggctccaggctctcatctttggngtgtccacgtagggccgcgtggtcgtccccagtctaggttcagtggcaggtggctcgtgggacagtagttcactctcaccatcagcacgcctgctagtctgtaagtatttgcttagtttattactgtcagactaataataatagtcgtcggtcctacgtagttgtctacgtttcggaccgtagggacctaaggcgtaggagactacgaaacgacgtagtcggntacg

SEQ ID NO: 242597 - DNA, 525 bp, Homo sapiens
  misc_feature: GYAE6OF02HJCXB.35.85.H08.1.454.CMB.1.raw
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
tcagtacagatcgtcacgaccggtgctcgatttagtatcactcagtcgcggggaggaactgctccagttaggacccagacggaaccatggaagccccagcgcagcttctcttcctcctgctattctggctcccagatatcactggagtaaatagtgatgtaacgcagtctccaaccactctgtctgtgtctccaggggacagagccaccctctcctggccagggccagtcagagtgttagcagcaacttagcctggtaccagcaagaaagttgccaggctcccaggcctcctcattcttggtgtcgtccactagggccncgtggtgtcccagtcaggttcagtgcagtgctgtgggacagngttcactctcacatcagcagcctgcagtctagaagtatttgactagtttattactgtcagctaatataatagtctcggcctacgtagttcgacttacgttttggacccgtaaggggtaccaaggtcgtaggagtactacgaaacgtacgtcggtggacgtacgg

SEQ ID NO: 242598 - DNA, 603 bp, Homo sapiens
  misc_feature: GYAE6OF02HNDJ8.35.85.H08.1.454.CMB.1.raw
  modified_base (148)..(148): a, c, t, g, unknown or other
  misc_feature (148)..(148): n is a, c, g, or t
  modified_base (172)..(172): a, c, t, g, unknown or other
  misc_feature (172)..(172): n is a, c, g, or t
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (256)..(257): a, c, t, g, unknown or other
  misc_feature (256)..(257): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (375)..(375): a, c, t, g, unknown or other
  misc_feature (375)..(375): n is a, c, g, or t
tcagtacagatcgtcacgaccggtgctcgatttagtatcactcagtcggtcgggggaggaactgctcagttaggacccagacggaaccatggaagccccagcgcagcttctctcctcctgctattctggcctccagatatcactgganaatgtgatgacgcagtctccaacnctcgtagtctgtgtctccgagggcagcgccacctntccagcacggccaggtcagagtgtacnctagctaacttgcctggtaccnncaagaagtcgcagcctccaggtcctcncattcgttgntcgtccgacgtaggcctgtggtcgcccagtctggttcaggtcgctagtcgctcgcggtacagtacgtcacgtctaccgacngtcagtcacgtcctagctacggttctaagacgttatttcgacttaaggtttttacaacgtcgttacagtactaattactaaacgtggtcccgttaggccccgtttacggaacgtttcgaccgtttaccggttttgggaaccccggtaaggggtaccctaaaggtccgtaacggggtaactaccgttaacccggaaacgtaaccgggttgttaccgggaccttaccggg

SEQ ID NO: 242599 - DNA, 508 bp, Homo sapiens
  misc_feature: GYAE6OF02GIRC6.35.85.H08.1.454.CMB.1.raw
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcattggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtntgtccacgtagggccnctggtgtcccagtcaggttcagtggcagtggctctgggacagagttcactctcaccatcagcagcctgcagtctgaagtatttgctagtttattactgtcagtcaatataatagtctgcctcgagttcgcgtacgttttcggccgtacgggtacctaaggtcgtaggtagacgtacgaaacgaacgtgtaggctcg

SEQ ID NO: 242600 - DNA, 531 bp, Homo sapiens
  misc_feature: GYAE6OF02HD72O.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtgtccacgtagggccgctggtgtcccagtcaggttcagtgcagtggctcgtgggacagagttcactctcaccatcagcacgcctgcagtctagaagtatttgctagttttattacttgtctagactaatataaatagtcttcggccttaccggtagtttcgtctacgttttggacccgtaaggggtaacctaagtcgtaggagactacgaaaccgtaacgtcggtaggctcgg

SEQ ID NO: 242601 - DNA, 671 bp, Homo sapiens
  misc_feature: GYAE6OF02JZT7Y.35.85.H08.1.454.CMB.1.raw
  modified_base (307)..(307): a, c, t, g, unknown or other
  misc_feature (307)..(307): n is a, c, g, or t
  modified_base (427)..(427): a, c, t, g, unknown or other
  misc_feature (427)..(427): n is a, c, g, or t
tcagtacagatcgtcacgaccggtgctcgatttagtatcactcagtcgcgggggaggaacgtgctcagttaggaccagacggaaccatggaagccccagcgcagcttctcttcctcctgctattctggctcccagatatcactggagaaatagtgatgacgcagtctccaaccactctgtctgtgtctaccgaggggacaggacgccacccgtctcctgcacgggccagtcagacgtgttagcaagctaacttagcctggtaccagctaaggaaagttcggaccagggcctaccccgaggcctcccnctagttccgtttggtgtcggttcccaacgtaccgggccgtcgtgggtcgtcccctaggtccgtaggttccaggtcggctacggtgggcctcggtgggacaggtacgttcacgtctcactntcgagtcacgctgctacgtctagaagtatttcggtacttagtttacgtttacgtgttaccgtaagtaccgttaaatttagtaaacgttaacgtcgttacggtacccgttaccggttaacggtttacgaccgtttaccgtttacgggtacccggtaacgggggtaaacccaagggttaccgttacgggacggttaactaaccggtaaaaccggttaaccgttagggtaccggtaccgttaacggg

SEQ ID NO: 242602 - DNA, 518 bp, Homo sapiens
  misc_feature: GYAE6OF02FISD1.35.85.H08.1.454.CMB.1.raw
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccacgtagggccnctggtcgtcccagtcaggttcagtggcagtggctcgtgggacaggtacgttcacttctcaccatcagcagcctgcagtctagaagtatttgcttagtttattactgtcagtcaatataatagtctgcctcgtagttcgcttacgtttcggaccgtacggggaccaaggtcgtaggagacgtacgaaacgtacgtggtaggctacg

SEQ ID NO: 242603 - DNA, 516 bp, Homo sapiens
  misc_feature: GYAE6OF02FPJ1C.35.85.H08.1.454.CMB.1.raw
  modified_base (297)..(297): a, c, t, g, unknown or other
  misc_feature (297)..(297): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtntgtccactagggccgctggtgtccccagtcaggttcagtggcagtggctctgggacagagttcactctcaccatcagcagcctgcagtctgaagtattttgctagttttattacttgtcagcaatataatagctggcctccgagttcgcttacgttttggcccgtaaggggtacccaaggtcctagggagactacgaaacgtacgtggtacggctacgg

SEQ ID NO: 242604 - DNA, 538 bp, Homo sapiens
  misc_feature: GYAE6OF02FYTJ5.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagactattagtaccaacttagcctggtatcagcagaaacctggtcaggctcccaggctcctcatctatggtgcatccaccagggccacgtggtatcccagcccaggttcaggtggctaggtgggtctgggacaggagttcactctcaccatcagcagcctgcagtctgatgtattttgctagtttattactgtcagctattagtgattaacgtggtacctccgtaggtaccgttcggaccgaacggggtaacctaagggtacggaaacgtaccgaaacggtaacgtcggtacggtacgtcgaccgtacctacg

SEQ ID NO: 242605 - DNA, 584 bp, Homo sapiens
  misc_feature: GYAE6OF02GFNA1.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtgtccacgtacggggccgcgtgggtcgtccccgagtccgaggtttcaggtcggcaggtggctcgtggggacaggtagttccactctcaccatcagcacgcctgcagtcgtagaagtagttttgcttagtttattactgtactagtactaaattaataagtagtacgttacggtcccttacggtacgttcgtcgttacgttttcgggccggtaacggggtaacccgtaacggtcgtacggtaacggtacgtaaccgtaaaaccggtaacgtacggttacggtctacgg

SEQ ID NO: 242606 - DNA, 540 bp, Homo sapiens
  misc_feature: GYAE6OF02I7XDI.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacttagggccgctggtcgtcccagtccaggttcaggtggcagtggctcgtgggacagagttcactctcacactcagcagcctgcagtctgaagtatttgctagtttattactgtcacgacgtaacttataatagtacgttcggcctcccgtagttcgtcttacgttttcggaccgtaacggggtaccaaggtacgtaggtagacgttaccgaaaccgttaacgtggttaggactacgg

SEQ ID NO: 242607 - DNA, 556 bp, Homo sapiens
  misc_feature: GYAE6OF02F49LU.35.85.H08.1.454.CMB.1.raw
  modified_base (356)..(356): a, c, t, g, unknown or other
  misc_feature (356)..(356): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctcccaggctcctcatctttggtgtgtccacgtgggccgcgtggtcgtcccagtcaggttcagtggcagtggctcgtgggacngtagttcactctcaccatcagcagcctgcagtctgaagtatttgacttagttttacttacgtgtacagtactaattaataagtagtacgttacggtccgtcgtagttcgtacttacgttttcggaccggtacggggaacctaacggtaccgttagggaacgtacgtaccgaaaccgtaacgtcggtacggtacgtaccgg

SEQ ID NO: 242608 - DNA, 848 bp, Homo sapiens
  misc_feature: GYAE6OF02GOIF5.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcaagtaaagttcggccaggcctcccgaggcctcctcattcgtttgggtgtcgtaccgacgtacggggcccgtcgttgggttccgtccccgtaggttccgtaaggggtttccaagggttcgggactagggttcgggtccttcggtaggggactaagggtacgtttccaccgttccgtaccgaaccctacgttaccaacggtaccaaccgggtcccgttacggaccgtaacggtttaccgttaagggttaaacggtttacggttttttaacggtaccgttttaaaggtttttttaaaccgttttaaccgtttacggtttaacccgttaaacgggttaacctaaaaaggttttaaactttaaaacggtttacggttacccgtttaccggggttacccccgtttaaccgggtttaacgttttaccgggtacccgttttaccggttttttacccggggaacccgggttaaaccggggggtaaacccgttaaacggggttaccggttaacgggggtaaacgttaaccggttaacccggtaaaaaacccgggtttaaccggtttacggggttaaccgggtacccggtttaacccggg

SEQ ID NO: 242609 - DNA, 528 bp, Homo sapiens
  misc_feature: GYAE6OF02HCU8P.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcatctttggtgtgtccacgtagggccgctggtcgtccccagtcaggttcagtggcagtggctcgtgggacagagttcactctcaccatcagcagcctgcagtctagaagtattttgctagtttattactgtcagactaatataatagtcttcggcctacggtagttcgcttacgttttggacccgtaaggggacctaaggtccgtaggtagtacgtacgaaaccgaacgtaggtggtctcgg

SEQ ID NO: 242610 - DNA, 526 bp, Homo sapiens
  misc_feature: GYAE6OF02I4LYM.35.85.H08.1.454.CMB.1.raw
  modified_base (315)..(315): a, c, t, g, unknown or other
  misc_feature (315)..(315): n is a, c, g, or t
  modified_base (345)..(345): a, c, t, g, unknown or other
  misc_feature (345)..(345): n is a, c, g, or t
  modified_base (376)..(376): a, c, t, g, unknown or other
  misc_feature (376)..(376): n is a, c, g, or t
  modified_base (388)..(388): a, c, t, g, unknown or other
  misc_feature (388)..(388): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaactagcctggtaccagcagaaagttggccaggctcccaggcctccctcatctttggtgtcgtccactagggccnctggtcgtcccaggtcaggttcaggtggcngtgctcgtgggacagtgttcacgtctcaccntcagcacgcctncgagtctagaagtatttgcttaagtttacttactgtcacgactaatatatagtcgtgtccgtcgagttcgtacgtacgtttcggccgtacgggactaagcgtagacgtaactacgaaacgacggtacgtaggctacgg

SEQ ID NO: 242611 - DNA, 554 bp, Homo sapiens
  misc_feature: GYAE6OF02FV3QS.35.85.H08.1.454.CMB.1.raw
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
  modified_base (548)..(548): a, c, t, g, unknown or other
  misc_feature (548)..(548): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctcccaggctcctcatctttggngtcgtccacgtagggccnctggtcgtcccagtcgaggttcaggtggcagtggctcgtgggacagtagttcactctcaccatcagcagcctgctagtctagaagttagttttcgacttagtttattacgtgtacacgtactaattataagtacgtcgttcggcccttacggtagttacgtcgttacgttttcgggaccgtaacggggaacctaaggtcgttaggagtactaccgaaacgtacggtgtacggntaccgg

SEQ ID NO: 242612 - DNA, 527 bp, Homo sapiens
  misc_feature: GYAE6OF02IRUFD.35.85.H08.1.454.CMB.1.raw
  modified_base (522)..(522): a, c, t, g, unknown or other
  misc_feature (522)..(522): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatcgtttggtgtgtccacgtagggccgtctggtcgtcccagtcaggttcagtgcagtggctcgtgggacagagttcactctcaccatcagcagcctgcagtctagaagtatttagactagtttattactgtctagactaattataatagtctcggtcctcgtagttcgtctacgttttcggaccggtaggggtaccaggtcgtaggacgtacgtacgaaaccgtaacgtaggtcggntacgg

SEQ ID NO: 242613 - DNA, 707 bp, Homo sapiens
  misc_feature: GYAE6OF02J1LL3.35.85.H08.1.454.CMB.1.raw
  modified_base (232)..(232): a, c, t, g, unknown or other
  misc_feature (232)..(232): n is a, c, g, or t
tcagtacagatcgtcacgaccggtgctcgatttagtatcactcagtcgcggggaggaacgtgctcagttaggacccagacggaaccatggaagcccagcgcagcttctcttcctcctgctattctggctccagatatcactggagaaatagtgatgacgcagtctccaaccactctgtctgtgtctaccaggggacaggagccacctctcctgccagggccagtcagacgtnttagcagctaactacgtcctcgtacgtacgcgagaacggttacggacgttttacggaccgtacccgacggaccgtcccgtccgtactcgtttcgttcggttcgtccgtacgtacgggtccgtccgtcggtcggtccgtacgtccgtacggttcgtacggtcggtcgtacggtcggtcgtcgtcgggtacgtacggtacgttacgtacgtcgtccgtacctactacgtacgtacgtaacgccgtcgtacgtacgtacgtcgtaacggtagtttacgtacgttacgtttacgttaacgtttcgttacgtagtaccgtaataacttaaagtaacgtacgttacggtaccgttacggtacgtttacgtacgttacgtttacggttacccggtaacgggtaaccggtaacggtaccggttaacggtaacggtaacggttaccggtaaaccgttaacggtacggttacggtacgttaacgg

SEQ ID NO: 242614 - DNA, 507 bp, Homo sapiens
  misc_feature: GYAE6OF02GBJL2.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccacgtaggggccgctggtcgtcccagtcaggttcagtggcagtgctgtgggacagtagtcactctcaccatcagcagcctgcagtctagaagtatttgctagtttattactgtcagtctaatataatagtctgtcctcgtagttcgtctacgtttcggccgtagggaccgacggtcgtaggagtagtacgtaaacg

SEQ ID NO: 242615 - DNA, 521 bp, Homo sapiens
  misc_feature: GYAE6OF02I3VBA.35.85.H08.1.454.CMB.1.raw
  modified_base (317)..(317): a, c, t, g, unknown or other
  misc_feature (317)..(317): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggaccaggctcccaggctcctcattcgtttggtgtcgtccactagggccnctggtctcccagtcaggttcagtggcagtggctgtgggacagtagtcactctcaccatcagcacgcctgcagtctgaagtatttgacttagtttacttactgtctagactaatataatagcgtcgtcctcgtagttcgtctacgtttcggaccgtaagggaccaaggtcgtaggagtactacgaaacgtacgtggtcggctacg

SEQ ID NO: 242616 - DNA, 558 bp, Homo sapiens
  misc_feature: GYAE6OF02H9CR8.35.85.H08.1.454.CMB.1.raw
  modified_base (210)..(210): a, c, t, g, unknown or other
  misc_feature (210)..(210): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctntcctgcagggccagtcagagtgtagcagcaacttgcctggtaccagcaagaaagttggccaggctcccaggcctcctcattcgtttggtgtcgtccacgtagggccgcgtggtcgtcccagtcaggttcagtgcagtggctcgtgggacagagttcactctcacatcagcacgctgcagtctagtaagtattttgtactagtttattactgtacagactaatataagtagtcgtacggtcctaccgtagttgtacttacgttttacggaccggtaacggggtaaccgaaggtacgtaggaaggtacgttaaccgaaaaccggtaacgtacggttacgggtacgtacgg

SEQ ID NO: 242617 - DNA, 529 bp, Homo sapiens
  misc_feature: GYAE6OF02H7IBA.35.85.H08.1.454.CMB.1.raw
tcagtacagatcgtcacgaccggtgctcgatttagtatcactcagtcgcgggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggcaggctcccaggcctcctcatctttggtgtgtccacgtagggccgctggtcgtcccagtcaggttcaggtggcaggtgctcgtgggacagtagtcactctcacatcagcagcctgcagtctagaagtagttttgcttagtttattacgtgtacgagtactaattataatacgtctcggtccttcgtagttcgtccttacgtttcggaccgtacggggacctaaggtcgtaggagtacgtacgtaaacgg

SEQ ID NO: 242618 - DNA, 589 bp, Homo sapiens
  misc_feature: GYAE6OF02G9GYP.35.85.H08.1.454.CMB.1.raw
  modified_base (411)..(411): a, c, t, g, unknown or other
  misc_feature (411)..(411): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctccaggctcctcatcgtttggtgtcgtccacgtacgggccgcgtggtcgtccccaggtccgaggttcaggtcggcaggtggctcgtgggacagtagttcactctcaccatcagcagcctgctagtctagtaagttntttgacttagtttattacgtgtacagtacgtaaacttataaagttcgtacgttacggtacccgttacggtagtttcgaccgtttaccgttttcggggacccgtaacgggggtaaccctaagggtcgttacgggaacgtaacgtaaccgtaaaacggtaccgttggtaccggactacgg

SEQ ID NO: 242619 - DNA, 581 bp, Homo sapiens
  misc_feature: GYAE6OF02I30GI.35.85.H08.1.454.CMB.1.raw
  modified_base (359)..(359): a, c, t, g, unknown or other
  misc_feature (359)..(359): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccaccctctcctgcagggccagtcagagtgttagcagacaacttagcctggtaccagcaagaaacgttggaccaggcctccgaggtcctcctcacttcgtttggcgtcgtccacgttacggggcctcgtggtcgtcccagttcgaggttcagtggcnggtcggcttcgtagggactagtcgtctactcgtcaaccatcagctcggctcgcagtcacgaagttctttgacttagtttactcgtgtacagaaccttaatataacgtaatcgtcggtaccctggaacgttggtaccttcgtttacgggacccgtaaggggaaccctagggtcgttacggaacgttaactaccggaaaacgtacgtttagggacgtcgtacgg

SEQ ID NO: 242620 - DNA, 517 bp, Homo sapiens
  misc_feature: GYAE6OF02GHI50.35.85.H08.1.454.CMB.1.raw
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccacgtacggggccgctgggtcgtccccagtcaggttcagtggcagtggctcgtgggacagtagttcactctcacatcagcagcctgcagtctgaagtntttgctagtttattactntacagacaatataatacgctggcctcgagttcgcttacgtttggacccgtaaggggtaccaaggtcgtaggagtactacgaaacgtaacgtggtcggctcg

SEQ ID NO: 242621 - DNA, 612 bp, Homo sapiens
  misc_feature: GYAE6OF02GFT99.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttagcctggtaccagcaagtaaagttcggaccaggcctcccgaggcctacctcacttcgtttggtcgttcgtcctacgtacggggccgtcgttgggtcgtccccagtcgtaggttcaggtcggactaggtcggccttcggtggggaacctaggtacgttccacttcctacacctatacagcacgtcctgcacgtctagtaagttagtttgacttagtttattacgtgtacagtactaattagtaatacgtacgttacgtcctaccgtgttcgtacgttacgttttcggaccggtaacggggtaaccgtaacggtcgttagggacgtaacgtaaccggtaaaacgtacggtacggtacggtcgtaaccgg

SEQ ID NO: 242622 - DNA, 533 bp, Homo sapiens
  misc_feature: GYAE6OF02GT16A.35.85.H08.1.454.CMB.1.raw
  modified_base (318)..(318): a, c, t, g, unknown or other
  misc_feature (318)..(318): n is a, c, g, or t
tcagtacagatcgtcacgaccggtgctcgatttagtatcactcagtcgcgggggaggaactgctcagttaggacccagacggaaccatggaagccccagcccagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccacgtagggccgctggtntcccagtcaggttcagtggcagtggctcgtgggacagagttcactctcaccatcagcacgcctgctagtctagaagtatttgacttagttttattactgtcagtactaatataatagcttcggaccttccgtagttcgcttacgtttcggaccgtacggggaacctaaggtcgtaggagtacgtacgaaacggtacgtggtacggtcgtgtaccg

SEQ ID NO: 242623 - DNA, 649 bp, Homo sapiens
  misc_feature: GYAE6OF02JXJ27.35.85.H08.1.454.CMB.1.raw
  modified_base (282)..(282): a, c, t, g, unknown or other
  misc_feature (282)..(282): n is a, c, g, or t
tcagtacagatcgtcacgaccggtgctcgatttagtatcactcagtcgcgggaggagcgtctggggaggaacgtggctcagttaggacccagacggaaccgatggaagcccagcgcagcttctcttcctcctcgctacttctggctcccagatatcactggagaaatagtgatgacgcagtctaccaaccactctgtctgtgtctcgaggggacaggagccacccgtctcctgccagggccaggtcacgagttgttacgacagcaacttagccgtcggtacngcaggaagttgcctaggctcccgaggctcctcattcgtttggtgtcgtccctaacgtcggggcccgtcgtgggtcgttccccgaagtcgtaggtttccgagtcgggactagggtcggcttcggaggggtaccaggtacgtcgtacgtccgtacctaccgacttacgaacgccgtacggtcccgttaaggccgtaccggttacgtaccggtaagttaacgtttttcggaccgtttaggtttactttacgtcgtacggtatacgttaacttaggtaataacgcgttacgtccgttcgtacggtgtaccttacgtttcggtacggtacgggttactaacgggtccgttgggacgttacgtacgtaaacgg

SEQ ID NO: 242624 - DNA, 565 bp, Homo sapiens
  misc_feature: GYAE6OF02I09L8.35.85.H08.1.454.CMB.1.raw
  modified_base (327)..(327): a, c, t, g, unknown or other
  misc_feature (327)..(327): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagccaagaaagttggcccagggcctcccgaggtcctcctcattcgtttggtgtcgtccacgtacgggccgntggtcgtcccagtcgaggttcaggtgcagtggctcgtgggacagtagttcactctcacatcagcacgcctgctagtctagaagtatttgcgtagttgtattacgtgtacagtctagtagttggttacgttaccgtaaccgttacttacgtttcggaccgtacggggacctaacgggtcgttagggaagtaacgtaaccgaaacgtaacgttcggtacggacgtacgacctaccgtacg

SEQ ID NO: 242625 - DNA, 679 bp, Homo sapiens
  misc_feature: GYAE6OF02JSB5Z.35.85.H08.1.454.CMB.1.raw
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggcctaggcctccaggcctccctnatctttggngtgtcccataggggcccnttgggnttccccaggtcagggtttccagtcggcaggtggctcgtggggactaggagtttccgattcctacgaccctacgtacgagtccgaacgtcccgtacgcctaacggttcctacggtaaagtacgtttttcggtaccgttacggttttaactttaaccgttcggttacgtacggtaccttaaagttaacgttaaacgttaacggtacgttacgggttacccgttaccggttaacgtttcggtaccgttacgtttttacgggacccgttaacggggtaacccgtaaacggttaccgttaagggtaaccggtaacgttaaccggaaaccggtaaccgttacgggttacggaccggttaaccgg

SEQ ID NO: 242626 - DNA, 548 bp, Homo sapiens
  misc_feature: GYAE6OF02H4E2F.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggccaggctccaggctcctcattctttggtgtgtccacgtaggggcctcgtggtcgtccccagtcaggtttcaggtggcagtggctcgtgggacagagttcactctacaccatcagcagcctgcagtctgaagtatttgctagtttatttactgtacagtactaataataatagtacttcggcctccggtagttcgtacgtaccgttttcggaccggtaacggggtaacccaaggtcgtagggaacgtacgtaccgtaaaccgtaacgtcggtacggtctacg

SEQ ID NO: 242627 - DNA, 494 bp, Homo sapiens
  misc_feature: GYAE6OF02FZVBA.35.85.H08.1.454.CMB.1.raw
  modified_base (297)..(297): a, c, t, g, unknown or other
  misc_feature (297)..(297): n is a, c, g, or t
  modified_base (491)..(491): a, c, t, g, unknown or other
  misc_feature (491)..(491): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtntgtccactagggccgctggtgtcccagtcaggttcagtggcagtggctcgtgggacagagttcactctcaccatcagcacgcctgcagtctgaagtattttgctagtttattactgtcagcaatataatagctcgcctcgtagttgctacgtttggccgagggaccaagcgtggagatacaaacgactggtggntcg

SEQ ID NO: 242628 - DNA, 564 bp, Homo sapiens
  misc_feature: GYAE6OF02GETTQ.35.85.H08.1.454.CMB.1.raw
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatattgatgacgcagtctccaaccactctgtctgtgtctccaggggacagagccaccctctcctgcagggccagtcagagtgttagcagcaacttagcctggtaccagcagaaagtggccaggctccaggctcncatcttggntgtccacgtagggccgntggtcgtccagtcaggttcagtggcagtggctcgtgggacaggagttcactctacaccatcagcagcctgcagtctagaagtatttgacttagtttacttacttgtacagtactaattataaagttacgcgttcggtccctacggtacgtttgtaccgttacgttttacgggacccgtaagggggtaaccctaagggtccgttagggaacgtacgttaaccggtaaaaccgtaacgtagggttacggccttacggg

SEQ ID NO: 242629 - DNA, 551 bp, Homo sapiens
  misc_feature: GYAE6OF02IY7I9.35.85.H08.1.454.CMB.1.raw
  modified_base (314)..(314): a, c, t, g, unknown or other
  misc_feature (314)..(314): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtcgtccacgtagggccncgtggtgtccccagtcaggttcagtggcagtggctcgtgggacagtagttcacgtctccacatcagcagcctgcacgtctagtaagtattttgcttagtttattacttgtacagtactaattataagtagtcgttcggtcctcgtagttcgtccgttacgttttcggaccggtacggggtaccgtaacggtcgtacggaagtacgtacgtaaacgtaacgttcggtacggtctacgg

SEQ ID NO: 242630 - DNA, 504 bp, Homo sapiens
  misc_feature: GYAE6OF02FTW1K.35.85.H08.1.454.CMB.1.raw
  modified_base (296)..(296): a, c, t, g, unknown or other
  misc_feature (296)..(296): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccactaggggccgcttggtcgtcccagtcaggttcagtggcagtggctcgtgggacagagttcactctcaccatcagcagcctgcagtctagaagtatttgctagtttattactgtcagcaatataatagctgcctcgagttgctacgtttggccgtaagggaccaaggctaggagtagtaccaaacggaactggtaggctacg

SEQ ID NO: 242631 - DNA, 535 bp, Homo sapiens
  misc_feature: GYAE6OF02IGWQL.35.85.H08.1.454.CMB.1.raw
  modified_base (287)..(287): a, c, t, g, unknown or other
  misc_feature (287)..(287): n is a, c, g, or t
  modified_base (314)..(314): a, c, t, g, unknown or other
  misc_feature (314)..(314): n is a, c, g, or t
tcagtacagatcgtcacgaccggtgctcgatttagtatcactcagtcgcgggggaggaactgatcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagctccccggtacagcagaaagttggccaggctccaggctccncatctttggtgtgtccactaggggccnctggtcgtcccagttcaggttcagtggcagtggctcgtgggacaggagttcactctcaccatcagcacgcctgcagtctagaagtatttgcttagtttattacttgtacagtactaattaataaattagtactcggtcctcggtagttgacctacgttttacggccgtacggggtaaccaaggtcgtaggagtactacgtaaacgaactggtacggctacg

SEQ ID NO: 242632 - DNA, 571 bp, Homo sapiens
  misc_feature: GYAE6OF02HJWL4.35.85.H08.1.454.CMB.1.raw
  modified_base (211)..(211): a, c, t, g, unknown or other
  misc_feature (211)..(211): n is a, c, g, or t
  modified_base (232)..(233): a, c, t, g, unknown or other
  misc_feature (232)..(233): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (331)..(331): a, c, t, g, unknown or other
  misc_feature (331)..(331): n is a, c, g, or t
  modified_base (361)..(361): a, c, t, g, unknown or other
  misc_feature (361)..(361): n is a, c, g, or t
tcagtacagatcgtcacgaccggtgctcgatttagtatcactcagtcgcggggaggaacgtggctcagttaggacccagacggaaccatggaagcccagcgcagctctctcctcctgctattctgctccagatatcactggagaaatagtagatgacgcagtctaccaaccactctgtctgtgtctccgagggacagacgccacctctccngcagggccagtcagagtgtannagcaatgctgaccagcagaacgtgcagctccagctcnatctttgngtgtccacgttagggccgtcgtcggtgtaccccagtccgtaggttcaggttgnacggtggctcgtagggactagagttcactntacccgacatcgagcacgacctgacctagtactacgaagttagtttcgacttaaggtttaattacgttgtaacgtaagtacctaaagttaactaaataagtacgtacgccttaacgaagtagtagtaccttaggttttcggacggtaacgggaccgtaaaggtcgtacggaagtaaccgtacgtaaaaccggagttaccggggtaaccgg

SEQ ID NO: 242633 - DNA, 550 bp, Homo sapiens
  misc_feature: GYAE6OF02HAGXH.35.85.H08.1.454.CMB.1.raw
  modified_base (286)..(286): a, c, t, g, unknown or other
  misc_feature (286)..(286): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctccaggctccncatctttggtgtcgtccacgtagggccgcttggtcgtccccagtcgaggttcagtggcaggtggctcgtgggacaggtagttcactctacaccatcagcagcctgcagtctagaagtatttgacttagtttattactgtacagtactaaattaataatagtcgttacgtcctacgtagttcgtacttacgttttcggaccggtaacggggtaacctaacggtcgtaggagtacgtacgaaacgtaacgtaggtacggactacgg

SEQ ID NO: 242634 - DNA, 615 bp, Homo sapiens
  misc_feature: GYAE6OF02IVPHQ.35.85.H08.1.454.CMB.1.raw
  modified_base (257)..(257): a, c, t, g, unknown or other
  misc_feature (257)..(257): n is a, c, g, or t
  modified_base (333)..(333): a, c, t, g, unknown or other
  misc_feature (333)..(333): n is a, c, g, or t
  modified_base (607)..(607): a, c, t, g, unknown or other
  misc_feature (607)..(607): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaaccngcaagaaagttggccaggcctccgaggcctcctcattccgtttggtgtcgtccgacgttacgggccgcgtgggtcnccccgaggttcaggttcaggtggcctaggtggtctcggtagggacaggtagttcaacgtcctacacctactacacgcacgccgtcgcacgtctagaagttacgtttgacgttagtttacttacgtgtacgagtactaaattaagttaataacggtcgttacggtccgttaccggtacgttcgtacgttaccgttttcgggaccggtaacggggtaacccgtaaggtcgttaggtaacgtaacgtaaccggaaaccgtacggtacggtccgggtntaacccgg

SEQ ID NO: 242635 - DNA, 542 bp, Homo sapiens
  misc_feature: GYAE6OF02GSYOZ.35.85.H08.1.454.CMB.1.raw
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (311)..(311): a, c, t, g, unknown or other
  misc_feature (311)..(311): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctccaggctcctnatctttggntgtccatacgggccnctggtcgtcccagtcaggttcaggtgctagtggctgtgggacagtagttcactctcaccatcagcagcctgcagtctagtaagtatttgcttagtttattactgtcagtctaataataagtagcgttcgtcctcgtagttcgtccgttacgttttcggaccgtaacggggtacctaacggtcgtacgggtagtaacgtacgtaaaacggtacgttaggttacggactacgg

SEQ ID NO: 242636 - DNA, 546 bp, Homo sapiens
  misc_feature: GYAE6OF02HRPQ5.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgccagggccagtcagagtgttagcagcaacttagcctggtaccagcagaagttggcaggctcccaggctcctcactcgtttggtgtcgtccacgtacggggccgcgttgggtcgtccccgagtccaggttcaggtggcaggtggctcgtggggacagtagttcactctcaccatcagcagcctgcagtctaggaagtattttgctagttttattactgtactagtactaaattataatagcttcggccttacgagttgtccttacgttttggacccgtaggggtacccaaggtcgtaggacgtactacgaaacgtacgtaggttggcctacgg

SEQ ID NO: 242637 - DNA, 514 bp, Homo sapiens
  misc_feature: GYAE6OF02IUDQO.35.85.H08.1.454.CMB.1.raw
  modified_base (419)..(419): a, c, t, g, unknown or other
  misc_feature (419)..(419): n is a, c, g, or t
  modified_base (510)..(510): a, c, t, g, unknown or other
  misc_feature (510)..(510): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctccctcattcgtttggtgtcgtccacgtaggggccgtcgtggtcgtcccagtcaggttcagtggcagtgctcgtgggacagagttcactctcacatcagcacgcctgcagtctgaagtatttgctagtttattactntcagactaatataatagctgtcctcgagttcgtctacgtttggaccgtagggaccagtcgtaggagtacgtacgaaacgtacgtggtacgntacg

SEQ ID NO: 242638 - DNA, 561 bp, Homo sapiens
  misc_feature: GYAE6OF02JEUIC.35.85.H08.1.454.CMB.1.raw
  modified_base (415)..(415): a, c, t, g, unknown or other
  misc_feature (415)..(415): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggcctcccgaggcctccctcattccgtttggtgtgtccacgtacgggcccgctgggtcgtccccgaggtcaggttcaggtggcaggtggctcgtgggacagagttcactctacaccatcacgcacgcctgcacgtctagaagtntttgcttagtttattacttgtcagtactaattataatagtcgtcgtcctaccgtagttcgtcttacgttttcgggaccggtaacggggtaccgtaaggtcgttagggaacgtacgtaacgtaaaccgtacgtggtacggtctacgg

SEQ ID NO: 242639 - DNA, 632 bp, Homo sapiens
  misc_feature: GYAE6OF02GXO7O.35.85.H08.1.454.CMB.1.raw
  modified_base (316)..(316): a, c, t, g, unknown or other
  misc_feature (316)..(316): n is a, c, g, or t
  modified_base (357)..(357): a, c, t, g, unknown or other
  misc_feature (357)..(357): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgtagcagcaacttagcctggtaccagcagaaagttggccaggctcccgaggcctcctcattctttggtctgtccagtagggccncgtggtcgtcccagtcaggttcaggtcggcaggtggctcgngggtacaggtacgttcaccttctccaccattccaggcctaggtccctggtaccaggttaccgtggtaaacgttagtttttcggacctttaaggttttaacttacgttcgaccgtaaactaggttaattaacgttaacgttttaccctacgttaacgtttccgggaggtaacgggtacccgtaaagggttacgaacgtaacccgtaaaacggtaaccttgggtacgtaccgtaggtacccgtaactacgttacgtacggtttcccttacttaaccg

SEQ ID NO: 242640 - DNA, 554 bp, Homo sapiens
  misc_feature: GYAE6OF02HXPJV.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttgcctggtaccagcaagaagtggaccaggctcccgaggcctccctcattctttggtgtcgtccacgtggggccgtcgttggtcgtcccaggtctaggttcaggtggcagtcggctcgtgggacaggtacgttcacgtctacactatcagcacgcctgcagtctagaagttatttgacttagtttactacttgtactagtactaattagtaactagtcgttcgtccgtcgtagttcgcttacgtttcggaccgtaacgggtaccacggtcgtaggacgtacgtaacgaaacgtacgtacggtcggctacg

SEQ ID NO: 242641 - DNA, 518 bp, Homo sapiens
  misc_feature: GYAE6OF02G2RVJ.35.85.H08.1.454.CMB.1.raw
  modified_base (406)..(406): a, c, t, g, unknown or other
  misc_feature (406)..(406): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccgaggcctcctcattcgtttggtgtcgtccacgtagggcccgctgggtcgtccccagtcaggttcaggtggcaggtggctcgtgggacagagttcactctacaccatcagcagcctgcagtctagaagtntttgcttagtttattactgtcagactaattataagtacgtctgtcctcgtagttgcttacgtttggaccgtagggacctagcgtggagtactacgaacgtacgtgtggctcg

SEQ ID NO: 242642 - DNA, 600 bp, Homo sapiens
  misc_feature: GYAE6OF02JLNL7.35.85.H08.1.454.CMB.1.raw
  modified_base (304)..(304): a, c, t, g, unknown or other
  misc_feature (304)..(304): n is a, c, g, or t
  modified_base (458)..(458): a, c, t, g, unknown or other
  misc_feature (458)..(458): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccaccctctcctgcacgggccagtcagagtgttagcagcaacttgcctggtaccagcaagaaggttcggccaggcctaccaggcctcctcacttcgtttggtntcgtacctaacgtcggggccgtcgttcgggtccgtccccgaggtcgtacggggtttccagggtcggtacgaggttcgggcttcggtaggggaccaaggtcggtttacaccttcctaccactacgtcagcacgcctgactacgtctagaacgttntttcggacttaggtttacttagtcgtcagactaagttatagtagtctcggtcctacgtagttcgacgtttcgttacggccggtaacgggaacctaggtcgtacgggaagtacgttacgaaacggtagtcggtacgccgtacg

SEQ ID NO: 242643 - DNA, 612 bp, Homo sapiens
  misc_feature: GYAE6OF02I8Q91.35.85.H08.1.454.CMB.1.raw
  modified_base (208)..(208): a, c, t, g, unknown or other
  misc_feature (208)..(208): n is a, c, g, or t
  modified_base (306)..(306): a, c, t, g, unknown or other
  misc_feature (306)..(306): n is a, c, g, or t
  modified_base (378)..(378): a, c, t, g, unknown or other
  misc_feature (378)..(378): n is a, c, g, or t
  modified_base (433)..(433): a, c, t, g, unknown or other
  misc_feature (433)..(433): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccatctgtctgtgtctccaggggacagacgccaccctntcctgcagggccagtcagagtgttagcagcaacttgcctggtaccagcaagaacgttggccaggcctcccgaggtcctccgtacattcggttttcggngtccgttaccaacgttcgggccgcttgggtccgtcccagtcgtaggttcaggttcggcaggtcgggcttcgngggactagtagttcacgttcacgacactcacgtacacgcctgctagtctgaagtntttgtacttagtttacttacgtagtcgtagtactaaattacgtaataggtcgttacgaccgttacggtagtttacgtacgtttacgtttcgggacccggttaacgggaaccgtacggtcgttaacggggaacgtaacgtacccggttaaaaccgacgttaacggttcggtaccctacgg

SEQ ID NO: 242644 - DNA, 568 bp, Homo sapiens
  misc_feature: GYAE6OF02IE4WP.35.85.H08.1.454.CMB.1.raw
  modified_base (300)..(300): a, c, t, g, unknown or other
  misc_feature (300)..(300): n is a, c, g, or t
  modified_base (407)..(407): a, c, t, g, unknown or other
  misc_feature (407)..(407): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttgcctggtaccagcaagaaagttggcaggctcccgaggctcctcattctttgggngtcgtccacgtacgggcccgtcgtggtcgtccccaggttcaggtttccgaggtggcaggtggtaccttcggtaggggactaggtacgtttccaccttctccaacctntacagcacgcctgacgtagtctagtaagtattttgacttagtttattactgtacagactaatataatgtcgtcgtcctacggtagttcgcttacgtttcgggaccgtaacggggtaccaaggtcgtaggatacgtaacgaaacgtaccgttgtcggtgtcg

SEQ ID NO: 242645 - DNA, 741 bp, Homo sapiens
  misc_feature: GYAE6OF02HHGML.35.85.H08.1.454.CMB.1.raw
  modified_base (114)..(114): a, c, t, g, unknown or other
  misc_feature (114)..(114): n is a, c, g, or t
  modified_base (124)..(124): a, c, t, g, unknown or other
  misc_feature (124)..(124): n is a, c, g, or t
  modified_base (157)..(157): a, c, t, g, unknown or other
  misc_feature (157)..(157): n is a, c, g, or t
  modified_base (172)..(172): a, c, t, g, unknown or other
  misc_feature (172)..(172): n is a, c, g, or t
  modified_base (185)..(185): a, c, t, g, unknown or other
  misc_feature (185)..(185): n is a, c, g, or t
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
tcagtacagatcgtcacgaccggtgctcgatttagtatcactcagtcggcggggaggaactgctcagttaggacccgagacggaaccatggaagcccctagcgcagctctctcncctgctatcngctccagatatcactggactaaatgtgatgacnctagtctaccaactntctgtctgtgtcncgagggcaggacncctacctntcngccgaggcctaggtacaggagttagttacgactacggtacctaacgttacgccgttagtaccacgacgaagtaaacggttccgaccgtaacggtcctaccgaggtcctccgtacaacgttcgtttggtacgtcgttaccgacgttaacggggtccctcggttacggtccgtacccccgtagttccggtacgttaccgtaacgggtcggtaccgtaacgggcggttacccgttacggtacgggaacccgtaacggttaaccggtttccaaacccgtccgttaccccgtaacgtaacgttccgtaacggaccttaccggaccgttacggacgtaccggttcgtaacgttaagtacttttacggacttaacggtttattacgtaccgtagtaacgtactaacgttattaacgtagtaccgtacgttacccgtacgtacggttacgtccgttacgtttacgggaccggttaacggacgtaacggtacgtaaggtcgaacttaccggaaagttaccggtacgttaccgcgtaaccgg

SEQ ID NO: 242646 - DNA, 605 bp, Homo sapiens
  misc_feature: GYAE6OF02HEKIA.35.85.H08.1.454.CMB.1.raw
  modified_base (451)..(451): a, c, t, g, unknown or other
  misc_feature (451)..(451): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaacctgaccaggcctcccgaggcctccgacattcctagtggtcgccacttcccaaccgacgggccaacgtcggtacctcccgagccctaaggttcaggtcggacgtaggtgggtcgtgggactagtaccttacgactcgtccacactcagcagcctagcgtagtctagaagtattacgtgctagtttanacctacttcgtaccgtagtaccttaagttttaactacgtccgtacggtcccgtcgtaccgttccgtttaccggttccggggaccgggtaacggtaaccggtaagggttacggaagttaacgtaacgtaaaacggtacgtacggtacgtcgtacg

SEQ ID NO: 242647 - DNA, 571 bp, Homo sapiens
  misc_feature: GYAE6OF02H49TN.35.85.H08.1.454.CMB.1.raw
  modified_base (300)..(300): a, c, t, g, unknown or other
  misc_feature (300)..(300): n is a, c, g, or t
  modified_base (561)..(561): a, c, t, g, unknown or other
  misc_feature (561)..(561): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttgcctggtaccagcaagaaagttggccaggctcccgaggctccctcattcctttggnttcgtccacgtagggccgcgtggtctcccagtcaggttcagtggcaggtggctcgtgggacagtacgttcactctacaccatcacgcacgccgtgccagtctaggtaagttgttttgtacttagttttactttacgtgtactagtactaattaataaagtagtccgtcggtcccgtacggtagttcgtacttacgttttcgggaccggtaacggggacctacggtacgtaggaggtacgtaaccgtaacgaacggttcggnggtacgtacg

SEQ ID NO: 242648 - DNA, 529 bp, Homo sapiens
  misc_feature: GYAE6OF02IU779.35.85.H08.1.454.CMB.1.raw
  modified_base (287)..(287): a, c, t, g, unknown or other
  misc_feature (287)..(287): n is a, c, g, or t
  modified_base (312)..(312): a, c, t, g, unknown or other
  misc_feature (312)..(312): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggaccaggctccaggctcctnatctttggtgtctccactagggccnttggtctccccggggatcaggttcagtgcagtggctctgggacagtagttcactctcaccatcagcagctgcagtctagatacgtttgactagtttattactgtcagactaatataatagtcgtacgcctacgagttcgcttacgttttcggacgtaacggggaacctaggtcgttaggagtacgttaacgaaaccgtaacgtcggtaggactacgg

SEQ ID NO: 242649 - DNA, 543 bp, Homo sapiens
  misc_feature: GYAE6OF02IUQW0.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccactagggccgctggtcgtcccagtcaggttcagtggcaggtggctcgtgggactaggagttcactcgtcaccatcagcagcctgcagtctgaagtagtttgactagtttattactgtctagctaatataatagtcgtcgtccgttcgtagttcgtctacgttttcggacccggtaacggggaacctaacggtcgtacggtagtaacgtacgaaaccggtaacgtacggttacggtctaccgg

SEQ ID NO: 242650 - DNA, 540 bp, Homo sapiens
  misc_feature: GYAE6OF02HNYL5.35.85.H08.1.454.CMB.1.raw
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
  modified_base (411)..(411): a, c, t, g, unknown or other
  misc_feature (411)..(411): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggcctcccaggctccncatcgtttggtgtgtccacgtagggccgctggtctcccagtcaggttcaggtgcgagtgctcgtgggacnggtagtcactctcacactcagcagcctgctagtcagtaagtntttgctagtttattactgtactagactaataataagtagtcgtacggtccctacggtagtttcggaccttacgtttcgggaccgtaacggggaccctaacggtccgtaggacgtacgtaacgtaaacgg

SEQ ID NO: 242651 - DNA, 554 bp, Homo sapiens
  misc_feature: GYAE6OF02JFJK7.35.85.H08.1.454.CMB.1.raw
  modified_base (422)..(422): a, c, t, g, unknown or other
  misc_feature (422)..(422): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcatctttggtcgtcgtccacgttacggggcctcgtggtcgtcccagtcaggttcaggtcggctagtcggctcgtgggacaggtagttcactcgtcaccatcagcagcctgctagtctagaagtntttgcttagtttacttacgttgtactagtactaatataaagtacgtcgttacggtcccttcggtagtttcgtaccttacggtttcggaccgtaaggggacctaaggtacgtaggacgtactacgtaaaacgg

SEQ ID NO: 242652 - DNA, 509 bp, Homo sapiens
  misc_feature: GYAE6OF02FYU76.35.85.H08.1.454.CMB.1.raw
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
  modified_base (355)..(355): a, c, t, g, unknown or other
  misc_feature (355)..(355): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccagtagggccgntggtcgtcccagtcaggttcagtggcagtggctcgtgggacngagttcactctcaccatcagcagcctgcagtctagaagtatttgctagtttattactgtcagtacaatataatagctgtcctcgtagttcgcttacgtttcggaccgtagggaccagtcgtaggagtactacgaaacgtacgtggtagcgtacg

SEQ ID NO: 242653 - DNA, 567 bp, Homo sapiens
  misc_feature: GYAE6OF02H67EY.35.85.H08.1.454.CMB.1.raw
  modified_base (294)..(294): a, c, t, g, unknown or other
  misc_feature (294)..(294): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccacctctcctgcagggccagtcagagtgttagcagcaacttagcctggtaccagcagaaagttggccaggctccaggctcctcattctttggngttcgtccacgttagggcccgcgtggtcgtccccagtcaggttccaggttggcaggttggcctcgtggggaccaggtacgttccactctaccaccatcgagccagcctgcagtctgaagttatttgtactagtttattactgtacagactaatataatagtcgttacggtcctcggtagttcgtacttacgttttcggaccgtaacggggtacctaaggccgttaggaagtactaaccgtaaaccggtaacgttacggttacggtacgtacgg

SEQ ID NO: 242654 - DNA, 514 bp, Homo sapiens
  misc_feature: GYAE6OF02GGOJP.35.85.H08.1.454.CMB.1.raw
  modified_base (310)..(310): a, c, t, g, unknown or other
  misc_feature (310)..(310): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (510)..(510): a, c, t, g, unknown or other
  misc_feature (510)..(510): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatcttggtgtgtccacgtagggccncgtggtcgtcccagtcaggttcagtgcagtggctcgtgggacnggagttcacttcncaccatcagcagcctgcagtctagaagtatttgcttagtttattactgtcagtacaatataatagtcgttgcctcgtagttcgctacgtttcggaccgtaggggaccaggtctaggagtacgtacgaaacgtacgtggtacggntacg

SEQ ID NO: 242655 - DNA, 715 bp, Homo sapiens
  misc_feature: GYAE6OF02GBY1C.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattcctggctcccaggatatcactggtacgaaatagtgatgacgcagtctccaaccactctgtctgtgtctccgaggggacagacgccaccctcgtcctcgcagggccagtcagagtgtagcagcaacttgcctggtacagcagaagttcggccagggctccccgaggcctcctcgacttcgtttgggtgtcgtccgacgtaggggccgcgttgggtctccccgaggttcgagggttcaggtcggactaggtggctcgtgggacaggtacggttccacttccgtaccaacctacttaccgacgacgaacgtcccttagacctaacggttacctaaggtaaacgttacgtttttacggaccgtttaacggtttttaacttaccgtacgttaccgtaagtaccgttaaagtttaacgttaaacgttacggtaccgtttaccgggttaacctttcccgggttaagtttcggtaaccgtttacgggtttttacggggacccggtaacgggggtaaccctaacgggtccgttacggggttaacgtaaccgttaaccggtaaaaccggttaacgttcgggttacggtaccgttaaccggg

SEQ ID NO: 242656 - DNA, 728 bp, Homo sapiens
  misc_feature: GYAE6OF02I000I.35.85.H08.1.454.CMB.1.raw
tcagtacagatcgtcacgaccggtgctcgatttagtatcactcagtcgcgggggaggaactgctcagttaggacccagacggaaccatggaagcccagcgcagcttctcttcctcctgctattctggctccagatatcactggagaaatagtgatgacgcagtctccaccactctgtctgtgtctccaggggacagagccaccctctcctgcagggccagtcagagtgttacgcagctaacttgccgtggtaccagcaagaaagttcgccgaggctcccgaggtcctccgtcacttcgtttcgggtgtaccgtcctacggtacggggtcccgcgttcgggtctaccccgaggtctaacggttcgagtcgggctaggtcgggtctcggtgggaaccaggttcgttccacgttctaccactacgtactacgcgacgccgttgaccgtacgtcgtaacggaagtttacgtttagaccgttttaaggtttaacttacgtttagtaccgacggttaaccttaaagttaacgttaaagttaaccggtccggttacggttaacccgttaccggttaacggtttacgttaccgtttaaccgttttttccggggacccgggttaaaccgggggtaaccctaacggggtttaaccgggtacgggtaaacggttaacggtaacccttaaaaccggggttaacccggtttaggggttaaccggtccgggtttaaacccgg

SEQ ID NO: 242657 - DNA, 503 bp, Homo sapiens
  misc_feature: GYAE6OF02F6QHQ.35.85.H08.1.454.CMB.1.raw
  modified_base (351)..(351): a, c, t, g, unknown or other
  misc_feature (351)..(351): n is a, c, g, or t
  modified_base (500)..(500): a, c, t, g, unknown or other
  misc_feature (500)..(500): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccacgtacggggccgctggtgtcccagtcaggttcagtggcagtggctcgngggacagagttcactctcaccatcagcagcctgcagtctagaagtatttgctagtttattactgtcagacaatataatagctcgcctccgtagttgctacgtttggccgtagggaccaagtcgtaggagagtacaaacgtactgtcggntcg

SEQ ID NO: 242658 - DNA, 496 bp, Homo sapiens
  misc_feature: GYAE6OF02FNIN8.35.85.H08.1.454.CMB.1.raw
  modified_base (492)..(492): a, c, t, g, unknown or other
  misc_feature (492)..(492): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctgggtgtcccagtcaggttcagtggcaggtggctgtgggacagagttcacttctcaccatcagcagcctgcagtctgaagtatttgctagtttattactgtcagcaatataatagctgcctcgagttgctactttggccgtaggggaccaaggcgtggagtatacgaaacgtatggtcgngtcg

SEQ ID NO: 242659 - DNA, 527 bp, Homo sapiens
  misc_feature: GYAE6OF02HKPMV.35.85.H08.1.454.CMB.1.raw
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagtggccaggctccaggctcctcatcttggntgtccacgtagggccnctggtctcccagtcaggttcagtggcagtggctgtgggacaggnttcactctcaccatcagcacgcctgctagtctagaagtattttgcttagtttattactgtcagtctaatataatagctgcctcgtagttcgtctacgtttcggccgtaacggggtacctaacggtcgttagggaacgtacgtacgaaaaccggtacgttaggtacgggtactacgg

SEQ ID NO: 242660 - DNA, 535 bp, Homo sapiens
  misc_feature: GYAE6OF02HRZ0O.35.85.H08.1.454.CMB.1.raw
  modified_base (295)..(295): a, c, t, g, unknown or other
  misc_feature (295)..(295): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcattctttggngtgtccagtagggccgctgggtcgttccaggttccaggttcaggtggcaggtcggctcgtgggactagagttcactctcaccatcagcacgcctgcagtctagtaagtagtttgactagttttattacttgtacagtactaattaataatagtcttcggtccgtcgtagttcgtcttacgtttcggccgtagggaccgaagcgtaggacgtagtacgaaacgtaacgtggtcggcgtacg

SEQ ID NO: 242661 - DNA, 572 bp, Homo sapiens
  misc_feature: GYAE6OF02HVAB6.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcaagaaagttggccaggcctcccgaggcctcctcattcgtttggtcgttcgtccacgtacgggccgcgttggtcgtccccgagtccgaggttcaggtggctaggtggctcgtgggactagtacgttcacctctcaccactcagcgtacgcctgctagtctagtaagtagtttgcttagtttattacgtgtactagtactaagtataagtacgtcgtcgtcctacgtgttcgtcgttacgtttacggaccggtacgggaacctaacggtccgtacggagtacgtacgtaaaccgtacgtacggtacggtctacgg

SEQ ID NO: 242662 - DNA, 498 bp, Homo sapiens
  misc_feature: GYAE6OF02IYYZN.35.85.H08.1.454.CMB.1.raw
  modified_base (313)..(313): a, c, t, g, unknown or other
  misc_feature (313)..(313): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctcccaggctcctcatcttggtgtgtccactaggggccncgtggtgtcccagtcaggtttcagtggcaggtggctcgtgggacagtagttcactctcaccatcagcagcctgcagtctagaagtatttgactagtttattactgtcagcaattataatagctcgtcctcgtagtgtctacgtttgccgtagggaccagtcgtgagatacaacgatggtgctacg

SEQ ID NO: 242663 - DNA, 736 bp, Homo sapiens
  misc_feature: GYAE6OF02IJJ01.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctcccaaccactctgtctgtgtctccaggggacagacgccaccctctcctgcgaggccagtcagagtgttagcagacaacttagcctggtaccagcgagaaagttggccaggcctccgaggcctcctctacttcgtttggtgtcgtccgacgtacggggtcccgcgttcgggtcgtccccgtaggtccgtaaggttccgtagggtcggctagggttcggccttcgtggggaacctaacgggtacgttttacccgaacttccgtccctaaacccgtattaccgaacgtccgacgtccgttcgacgtaacggttcgtaaggtaaacgtttagttttacggacttttaaggttttaacttaaccggttgttaccgtaaggttaccttaagtttaagttacggtaaactttaaccggttcggttaccccggttccggtaacggggttaccgggtttccggaacccgggtaaacggggtaacccgtaaaggggttaaccgggtaaaacgtaaacccgtaaaacgtaacggttacggtaccgggtacttaacgggacccttaacgtaccgttaccgg

SEQ ID NO: 242664 - DNA, 596 bp, Homo sapiens
  misc_feature: GYAE6OF02JKRWD.35.85.H08.1.454.CMB.1.raw
  modified_base (209)..(209): a, c, t, g, unknown or other
  misc_feature (209)..(209): n is a, c, g, or t
  modified_base (317)..(317): a, c, t, g, unknown or other
  misc_feature (317)..(317): n is a, c, g, or t
  modified_base (354)..(354): a, c, t, g, unknown or other
  misc_feature (354)..(354): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctntcctgcagggccagtccagagtgttagcaagctaacttagcctggtaccagcaagaaagttggccaggctccgaggctcctcatcttggtcgtgtccacttagggccncgtggtcgtcccagtcaggtcagtggcagtgctacgngggtacagacgttcactctcacatcagcagcctagcctaaggtctacggtaaagttacttttcgggactttaggttaaactttcgtgttacgaagtcctaaattagtaaacgttggtacttacggggtaccctccgggttaagttcgacctttaccggttttggaccccggtaagggggtaacctaacggtcggtaaggtacgaacgttaccgaaaacgtacgtacggttacggacgttacg

SEQ ID NO: 242665 - DNA, 607 bp, Homo sapiens
  misc_feature: GYAE6OF02JUF6C.35.85.H08.1.454.CMB.1.raw
  modified_base (233)..(233): a, c, t, g, unknown or other
  misc_feature (233)..(233): n is a, c, g, or t
  modified_base (318)..(318): a, c, t, g, unknown or other
  misc_feature (318)..(318): n is a, c, g, or t
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccatctgtctgtgtctccaggggacagacgcctacctctcctgccagggccagtccagagtntagcagcaattacgcctaggtaccagcaagaagttgcctaggcctccaggcctctcattcttggtacgtcgtccacgtagggccncgttggtcgtcccaggtctaggttcaggtcgcaggtcgactcgngggacagtgtcacgtctacncgactcgacgcacgcctcnccgacgtcgtacgtagttacgtttcgaccttagtttaccttacgttcgtactaaggtactaaattacgttaacgtacggtcgtacggttcccttacgggtacgtttcgtaccgttacgttttcggaccggtaacgggtaccaggtaccgttacggaacgttacgtaaccggtaaaccgttacggttcggtaccggtacgttaccgg

SEQ ID NO: 242666 - DNA, 553 bp, Homo sapiens
  misc_feature: GYAE6OF02IYJSD.35.85.H08.1.454.CMB.1.raw
  modified_base (287)..(287): a, c, t, g, unknown or other
  misc_feature (287)..(287): n is a, c, g, or t
  modified_base (319)..(319): a, c, t, g, unknown or other
  misc_feature (319)..(319): n is a, c, g, or t
  modified_base (416)..(416): a, c, t, g, unknown or other
  misc_feature (416)..(416): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcntcttgtgtgtccactagggcgctggtgtcccngtcaggttcagtggcagtgctcgtgggacagtagttcacctctcacctatcacgcacgctcgcagtctagagtatttgacttagtttattactcgtntacgactaattataatcgtactacggtcccgtacggtaagttcgtacttaccgttttaggacccggtaacggggtaacccaagggtccgttagggaagtacgttaccgaaacgtacggttagtacgggccttaccgg

SEQ ID NO: 242667 - DNA, 493 bp, Homo sapiens
  misc_feature: GYAE6OF02HWCX9.35.85.H08.1.454.CMB.1.raw
  modified_base (293)..(293): a, c, t, g, unknown or other
  misc_feature (293)..(293): n is a, c, g, or t
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (490)..(490): a, c, t, g, unknown or other
  misc_feature (490)..(490): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaaatagtgatgacgcagtctccaaccactctgtctgtgtctccaggggacagagccaccctctcctgcagggccagtcagagtgttagcagcaacttagcctggtaccagcaagaagttggccaggctccagctcctcatcttgngtcgtcactagggccgctggtcgtcccagtctaggttcagttcggcagttggcttcgngggacagagttcactctcacatcancacgcctgcagtctagaagtattttgnttagtttattatgtcanactaatatatagntcgctcgagttgctagtttcggcgagggaccagcgtagagatacgaagtacgtgtgntcg

SEQ ID NO: 242668 - DNA, 532 bp, Homo sapiens
  misc_feature: GYAE6OF02IMYN4.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaaagttggccaggcctccaggcctcctcattcgtttggtgtgtccacgtacgggccgcgttgggtcgtccccagttcaggttcagtggcagtggctcgtggacagattcactctacaccatcagcagcctgcagtctagaagtattttgacttagtttattactgtacagtactaatataatagtctcgtcctcggtagttcgcttacgtttggacccgtaggggtaaccaaggtcgtaggagtactacgaaacgtacgtggtcggctacg

SEQ ID NO: 242669 - DNA, 572 bp, Homo sapiens
  misc_feature: GYAE6OF02FJ33I.35.85.H08.1.454.CMB.1.raw
  modified_base (227)..(227): a, c, t, g, unknown or other
  misc_feature (227)..(227): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagngtgttagcagcaacttagcctggtaccagcaagaaagtggccaggctcccaggcctcctcattcgtttggtgtcgtccagtacggggccgcgttgggtcgtccccgaggtcgaggttcaggtcggcaggtggctcgtggggacaggtagtttcacttcctaccacctactcacgacgacgtccctgcctagttcgtaggaagttattttgacttagtttattacgtgtactagtactaatataagtagtcgtacgtcctcgtagttgacttacgtttcgggaccgtaaggggtaccaaggtcgtaggagtacgtaacgaaaccgtacgtacggtacgtcgtacgg

SEQ ID NO: 242670 - DNA, 569 bp, Homo sapiens
  misc_feature: GYAE6OF02H13MZ.35.85.H08.1.454.CMB.1.raw
  modified_base (303)..(303): a, c, t, g, unknown or other
  misc_feature (303)..(303): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccaggggacagagccacctctcctgcagggccagtcagagtgttagcagcaacttagcctggtaccagcaagaaagttggccagggcctccgaggctccctcacttcgttttgggngttcgttccacgttacggggccgtcgttggtcgtcccagtccgtaggtttcaggttggcaggtcggctcggtggacagtagttcacgtctcaccatcagcagcctgctagtctgaagtattttgacttagttttatctgtctaagctaaatacgttaatagtcgttagtccctacgtagttcgtacttacgttttcgggccgtaacggggtacctaaggtcgttagggagtacgtaacgaaacggtaaccgtgtacgggtctacgg

SEQ ID NO: 242671 - DNA, 571 bp, Homo sapiens
  misc_feature: GYAE6OF02HM6BX.35.85.H08.1.454.CMB.1.raw
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcagaaagttggcaggctcccaggctcctcattcgtttggngtcgtccacgtacgggccngtggtcgtcccagtccaggttcaggtggcaggtcggctcgtgggacaggtagttcacgtctacaccatcagcagcctgctagtctagtaagtatttagcttagtttattactagtcgagtactaaattaataaagttagtacgttcggtacccgttacgtacgttacgtcgttacgttttcggacccggtaaggggacccgtaacggtcgtaggacgtacgtaaccgaaacggtacgtaggtacggtcgtaccg

SEQ ID NO: 242672 - DNA, 608 bp, Homo sapiens
  misc_feature: GYAE6OF02HB8IB.35.85.H08.1.454.CMB.1.raw
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttgccaggctccaggctccncatctttggngtcgtccacgtagggccgcgtggtcgtcccagtcgtaggttcaggtgcagtcggctcgtgggacagtacgttcactcctcaccagtcacgcacgcctgactagtctaggaagttagtttgaccgtttagtttattacgttcgtatacgtactaaagttagtaaacttacggtacgttcggtacccttccggtaggtttaccgtaccgtttaccgttttcgggaccccgggtaacgggggtaaccctaagggtccgtagggtaacgtacgtaaccggtaaaacggtaccggttacgggttacggtccgttacccgg

SEQ ID NO: 242673 - DNA, 743 bp, Homo sapiens
  misc_feature: GYAE6OF02F18MI.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatactcactggaagaaatagtgatgacgcagtcctaccaaccactctgtctgtgtcctccggagggacagacgcccaccctctcctgcgacggccagtcgagtagtgttagcgagacctaacgttacgccgtacggtaccagacgaaaggttaaaggttcggacccgacggtccctaccccggaggtccttccctacgtacgtttcgttttgggtgttccggtaccctaacgggtaccggggcccgtcggttcgggttccgtacccgtagtcgtacgggtttcgagggtcggacgtaggtcggtccgttcggtacggggaactaacgggttacgtttaccaccgtttaccgtacccgaaccgtactaccgacggaccgtaccggtccgtacgacgtacgtaccgtaaggtaaagtttgttttacgacgtttaagttttacttacgttcgtacgacgtaactaaattaataagtacgtcggttacgtcccgtacggttagttcgtacctttacggtttccggaccggtaaccgggaaccgtaacggtcggtacgggtaacgtaacgtaaccggtaaaaccgttacggtcgggttacggtacgtacccgg

SEQ ID NO: 242674 - DNA, 598 bp, Homo sapiens
  misc_feature: GYAE6OF02G2YT2.35.85.H08.1.454.CMB.1.raw
  modified_base (326)..(326): a, c, t, g, unknown or other
  misc_feature (326)..(326): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcaagtaaagttcgaccaggcctcccgaggcctcctcattcgtttggtcgtcgtaccacgtacggggccncgttggtcgtccccagtcaggttcaggtcggctaggttggctcgtgggacagtacgttcacgtctacacactcacgcagcctgctagtcgtagagtatttgacttagttattactgtctagtactaagtactaagtagtcgtcgtaccgtcgttaacggttcgtaccgttacgttttcgggaaccggtaacggggtaaccgtaaacggtacgttacgggtaacggtacgttaaccgtaaaccggttaacggtacggtacgggtactaaccgg

SEQ ID NO: 242675 - DNA, 560 bp, Homo sapiens
  misc_feature: GYAE6OF02HD544.35.85.H08.1.454.CMB.1.raw
  modified_base (285)..(285): a, c, t, g, unknown or other
  misc_feature (285)..(285): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (370)..(370): a, c, t, g, unknown or other
  misc_feature (370)..(370): n is a, c, g, or t
  modified_base (425)..(425): a, c, t, g, unknown or other
  misc_feature (425)..(425): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccaggggacagagccacctctcctgcagggccagtcagagtgttagcagcaacttagcctggtaccagcagaaagttggccaggctcccgaggctccnctattctttggtgtntccacgtacgggccncgttggtcgtccccgtagtccgaggtttcaaggtggctaggtggctcgtgggacngtagttcactctcaccatcagcacgcctgcagtcagtatagtttgcttaagtttnttaacgtgtactagctaaatataatacgtctagccttacgtacgttagtacgttacgttttaggaccggtaacggggacctaaggtccggttaggacgtaactaccgaaacggtacgttcggtacggtctaccgg

SEQ ID NO: 242676 - DNA, 852 bp, Homo sapiens
  misc_feature: GYAE6OF02GWREU.35.85.H08.1.454.CMB.1.raw
tcagtacagatcgtcacgaccggtgctcgatttagtatcactcagtcggtcgggggaggaactgctcagttaggacccagacggaaccatggaagccccagcgcagcttctcttcctcctgctattctggctcccagatatcactggagaaatagtgatgacgcagtctccgaaccacctctgtcttcgtggtctccgaggggaccacgagcccaccctctccgtcgacgacgggccaaggtccgtaaggacggttacgtttaaggcctaggtacctaactttaggccccttagggtaacccgaacgtccgaacggaaaacggtttcgggacccccgaagggcccttacccccgaagggtccttccccgtttcgaacgtttcccgtttttagggtcgggttccgtacccgtaacggttaacggggtccccgtacggtcgggttacggttcccccaaggttcccggtacggtttccggtagggttcgggaccggtaggtttcgggtccttcgttcggggaactaacggtaacgtttccaaccgtttaccgttaccaaccgtaacttccgtaacgtaccgtaacgtacccgtcggtaccgttaacggttccttacggtaaagttacgtttttacgacgtttaagttttaacttaacgttacggttacgtaacgttacctaaacgtttaacgttaaacggttaacggtaccgttacgggttacccgttaccggtaacgttaacggtaccgttacggttttcggggacccggtaacggggtaaccctaacgggtaccgttacgggtaacgtacgttaccgaaaccgttaccggttaccggttacggtacgttccgg

SEQ ID NO: 242677 - DNA, 749 bp, Homo sapiens
  misc_feature: GYAE6OF02HNN4P.35.85.H08.1.454.CMB.1.raw
  modified_base (200)..(200): a, c, t, g, unknown or other
  misc_feature (200)..(200): n is a, c, g, or t
  modified_base (327)..(327): a, c, t, g, unknown or other
  misc_feature (327)..(327): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatccctctcctgcagggccagtcagagtatcggaacacgtgtctggtaccagcaagaaacctggccaggctcccgaggcctcctcatctagtggtgcatcccacgacgggcctacgtggtacncccagccgtaggttcaggtcggactaggtcgggtcgtaggggactaggtacctttcacttcctaccgaacctactccgaaggtccaacggtccgttacggaccgtacggttccgtaaggtaaacgttacgttttaagtcggtacctttaaggttttaactaccgtaacgtttggtaccgtaaggtaccgtttaaacggttttaacgtaccggttccggttaccggggcccccgttccggttacccgtttccggttttacccggggttttacccgggggacccgggggttaaccggggtaaaccccgggttaaaggggggtacggggtaaacgtaaaccggtttaaaacccgggaaaaacgttaccggggtttacgggtaaccgggttacccgtttaacgggtaccccgtaaccgtttaacgg

SEQ ID NO: 242678 - DNA, 508 bp, Homo sapiens
  misc_feature: GYAE6OF02G0SL3.35.85.H08.1.454.CMB.1.raw
  modified_base (309)..(309): a, c, t, g, unknown or other
  misc_feature (309)..(309): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttgcaggctcccaggctcctcatctttggtgtgtccactagggccnctggtcgtcccagtcaggttcagtgcagtggctcgtggacagagttcactctcaccatcagcagcctgcagtctagaagtatttgactagtttatactgtcagtcaattataatagtcttcggcctaccgtagttcgacttacgtttggccgtagggacctaggcgtaggagatacgaaacgtacgtgtacggctacgg

SEQ ID NO: 242679 - DNA, 854 bp, Homo sapiens
  misc_feature: GYAE6OF02HBX4V.35.85.H08.1.454.CMB.1.raw
tcagtacagatcgtcacgaccggtgctcgatttagtatcactcaggtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccaccctctcctgcacgggccagtcagagtgttagcagctaacttagcctggtaccagacaagaaagttcggccaaggcctaccccgaggcctcccgtactacgttcgtttagggtcgtacggttacccgaaccggttacggggcccgtacgtttcgggttccggttaccccgtaaggttccgtacggggtttaccaaggggttcgggacgtacgggttcgggccgtttaccgggtaggggggaaacctaggggttaaccgtttccgtaaccgttccttaacccgtaaccctaacgtttacccgaacggtaccccgaaaccgggtcccgtacgggtaacccgttaaacggggtttacccgtaagggtaaaacggtttttaggttttttaacccgggtaacttttaaacgggtttttttaacttttaacccgtttacggttaacccgtaaggttaaaccttaaagtttaaatttaaacgttaaccggtaccgtttaccgggtccctttaccggtaacgtttacggtacccgtttacggtttttccggggaacccggtaaccgggggtaaccgtaaacgggtccgttaaggggaacgttaaaccgtaaccggtaaaaccggttaaccgttcgggtagggtacccttaaccggg

SEQ ID NO: 242680 - DNA, 586 bp, Homo sapiens
  misc_feature: GYAE6OF02IMV0H.35.85.H08.1.454.CMB.1.raw
  modified_base (293)..(293): a, c, t, g, unknown or other
  misc_feature (293)..(293): n is a, c, g, or t
  modified_base (418)..(418): a, c, t, g, unknown or other
  misc_feature (418)..(418): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaacactctgtctgtgtctccaggggacagagccacctctcctgcagggccagtcagagtgttagcagcaacttagcatcggtacagcagaaagttggccaggctccgaggctctcatctttggtntcggtccacgtagggccgcgttggtacggtcccaggtcgaggtttccaggtcggcgtaggttggcttcgtggggaacaggtacggttcacgttctacaccatcaagtcagcctgcagtctgaatnttttgctagtttattacgtgtcgtagtacctaattaataataacgtcgttacggtccttaccggtagtttcgacgtttacgttttcgggaccgtaagggggttaccaaacggttcgttacgggaacggtacgtaaccgtaaaaccggtacctagggttacggtaccgg

SEQ ID NO: 242681 - DNA, 599 bp, Homo sapiens
  misc_feature: GYAE6OF02IDWFG.35.85.H08.1.454.CMB.1.raw
  modified_base (301)..(301): a, c, t, g, unknown or other
  misc_feature (301)..(301): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagccctggtaccagcaagaaagttggtcaggctccaggctcctcattcgtttggngtcgtccacgtacggggcccgcgtgggtcgtcccgagtccaggttccaggtgcaggtggctcgtgggacagtagttcacttcctaccaccatcacgcagtcctgctagtctagtaagttattttgacttagttttacttacgtgtacagtactaaattacgtaaatacgtccgttaccgggccccgtacggttacgttcgttaccgtttacggttccggtaccgggtaacggtaaccgtacggtacggtaggtaacgtacgtaaacggtaaccgtacggtacggtccgtacgtacccg

SEQ ID NO: 242682 - DNA, 548 bp, Homo sapiens
  misc_feature: GYAE6OF02HUV2O.35.85.H08.1.454.CMB.1.raw
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagtaaagtggccaggctccaggctcctcatctttggntgtccactagggtccngtggtcgtcccagtcaggttcagttgcagtggtctgtgggacaggtacgttcactctacgacctatcagcacgcctgaccaggtctaggaatattttgcttagtttattacttgctagtataatataatagtctcggtcctcgtagttgccttacgttttcgggaccgtaacggggacctaacggtcgttaggagtaacgtaaccgaaacggtaaccgttggtaccggtactaccgg

SEQ ID NO: 242683 - DNA, 514 bp, Homo sapiens
  misc_feature: GYAE6OF02H2IHC.35.85.H08.1.454.CMB.1.raw
  modified_base (293)..(293): a, c, t, g, unknown or other
  misc_feature (293)..(293): n is a, c, g, or t
  modified_base (371)..(371): a, c, t, g, unknown or other
  misc_feature (371)..(371): n is a, c, g, or t
  modified_base (402)..(402): a, c, t, g, unknown or other
  misc_feature (402)..(402): n is a, c, g, or t
  modified_base (446)..(446): a, c, t, g, unknown or other
  misc_feature (446)..(446): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctttctgtgtctccaggggacagagccaccctctcctgcagggccagtcagagtgttagcagcaacttagcctggtaccagcagaaagttggccaggctccaggctctcatctttggngtcggtccacgtagggcctcgtggtcgtcccaggttcaggttcaggtggcaggtggctgtgggacagtagttcactcncaccatcagcagccctgctagtctagtaatntttgctagtttattactgtcagctaataatatagctgcctacgnttgctacgtttggacccgtagggacctagtcgtaggagaagtacaaacggtagtggtacggtctgacc

SEQ ID NO: 242684 - DNA, 746 bp, Homo sapiens
  misc_feature: GYAE6OF02IWNVH.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagctaacttagcctggtaccagcagaaagttgccaggcctaccgaggctaccctcattcgtttggtgtcgtccgacgtacggggcccgtcgtggttcgtccccgaaggttccgtaagggtttccgtaaggttcgggaccgtaggttcgggtaccgttcggttagggggaacctagggtacgtttccgaaccttccgtaccgaaccctagttaccgaacggtcctaaccggtccccttaggtaccgtaacggttccgtaacgtacgtttacgttaaagttttttcgaaccgtttaaggttttttaaacttacgttacggttacgtacggtaacttaacgtttaagtacgtaacgtttaaaccggtcggtaaccccgttccgggttaacgggttaccccggttacgggtaacccggtaacggggtaacccggtaaggggttaaccgggtaaaccgttaacccggtaaaccggtacgtacgggttccgtaccgttacgaccgtacctacgg

SEQ ID NO: 242685 - DNA, 736 bp, Homo sapiens
  misc_feature: GYAE6OF02FLBYN.35.85.H08.1.454.CMB.1.raw
tcagtacagatcgtcacgaccggtgctcgatttagtatcactcagtcgcggggaggaactggctcagttaggacccagacggaaccatgggaagccccagccgcaggcttcgtcttcctcctgcttattctggctcccagatagtcactgggacgaaagtacgtgatgaccgcacgtctccaaccactctgtctgtgtctccaggggacagagccacctctcctgctacgggccagtcaggacgtgttagcagctaacgttagcctggtaccagcaagtaaagttcggaccaggcctacccgacggacccttacctcgaacttcgttttagggtcgttcggtcccaacgttacggggcccgtcgttcgggttcgtccccgtaagttcctagggtttccaaggttcggctaggtcggcttcgtaggggaactaggtacgttccaacgttccgtaccaacctactaccgacgtccgacggtacccgtcgtaccgtacgttcgtacggtaacgttacgttttacgtacgtttaacgttttacgtttacgttacgtttaccgtaacgtacgtaaacttaacgtaacgttacgtacgttacgggtacccgttacggtacgtttacgtaccgttacggttttacggacccgggttaacggggtaaccgtaacggtccgttacgggtaacggtaccgttaaccggtaaaccggtaaccggtacggttacggtcccgttaccgg

SEQ ID NO: 242686 - DNA, 555 bp, Homo sapiens
  misc_feature: GYAE6OF02HLUXN.35.85.H08.1.454.CMB.1.raw
  modified_base (185)..(185): a, c, t, g, unknown or other
  misc_feature (185)..(185): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (311)..(311): a, c, t, g, unknown or other
  misc_feature (311)..(311): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtntctccaggggacagagccaccctctcctgcagggccagtcagagtgttagcagcaacttagcctggtaccagcagaagttggcaggctccgaggctctcatctttggngtntccagtacgggccgntggtgtcccctagtcgaggttcagtgcaggtcggctcgtgggacaggtacgtttcacttctcacctatcagcacgctcgctacgtcgtaggtaagtagttttcgacttagttttacttacttgtacagtactaattataagtacgacttcggcctacgtgttacgtcgttacgttttcggacccggtaacgggtaccaacggtcgtaggacgtacgtacgaaacgtacgtaggtcggcgtacgg

SEQ ID NO: 242687 - DNA, 543 bp, Homo sapiens
  misc_feature: GYAE6OF02GLKRX.35.85.H08.1.454.CMB.1.raw
  modified_base (328)..(328): a, c, t, g, unknown or other
  misc_feature (328)..(328): n is a, c, g, or t
  modified_base (376)..(376): a, c, t, g, unknown or other
  misc_feature (376)..(376): n is a, c, g, or t
  modified_base (435)..(435): a, c, t, g, unknown or other
  misc_feature (435)..(435): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctccctgcagggcccaggtccagagtgttagccagcaacttagcctggtaccagcagaaaacgttggcccaggcctccccgagcctcctcatctttggtgtgtccacgtacggggcccncgtggtcgtccccagtcaggtttccagtggcaggtggctcgtgggacngagttcactctcaccatcagcagcctgcagtctgaagtattttgcttagtttattactntcagcaatataagtagtctgcctcgtagttcgactacgtttcggaccgaacggggtaccaacggcttaggaacgtacgtacaaaccggtaactggtcggtcgtaccgg

SEQ ID NO: 242688 - DNA, 565 bp, Homo sapiens
  misc_feature: GYAE6OF02IJC5A.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttggccaggctccgaggcctcctcattctttggtgtcgtccacgtacggggcccgtctcggtcgtccccgagttcgacggttcaggtggacaggtggctcgtgggacagtacgttcactctcaccatcagcacgcctgcgagtcgtagtaagtagttttgacttagtttattacttgtacagtactaaattaataagtacgtcgtcggtaccgtacgtacggttcgtaccttacggttttcggaccgtacggggaaccgtacggtcgtaggacgtaacgtacgtaaaccgg

SEQ ID NO: 242689 - DNA, 539 bp, Homo sapiens
  misc_feature: GYAE6OF02JBUSO.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccacggccccccaggcctcctcatctagtggtgcactcccaccagggccacgtggtactcccagccaggttcagtggcaggtgggtcgtgggacagagttcacgtctcacctatcagcagcctgccagtctaggaagttatttgacttagtttattacgtgtacagtactaataataatagtcgtcggtcccttcggtagttgtcttacgttttcggccgtaacggggacctaggtcgtaggatacgtacgaaacgtatcggtagctacg

SEQ ID NO: 242690 - DNA, 686 bp, Homo sapiens
  misc_feature: GYAE6OF02H0O7D.35.85.H08.1.454.CMB.1.raw
  modified_base (200)..(200): a, c, t, g, unknown or other
  misc_feature (200)..(200): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagngccaccctctcctgcgagggccagtcagagtgttagcagactaacttagccgtggtaccagcaaggtaaggttcggcgaggcctcccgaggtcctcctctacttcggtttggtcgtcgtccacgtacggggcctggtcggttccgtcccgtaggtcgtaggttcgaggttggcctaggtcggtcgttcggtagggaccaggtacgttaccaccgtcctaccgacctactacacgcctacgtccgtcgtacgtacgtacgtaggtaacgtttacgttttacggtacgtttaagttttacttacgttcgtaccgtagtaacctaaagttaacgttaaacttacggtacgttaccggttcccgttacggtacgtttacggttaccgtttacgttttaccgggacccgggtaacggggtaaccgtacggtacggttaagggaaccgttacgaaaccgtaaacggtaacgttacggtacggtcgttaccgg

SEQ ID NO: 242691 - DNA, 545 bp, Homo sapiens
  misc_feature: GYAE6OF02HOXZY.35.85.H08.1.454.CMB.1.raw
  modified_base (405)..(405): a, c, t, g, unknown or other
  misc_feature (405)..(405): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattcgtttggtgttcgtccacgtacggggcccgtcgttgggtcgtccccagtccgaggttcaggtggctaggtggctcgtggggacagtagttcactctcaccactcagcagcctgcngtctagtagtatttgctagtttattactgtcagacaattataatagtcgtcgtccgtcgtagttcgcgttacgttttggacccgtaagggacctaaggtcgtaggagtactacgaaacgtaacgtggtacggtactacgg

SEQ ID NO: 242692 - DNA, 534 bp, Homo sapiens
  misc_feature: GYAE6OF02G61YE.35.85.H08.1.454.CMB.1.raw
  modified_base (227)..(227): a, c, t, g, unknown or other
  misc_feature (227)..(227): n is a, c, g, or t
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
  modified_base (401)..(401): a, c, t, g, unknown or other
  misc_feature (401)..(401): n is a, c, g, or t
  modified_base (530)..(530): a, c, t, g, unknown or other
  misc_feature (530)..(530): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagngtgttagcagcaacttagcctggtaccagcagaagttggccaggctccgagcctcctcattctttggngtcgtccacgtacgggccncgtggtcgtcccagtcaggttcaggtggcagtggctcgtgggacaggtattcactctcaccatcagcagcctgctagtctagaagtnttttgacttagtttattactgtcagtactaattataatagtcgtacggtcctacggtagttgaccttacgtttcggaccgtaacgggaacctacggcgttaggatacgtacgaaacgtacgtggtacgntacg

SEQ ID NO: 242693 - DNA, 546 bp, Homo sapiens
  misc_feature: GYAE6OF02FH0K6.35.85.H08.1.454.CMB.1.raw
  modified_base (317)..(317): a, c, t, g, unknown or other
  misc_feature (317)..(317): n is a, c, g, or t
  modified_base (382)..(382): a, c, t, g, unknown or other
  misc_feature (382)..(382): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtcgtccacgtaggggcccgntgggtcgtcccagtcaggttcagtggcagtggctcgtgggacagtacgttcactctcaccatcancagcctgcagtctagaatcgtttgcttagtttacttactgtcagtcaatataagtgtctcgcctaccggtagttcgacttacgtttcggccgtaacggggaccaaaggtccgttagggaacgtaacgttaccgaaaaccgtacgtacggtacgggtcctaccgg

SEQ ID NO: 242694 - DNA, 547 bp, Homo sapiens
  misc_feature: GYAE6OF02IAX5I.35.85.H08.1.454.CMB.1.raw
  modified_base (216)..(216): a, c, t, g, unknown or other
  misc_feature (216)..(216): n is a, c, g, or t
  modified_base (316)..(316): a, c, t, g, unknown or other
  misc_feature (316)..(316): n is a, c, g, or t
  modified_base (388)..(388): a, c, t, g, unknown or other
  misc_feature (388)..(388): n is a, c, g, or t
  modified_base (471)..(471): a, c, t, g, unknown or other
  misc_feature (471)..(471): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtctccaaccactctgtctgtgtctccgaggggacagacgccaccctctccngcgagggccagtcagagtgtagcagctaacttagcctggtaccagcaagaagtcgcaggcctccgaggcctctcattcgttggtgtcgtcacgtcgggcncgtggtcgtcccagtcctaggttcaggtgctaggtggctcggagggtacagacgttcactctcgacatcacncagccctggctagtcgtagaagttattgacttatttacttatcgtacatacgtaattataagtctgtacgtctaccgtagttnaccgttagtttcgggacccgaaggggtaacctagtccgtagggaactagtaccgaaagtaccgtaggtccggatcg

SEQ ID NO: 242695 - DNA, 552 bp, Homo sapiens
  misc_feature: GYAE6OF02F2F4I.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctcccaggctccgtcattctttgggtgtcgtccaacgtacggggccgtcgttgggtcgtccccagtccgaggttcagtggcaggtggctcgtggggactaggagtttcactctacacatcacgcacgcctgcagtctagtaagtatttgcttagttttattacttgtcaagtcaattataatagtactggcctcgtagttcgtacttacgtttcggaccgtacggggtaaccaaggtctaggagtacgtacggaaacgtacgtacggtacggtcgtacg

SEQ ID NO: 242696 - DNA, 525 bp, Homo sapiens
  misc_feature: GYAE6OF02FV6RY.35.85.H08.1.454.CMB.1.raw
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccacgtagggccnctggtcgtcccagtcaggttcagtggcaggtgctcgtgggacagagttcactctcaccatcagcagcctgcagtctagaagtattttgctagtttacttactgtacagtacaatataatagctcggtcctacgtagttcgactacgtttggccgtaaggggacctaaggtccgtaggagtacgtaccgaaaacgtacgtaggtacggctacg

SEQ ID NO: 242697 - DNA, 560 bp, Homo sapiens
  misc_feature: GYAE6OF02FIS21.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttgccaggctccaggctcctcatctttggtgtcgtccacgtagggccgtcgtggtcgtcccgagttcgtaggtttcaggttcggcgtaggtcggtctcgtgggacagtagttccactctacaccatcagcacgcctgcagtcgtagaagttatttcgacttagtttattactgtacagtactaatagtaattagacgttcggcccttaccgtacgttcgccgttacgttttcggacccggtaaggggacctaaggtccgttaggagtactacgtaaaccgacgtaggtggtactacg

SEQ ID NO: 242698 - DNA, 598 bp, Homo sapiens
  misc_feature: GYAE6OF02GCS8J.35.85.H08.1.454.CMB.1.raw
  modified_base (458)..(458): a, c, t, g, unknown or other
  misc_feature (458)..(458): n is a, c, g, or t
tcagtacagatcgtcacgaccggtgctcgatttagtatcactcagtcggcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagttgttagcagctaacttacgcctggtaaccagacgaagtaaagttcggaccaaggtcctccccgagggtcccttcccgtctattccgttttggtcgtcgtccccgacgttacggggcccgtcttcggtcgttccccgaggttccgtaggtttccaggtcggctaggtcggtctcgtgggacagtacgtttcacttcacaccatcagcagtcctgcagtctagtaagttntttagcttagtttattactagtcagtcaattataagtgtcgtcgccgtacgtgttagtcgttacgtttcggaccgtacggggtaacctaacggtcgtaggtaacgtacgtaccgtaaacgtacgtggtacggtctaccgg

SEQ ID NO: 242699 - DNA, 541 bp, Homo sapiens
  misc_feature: GYAE6OF02I3DO9.35.85.H08.1.454.CMB.1.raw
  modified_base (321)..(321): a, c, t, g, unknown or other
  misc_feature (321)..(321): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttgccaggctccaggctcctcatctttggtgtgtccacgtagggccncgtggtcgtcccagtcaggttcagtggcagtcggctcgtgggacagtagttccgactcgtcaaccattcgagtcacgcctgctagtccttagagttatttgacttagtttacttacgttgtcagtacgaattaactaatacgtctcggccttacggtggttctacttacgtttcggaccgtaacgggacctacggtccgtaggagtacgtacgaaaccgg

SEQ ID NO: 242700 - DNA, 575 bp, Homo sapiens
  misc_feature: GYAE6OF02GJU2O.35.85.H08.1.454.CMB.1.raw
  modified_base (569)..(569): a, c, t, g, unknown or other
  misc_feature (569)..(569): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggctcccaggctcctcattctttgggtgtggtcccacgtacggggccctcgtgggttcgtccccgaggttccgagggtttccaggttcgggctaggtgggcttcgtggggaactaggtacgtttcaccgttcctaccaacctatacacgcacgccctgctagtctagaagtattttgacttagtttattactgtcagtcaaattataatagtctggcctccgtagttctacttacgttttcggccgtaacggggtaccaaggtcgtaggagtactacgaaacgtacgtacggtggtntaccgg

SEQ ID NO: 242701 - DNA, 691 bp, Homo sapiens
  misc_feature: GYAE6OF02GTB0C.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgtagcagcaacttagcctggtaccagacaagaaagttggccaggcctcccgaggcctcctcattccgtttggtcgttcgtccgtacgtacggggcccgtcgttgggttcgtccccgtaggtccgtacgggtttcgaggtcgggctaggtcgggctcggtaggggactaggtacgttccacttcctaccaacctatccgacgcctacggcccttcgaccgtacggttcgtaaggtaacgtttagttttacggacttttaagttttaacttacgttggttaccaaggttaactaaatttaagtaaacgttacgtccgttacggtacccgttacggttaacgttcgtaccgttttacggttttccgggacccggttaacggggtaaccctaaacgggtccgttaagggtaacgtaacgttaaccggtaaaaccggtaccgttagggttccggacgtaccgg

SEQ ID NO: 242702 - DNA, 568 bp, Homo sapiens
  misc_feature: GYAE6OF02JB1IK.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattcgtttggtgtcgtccacgtacggggccgcgtggtcgtcccagtcaggttcaggtggcaggtggctcgtgggacaggtagttccactctcaccactcagcacgcctgcagtctgaagtgttttcgcttagtttattacttgtcgagtactaattataaatagtcgttcggtccgtaccggtagttcgtacgttacgttttcgggacccggtaacggggaacctaacggtcgtaggtaagtaacgtaccgtaaacggtaacgtaggtacggtcgtaccgg

SEQ ID NO: 242703 - DNA, 610 bp, Homo sapiens
  misc_feature: GYAE6OF02IRLL5.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccaggggacagagccacctctcctgcagggccagtcaggagtgttagcagacaacttagcctggtaccagacaagaaagttcggccaaggctcccaggcctccctcatttcgtttgggtgttcgtccacgttacgggccgtcgtggtcgtccagttcgaggttcaggtcggcaggtggctcgtagggactaggacgtttcacttcctcaaccgtactcgacgcacgccgtgtcgtagtcgtaggtaagttagttttcgtacgttagttttattacgttgtacagtactaaagttattaaagtagtaccgtacgtccgtacggttacgttcgtaccgttacgttttacggaccggtaacgggtaaccgtaaggtaccgtgggtaagtaacgttacgaaaccgtacgttaggtcgggtactacgg

SEQ ID NO: 242704 - DNA, 511 bp, Homo sapiens
  misc_feature: GYAE6OF02FQ528.35.85.H08.1.454.CMB.1.raw
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtntgtccacgtagggccnctggtgtccccagtcaggttcaggtggcagtggctcgtgggacagagttcactctcaccatcagcagcctgcagtctgaagtatttgctagtttattactgtcagcaatataatagctcgcctcgtagttgcttacgtttcggaccgtaggggaaccaaggtcgtaggagtactacgaaacggtactggtggctacgg

SEQ ID NO: 242705 - DNA, 518 bp, Homo sapiens
  misc_feature: GYAE6OF02F0Z7Y.35.85.H08.1.454.CMB.1.raw
  modified_base (396)..(396): a, c, t, g, unknown or other
  misc_feature (396)..(396): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgtctgggtcgtcccagtcaggttcagtggcagtggctcgtgggacagagttcactctcaccatcagcagcctgcagtctgaagtntttgctagtttattactgtcagtcaatataatagctgcctcgagttcgctacgtttcggccgtaaggggacctaaggtccgtggaacgtagtacgaaaccggtaacgtggttacggctacgg

SEQ ID NO: 242706 - DNA, 605 bp, Homo sapiens
  misc_feature: GYAE6OF02JVEPJ.35.85.H08.1.454.CMB.1.raw
  modified_base (379)..(379): a, c, t, g, unknown or other
  misc_feature (379)..(379): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgtagcagcaacttagcctggtaccagcaagaagttgccaggcctccgaggcctcctcattcgtttggtgtcgtccacgtacgggccgtcgtgggtccgtcccctaggtcctaggttccaggttcggctaggtcggtcctgtgggacngtacgttccacgtctcacatcagcagtccgtgctagtcgtagtacgttatttgtacttagtttactacgtgtactagtctaaagttataacgttagtccgttacggtccgttacggtagttacgtccgtttaccgttttcgggacccggtaacggggtacccaacgggttcgtaaggaacgtaacgtaaccgaaaccggttacgtacgggtaggtacccgttacgg

SEQ ID NO: 242707 - DNA, 525 bp, Homo sapiens
  misc_feature: GYAE6OF02F8ZTI.35.85.H08.1.454.CMB.1.raw
  modified_base (405)..(405): a, c, t, g, unknown or other
  misc_feature (405)..(405): n is a, c, g, or t
  modified_base (431)..(431): a, c, t, g, unknown or other
  misc_feature (431)..(431): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccccaggcctccgtcattctttggtgtgtccgactacggggccgtctggtcgtccccagtcaggttcagtggcaggtggctcgtgggactagacgttcactctcaccatcagcagcctgcagtctagagtntttgctagtttatactgtcagcaatntaatagcgtcgcctcgtagttcgctacgtttcggaccgtacgggaacctaggccgttggaagtactacgaaaccgtacgtcggttggactacgg

SEQ ID NO: 242708 - DNA, 522 bp, Homo sapiens
  misc_feature: GYAE6OF02F3YYQ.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttgccaggctccaggctcctcatctttggtgtgtccacgtacgggccgctggtctccagtcaggttcagtgcagtgctgtgggacagtagtcactctcacatcagcagcctgctagtctagagtatttgcttagtttatactgtacagtactaatataagtagcgtcgccgtcgtagttcgcttacgtttcggaccgtaggggaccctaaggtccgtaggaagtacgttaccgaaaacgtacgtacggtacggtctacgg

SEQ ID NO: 242709 - DNA, 664 bp, Homo sapiens
  misc_feature: GYAE6OF02ID8ZQ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaacttagcctggtaccagcaagaaagttggaccaggctccgaggctccctcattccgtttgggtgtcgttaccacgttacggggccgtcgtgggttcgtaccccgtaggttccaaggggtttccagggttcgggactagggttcggtccttcggtggggaacctagtacggtttccaccgttcctaccaacctataccgacgccaagcccttggcctaggtactggtaaagttagtttttcgacttaagtttttacttacgtgttaccgtaagtactaaattaataaacgttacgtaccgttacgggtacctaccggttaggttcgtaccgtttacgtttttaccgggacccgggtaacgggggtaaccctaagggtccgtaggaacgtacgtaaccgaaacgtaacgtggtacggtctaccgg

SEQ ID NO: 242710 - DNA, 765 bp, Homo sapiens
  misc_feature: GYAE6OF02JUY60.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttccctctgcttattcgtggtcctccgagtatactccacgtggaataaattaggtgtataggaaccgtctaacgtcctacccaacctactctgtctgttcgtcctaccggagggacagaccgccctaccgtctccgtgacggacggtacctagtccaaggtagttgttacgagtacgtacctaacgttcgtccggtaggtaccagtacgaaaggtaacggttcggacccacggtccctaccggacgtccttccctagtacgttttcgggtttcggtacgttccgtacccgtaacgggtccgggtccgtcgttcggtcctccgaggttccgtacggttcgaggtcgacgtaggtcgtctacggtaggacgtgttaaccgtctaacgtctaccgactaacgtcgagtcgaccgtcacggtactggtacctaaggacgtttacggttataccgtttaaagttttaaccgtcgttaacggtactacgtaacgtaaaccgtttagttaaacggtcgtaaccggttccggttacccgtacggtttagttaccgttaccggttttacgttaccgggtacccggaaacggggttaccctaaggtccggtaagtaccggttcctaaacggtccggttaaacgtttcgggtccgtacgtaacccgg

SEQ ID NO: 242711 - DNA, 575 bp, Homo sapiens
  misc_feature: GYAE6OF02IAL7N.35.85.H08.1.454.CMB.1.raw
  modified_base (318)..(318): a, c, t, g, unknown or other
  misc_feature (318)..(318): n is a, c, g, or t
tcagtacagatcgtcacgaccggtgctcgatttagtatcactcagtcgcgggggagaactgctcagttaggacccagacggaaccatggaagccccagcgcagcttctcttctcctgctattctggctccagatatcactggagaaatagtgatgacgcagtctccaaccactctgtctgtgtctccgaggggacagacgcctaccctctcctgccagggccagtcagagttgttagcagcaacttgcctggtaccagcaagaagttcggccaggctcccgaggctcctcattcgtttggtgtgtccacgtggggccnctggtcgtcccaggtcgaggttcaggttggcaggtcgctcgtgggacagtacgttccacttctaccgaccactcacgcgacgtccgtgtactagtcgtagtaagttagtttcgtacgttagtttaacttactagtactagtactaagttagtaactagtcgttacgtcctacgtagttcgacttacgtttcggaccgtacggggtacctacggtcgtaggtagtacgtacgtaaaccgtacgtaggtacggtcgtcg

SEQ ID NO: 242712 - DNA, 541 bp, Homo sapiens
  misc_feature: GYAE6OF02GHEWD.35.85.H08.1.454.CMB.1.raw
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccngtggtgtcccagtcaggttcaggtgcagtggctcgngggacagagttcactctcaccatcagcagcctgcagtcgtagaagtatttggctagtttattacgtgtacagtctaatataagtagcttcggccttccggagttcgacttacgttttggacccggtaggggaacccaaggtccgttagggacgtagtaccgtaaaccggtaacgttcggtacggtcgtaccgg

SEQ ID NO: 242713 - DNA, 577 bp, Homo sapiens
  misc_feature: GYAE6OF02JJBAV.35.85.H08.1.454.CMB.1.raw
  modified_base (260)..(260): a, c, t, g, unknown or other
  misc_feature (260)..(260): n is a, c, g, or t
  modified_base (301)..(301): a, c, t, g, unknown or other
  misc_feature (301)..(301): n is a, c, g, or t
  modified_base (356)..(357): a, c, t, g, unknown or other
  misc_feature (356)..(357): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
tcagtacagatcgtcacgaccggtgctcgatttagtatcactcagtcgcgggggaggaacgtggctcagttaggaccagacggaaccatggaagcccagcgcagcttctcttcctcctgctattctggctcccagatatcactggagaaatagtgatgacgcagtctccaaccactctgtctgtgtctccaggggacagagcccacctctcctgccgagggccaggtaccagagtgttagcagctaatacgctggtaccngcagtaagttgcaggcctccaggcctcgacatcgtttcggngtcgcctacgtcgggccgacttgggtcgtccccgaagtccgaggttcaggttcgnngtggctcgngggacngacttcgactcgtacacctatctagctagccgtcgcagtctagtattagttgtctagtttatacgttacgtcagtactaactatacgtaagttcgtcgtaccgtacgtacgttgtaccgttacgtttaccggccggttaacgggacctacgggtacttacgggaacgtacgttacgaaaccgtaacgtcggtacggtacgtaccg

SEQ ID NO: 242714 - DNA, 619 bp, Homo sapiens
  misc_feature: GYAE6OF02GXQ4S.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctctgctattctggctcccagatatcactggagaaatagtgatgacgcagtctccaaccactctgtctgtgtctccgaggggacagacgcccaccctctcctgcagggccagtcagagtgttagcagcaacttagcctggtaccagcaagaagttggaccaggcctcccgaggtcctccctctacttccgtttggtcgtcgtcccaacgtaggggccctcgttgggtcgtccccgaggttccagggttcaggttggctaggtcggtccttcgtaggggaactagggtacgttccaaccttcctaccaaccgtactaccgacgcacgccgtagcgtacgtctaggtaagttagttttcgacttagtttacttacgttcgtacacgtactaaagttataagtagtacgtcggtcctaccggtagttcgtccgttacgtttcggaccggtacgggaacctaaggtcgtaggtacgtacgtacgtaaaccgtacgtagttacggatacgg

SEQ ID NO: 242715 - DNA, 546 bp, Homo sapiens
  misc_feature: GYAE6OF02HI9BN.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattcgtttggtgtcgtccacgtaggggccgtctgggtcgtccccagtcaggttcaggtggcaggtggctcgtgggacagacgttcactctcaccatcagcagcctgcagtctgaagtatttgctagtttattactgtcagactaatataatgtcgtcgtacctcgtagttcgtaccgttacgttttcggaccggtaaggggtacctaagggtccgtagggtacgacgttaccgaaaccgtaacgttggtacggactacgg

SEQ ID NO: 242716 - DNA, 589 bp, Homo sapiens
  misc_feature: GYAE6OF02H3BQL.35.85.H08.1.454.CMB.1.raw
  modified_base (287)..(287): a, c, t, g, unknown or other
  misc_feature (287)..(287): n is a, c, g, or t
  modified_base (450)..(450): a, c, t, g, unknown or other
  misc_feature (450)..(450): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttgcctggtaccagcagaaagtggccaggcctcccaggctccctntattcgttttggtgttcgtcccacgtacgggccgtcgtggtcgtccccgtagtccgtaggttccaggttggcgtagtcgggctcggtagggacaaggtgttcaccgtctaccaccatcacgcacgcctgccagtctgtaagtatttgactagtttattacgtntacagtactaattattaatacgtacgttcgtaccctacgtacgttgtacgttaccgttttcgggaccggtaacggggtaccgtaagtacgttacgggaacgtacgtaacgaaacgtaaccggtggtacggtctaaccgg

SEQ ID NO: 242717 - DNA, 583 bp, Homo sapiens
  misc_feature: GYAE6OF02G13NK.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttgccaggctccaggctcctcatctttggtgtcgtccacgtagggcccgctgggtcgtccccgagtcgagggttcaggtggcaggtcggctcgtggggacaggtacgtttccacttctacaccatcagccagccctgacagtctaggaagttatttcgattacgttttattacgttgtaccagtactaattataaatacgtcttacgggtcccttcgagtttcgacttacgttttacgggacccgtaacgggggtaaccaacgggtcgttagggaacgtacgttaaccgaaaacggtaacggtggttacgggcttaccgg

SEQ ID NO: 242718 - DNA, 535 bp, Homo sapiens
  misc_feature: GYAE6OF02IE1RR.35.85.H08.1.454.CMB.1.raw
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
  modified_base (467)..(467): a, c, t, g, unknown or other
  misc_feature (467)..(467): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccacctctcctgcagggccagtcagagtgtagcagcaacttagcctggtaccagcaagaagtggccaggctcccaggctcctctattcttttggtgtgtccacgtagggccgcgtggtcgtcccgaggttcagggtttcaggttgggctaggtcggtcgtcgtgggacaggtagttcgactcctcacctatacagcagcctgcagtctgaagtntttgcttagtttattcgtntcagctaatataatgtctggcctactgttcngttacgtttcggccggtaagggacctaaggtcgtagagtacgtacgaaacgacgtcggtggtctacgg

SEQ ID NO: 242719 - DNA, 506 bp, Homo sapiens
  misc_feature: GYAE6OF02FIALR.35.85.H08.1.454.CMB.1.raw
  modified_base (409)..(409): a, c, t, g, unknown or other
  misc_feature (409)..(409): n is a, c, g, or t
  modified_base (454)..(454): a, c, t, g, unknown or other
  misc_feature (454)..(454): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtcgtccacgtacggggcccgcgttgggtcgtccccagtccgaggttcaggtggcaggtggctcgtgggacagtagttcactctcaccatcagcagcctgcagtctagaagtntttgctagttttattactgtcagcaattataatgtctggcctcgngttgtctctttggccgacgggacaggcgtggagagtacaagactgtggctcg

SEQ ID NO: 242720 - DNA, 695 bp, Homo sapiens
  misc_feature: GYAE6OF02IW6XJ.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccagtggggacagacgccaccctctcctgcgagggccagtcagagttgttagcagcaacttagcctggtaccagcagaaagttggccaggctccgaggctcctcattctttggtgttgtccacgtagggccgtcgtggtcgtcccgtagtcgtacgggtttacacggttcggcgtaggttcggtccgttcggtggggtaccgaggtacggtttctaccgttcgtaccaccctattccgaacgtccgaacgtcccgttggaccgtaggttacccgtaggtaaacgttaagtttttggtaccgtttaaggtttttttaacttaaccgttttacgttacctaaggttaacctaaatttaataaaacgtttagtccgttacgggtacccgtttaccgggttaaggtttccggttacccgtttaacgtttttaccgggacccgggtaacggggtaacccggtaacggtacggttacggggtaacggttaactaaacccggg

SEQ ID NO: 242721 - DNA, 709 bp, Homo sapiens
  misc_feature: GYAE6OF02GKSJV.35.85.H08.1.454.CMB.1.raw
  modified_base (262)..(262): a, c, t, g, unknown or other
  misc_feature (262)..(262): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctccagatatcactggagaaatagtgatagacgcagtctccaaccactctgtctgtgtctaccaggggacagacgccaccctctcctgcagggccagtcagagtgttagacagacaattacgcctggtaaccnggactaacgtaaagttcggaccacggtacctcccgaaggtcctactcagtttcgtttggtgtcggtaccacgtacggggccctaggttcggtcgtccccggtatcggtaacggttcaaggggttcgaactgggtcggccttacggacggggtaccagggtacgttttacgacccttcgtaccgaaccgacgttaccaacggtccgacgtccgttcgacgtcgtacgtagtaacgttagtttcgtacttacggttttactacgttgttaccgtaagtacctaaagttaacgtaaagttaccgtacgttaccgggtcccttaccggttaacggttacgtaccgttaccggttttacggacccgggttaacggggtaacccgtaacggtacccggttaggaaccgtaacgttaacgtaaaccggtaacggtacggtaccgtacgtaccgg

SEQ ID NO: 242722 - DNA, 575 bp, Homo sapiens
  misc_feature: GYAE6OF02I8OTI.35.85.H08.1.454.CMB.1.raw
  modified_base (364)..(364): a, c, t, g, unknown or other
  misc_feature (364)..(364): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctaggtaccagcaagtaaagttggccaggctcccaggcctcctcattctttggtgtcgtccacgtaggggcccgtctggtcgtccccgagtcaggttcaggtggcaggtggctcgngggacaggagttcactcctcgacctatcgagcacgcctgcagtctagaagtatttcgactagtttaacttattcgtctaacgtacgtaaatattaatagtcttacggtacctaccgtagttcgtaccgttacgttttcgggaccgtacggggaaccctaaggtccgtaggacgtacgtaaccgaaaccgtaacgttggtacggcgttacgg

SEQ ID NO: 242723 - DNA, 708 bp, Homo sapiens
  misc_feature: GYAE6OF02H6K3M.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccacctctcctgcagggccagtcagagtgttagcagcaacttagcctgtaccgagacgagaaagttggaccgaggcctaccgaaggctcccctactactttcgtttgggtgttcgtaccgacggttacggggcccgtcgttgggtcgttccccaggttcgtaacgggttccaaggttggcaaggttcgggtccttcggtaggggtaccaggtacgttaccgacttcttaccactactaccgtacgcctaacggtcccgtagccgtacgttcgtaggttaaaggttaagtttttcgtaacgtttaaggtttttaactttaacgtttgtaacgtacgttaaaccttaaagttaactttaaagtacgtacggttccggttacccgttacgacggtttacgtacgttacgtttttaccgggaccggtaacggggtaaccgtaacggacggtttaagggaacgttaccgtaaccgtaaaaccgtaacggtacggttacggtaccgtaaccgg

SEQ ID NO: 242724 - DNA, 524 bp, Homo sapiens
  misc_feature: GYAE6OF02HF8N0.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttgcctggtaccagcagaagttgcaggctccaggctcctcattctttggtgtgtccacgtacgggccgctggtcgtcccagtcaggttcagtggcagtggctcgtgggacagtgttcactctacacctatcagcacgcctgcagtctagtaagtagtttgactagtttattactgtctagtacaattataatacgtacgtggtcctacgtagttcgtcgttacgtttcggaccgtagggaccaaggtcgtaggagactacgaaacgtacgtggtaggctacg

SEQ ID NO: 242725 - DNA, 567 bp, Homo sapiens
  misc_feature: GYAE6OF02ICGNK.35.85.H08.1.454.CMB.1.raw
  modified_base (322)..(322): a, c, t, g, unknown or other
  misc_feature (322)..(322): n is a, c, g, or t
  modified_base (372)..(372): a, c, t, g, unknown or other
  misc_feature (372)..(372): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcacgggccagtcagagtgttagcagcaacttagcctggtaccagcaagaaagttggcaggcctccaggctcctctattcgtttggtgtcgtccacgtacggggccncgtgggtcgtccccaggttccgagggttccaggttggcaggtcgcttcgngggacagacgttcactctcaccatcagcacgcctgctagtctagaagtatttgtctagtttacttactgtacagtactaattagtaatagtcgttacgtcctcggtagttcgtctacgttttcggaccgtaacggggtaacctaggtacgttaggacgtacgtaacgtaaacgtaacgtcggtacggtcgtaccg

SEQ ID NO: 242726 - DNA, 721 bp, Homo sapiens
  misc_feature: GYAE6OF02IH17F.35.85.H08.1.454.CMB.1.raw
  modified_base (542)..(542): a, c, t, g, unknown or other
  misc_feature (542)..(542): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctgcctcccagatatcactggaagaaatagtgatgacgctagtcctaccaacctactcgtgtctgtgtctaccgaggggacagacgcccaccctctcgtgacgacgggccagtcaggtagttgttacgcagacctaacttacgccttcggaacctagacaaaggtaaacggttcggaccgaacggtcctacccgaacggccttccgtactacgtttcgttttcggtcgttcgtaccctaaccggtacgggtccgtcggttcggtaccgtcccgtaaggtccgtaaggttccgacggttggtaaccgtcggtgggccttcgggacgggtaacgtaacgttacggtttaccaccgttaccgttaccgaacctactacgcggacgtaccgtcctcgacgttaaccggttntacggtaaagtttcgtttcgacgtttaacgttttacttaccgtagtacgacgttaataaactaagttaaactacgtccgtacggtacccttaggtacgttccgttaaccgtttcgggtttaccggaccggtaacggggaacctaacgcggtagggtaacctaacgttaaccgaaacggg

SEQ ID NO: 242727 - DNA, 588 bp, Homo sapiens
  misc_feature: GYAE6OF02I4A9D.35.85.H08.1.454.CMB.1.raw
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (416)..(416): a, c, t, g, unknown or other
  misc_feature (416)..(416): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgcccaccctctcctgcgagggccagtcagagtgttagcgagcaacgttacgcctacggtaaccagccgaagaaaaggttcggcccgaggcctcccgnggcctcctcagttcgtttggngttcgtccacgtacgggccgtcgtggtccgtcccagtcgaggttcaggtggcaggtggtctcgtgggacagtacgttccactctacacactcacgcncgcctgctacgtactgagttagtttgtacttacgtttattacttgtacgtagtactaattataacgtagtcgtcgtccgtacgtagttcgtcgttacgtttcggaccggtaacgggtaccaggtcgtacggtaacgtacgtaacggtaaccgtaacgtcggtaggtcgtacg

SEQ ID NO: 242728 - DNA, 609 bp, Homo sapiens
  misc_feature: GYAE6OF02IQ1PN.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcgagggccagtcagagttgttagcagacaacttagcctaggtaccagacaaggaaagttcggaccaggcctcccaggcctcctcattcgttttggtcgttcgtccacgtacggggccgtcgttgggtcgtccccgagttccgagggtttcaaggttggactagggtggcgttcgtgggactaggtacgttccaccgttctccgaccatcacgctacgcctgctacgtctaggtaagttagttttgacttaagtttattacgttagtcagtactaattataagttagtacgttcgtccgttacgtacgttcgtacttacgtttacggaccggtaacgggaacctaggtcgtacggtaacgtacgtacgtaaaccgtacgtacggtacggtcgtacgg

SEQ ID NO: 242729 - DNA, 546 bp, Homo sapiens
  misc_feature: GYAE6OF02GJ0QE.35.85.H08.1.454.CMB.1.raw
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
tcagtacagatcgtcacgaccggtgctcgatttagtatcactcagtcggcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggccaggcctccgaggctcctcattcttggtntgtccacgtagggccgctggtcgtcccagtcaggttcaggtggcnggtggctcgtgggacagngttcactcncaccatcagcacgcngcagtctagaagttnttttgnttagtttattacgtcgttcagtactaattataaatcgtacgttcgtacccgttcgtagttcgtcttacgtttggaccggtaacggggtaacctaacggtggaagtataaccgaaacgtacgtaggtcggtactgtaacc

SEQ ID NO: 242730 - DNA, 709 bp, Homo sapiens
  misc_feature: GYAE6OF02JL0OB.35.85.H08.1.454.CMB.1.raw
  modified_base (236)..(236): a, c, t, g, unknown or other
  misc_feature (236)..(236): n is a, c, g, or t
tcagtacagatcgtcacgaccggtgctcgatttagtatcactcagtcgcgggggaggaactgcgtcagttaggacccagacggaaccatggaagccccagcgcagctctcttcctcctgctattctggctcccagatatcactggagaaatagtgatgacgcagtctccaaccactctgtctgtgtctccaggggacagagccaccctgtcctgccagggccagtcagagtgttancagcaacttgcctgtaccagcaagaaagttcgaccaggcctaccaggtcctccgtcattcctttggcgttcgtcccacggttacgggcccgtcgttgggtccgtaccccgagtccgagggttttccagggtcggctaggtcggtctcgtggggaccaggtcgttacacccgttctccgaaccctacgtaccgtacgtaccgtaacggtcccgttacggaccgtaacggttccgtacggtaaacgttacgtttttacggacgtttaacggttttaactttaaccgttcggttaccgtaacgggttacccttaaagttaacgtttaaacgttaaccgtacgttaaccggtccgtttaacccggtatttaccgggtacttaccggtttttcggaacccggtaacggggtaacctaacgggtaccgttggaacgtacgtaacggtaaaccgtaacggttcggtacggtccgtaacgg

SEQ ID NO: 242731 - DNA, 507 bp, Homo sapiens
  misc_feature: GYAE6OF02F9S6R.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtccccagtcaggttcagtggcagtggctcgtgggacagagttcactctcaccatcagcacgcctgcagtctagaagtattttgctagtttattactgtcagcaattataatagctggcctcgagttcgctacgtttgaccgaggggaccaaggcgtaggagactacgaaacgtacgtggtaggcgtacg

SEQ ID NO: 242732 - DNA, 709 bp, Homo sapiens
  misc_feature: GYAE6OF02HB9TY.35.85.H08.1.454.CMB.1.raw
  modified_base (156)..(156): a, c, t, g, unknown or other
  misc_feature (156)..(156): n is a, c, g, or t
  modified_base (241)..(241): a, c, t, g, unknown or other
  misc_feature (241)..(241): n is a, c, g, or t
tcagtacagatcgtcacgaccggtgctcgatttagtatcactcagtcgcggggaggaactgctcagttaggacccagacggaaccatggaagcccagcgcagctctctctctgctattctggctcccagatatcactggagaaatagtcgatgacncagtctccaaccatcgtgtctgtgtctaccgaggggacaggagcccacccgtctccgtgccgagggcctaagtcaagcgtgtacncagctaacttgcctggtaccagctaaggaagttcggacctaagggtccttacccgagggccctcctctaacttcgtttaggtcgtacgtaccgaccgttacgggccgtcgttcggtcgttaccccaggttccgtaaggttccaggtcggacgtaggtcggtctcgtcgggacagttacgtctaccgtctaccactacgtactacgacgtacgtaccgtgtactaacggtacgtacggtaacgttacgttttacggtaccgttaaggtttttaaccgttacgtttacggtccttaaacggtacctaaattaccgtttaaagttacggtaccgttaaccggtcccgttaccgttagttaccgtaccgtttacggtttaccgggtaccgtaaccggggtaacctaacggtccgttaacgggtaacgttacgaccgttaaaccgtacggtacgttaccgggagttaaccggg

SEQ ID NO: 242733 - DNA, 549 bp, Homo sapiens
  misc_feature: GYAE6OF02I6UW4.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcaagaagttggccaggctccaggcctccgtcattcgtttggtgtgtccacgtacgggcccgtcgtcgggtcgtccccgagttctagggtttccaggttcggcaggtcggctcgtgggacagagttcactctaccactatcagcagcctgcagtctagaagtatttgcttatttattactgtcagtactaatataatagtctcggtcctcgtagttcgtcctacgtttcggaccgtacgggacctaaggtcgtaggaagtacgtacgtaaaccgtacgtaggtcggtgtacg

SEQ ID NO: 242734 - DNA, 639 bp, Homo sapiens
  misc_feature: GYAE6OF02ISE0W.35.85.H08.1.454.CMB.1.raw
  modified_base (335)..(335): a, c, t, g, unknown or other
  misc_feature (335)..(335): n is a, c, g, or t
  modified_base (391)..(391): a, c, t, g, unknown or other
  misc_feature (391)..(391): n is a, c, g, or t
tcagtacagatcgtcacgaccggtgctcgatttagtatcactcagtcggcgggggaggaactgctcagttaggacccagacggaaccatggaagccccagcgcagcttctcttcctcctgctattctggcctcccagatatcactggagaaatagtgatgacgcagtctccaacactctgtctgtgtctccgaggggaccagacgcccaccctctcctgccagggccagtcagagtgttagcagctaacttacgcctaggtaccagcaagtaaaggttcgccaggcctaccaggcctcgtcattccgtttggcgtcgtccacggtacgggccgtntcgggtcgtacccaggtccgtacggttcaaggttcgggcctaggtggtcctacggngggactaggtcgttaccacgtctacacctatcagcacgtcgtgcgtacgtctaggtaaagtcgttttacggcctttaaggttttacttacgttgtaccgaagtaaccgttaaatttaacgtaacgttacgaccgttccgggtcctaccggttaagttcgtacttacggtttacggaccggtaacggggaacctaacggtccgtaaggtagaacgtacgtaaacggaaccgttggtcgtacgtaaccgg

SEQ ID NO: 242735 - DNA, 535 bp, Homo sapiens
  misc_feature: GYAE6OF02F677Z.35.85.H08.1.454.CMB.1.raw
tcagtacagatcgtcacgaccggtgctcgatttagtatcactcagtcgcggggaggaactgcttagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcattctttggtgtgtccactagggccgcgtggtcgtcccgagtcaggttcagtggcagtggctcgtgggacagtacgttcactctcaccatcagcacgcctgcagtctgagtatttgctagtttatactgtcagcaatataatagtcgtagcctcgagttcgcttacgtttggacccgtaggggtaacccaaggtccttagggacgtaacgtaccgtaaacggtaaccgttggtacggtacctcggtaccc

SEQ ID NO: 242736 - DNA, 761 bp, Homo sapiens
  misc_feature: GYAE6OF02I87HZ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccaccctctcctgcagggccagtcagagtgttagcagcaacgttagcctggtaccagacgaagaaagttcggaccaggcctacccgaggtcctaccttcattccgtttgggtcgtcgtacctaacgttacggggccgtcgttgggtcgtaccccgagttccgtaggtttccaaggttggacctaggttcgggtaccttcggtacggggaactaagggtaccttttaccgaaacctttccgtacctaaaccgtaacgtacccgtaaggaacccgaacggtcccgtgggtaaccctaaggtttaccgttaaggttaaaccggttaagttttttacggaacctttaagggtttttaactttaaccgttacggtaaccgtaacgttaaaccgtaaaatttaacgtttaaaacgtcggttaaccgttcggtaaccccttaccgggaaagtttttcgaaccggtttaccgttttacgggaacccggtaaggggtaaaccccaagggtccgttaaggaacgttaacgtaacgtaaaaccgaacgttcgggtacggtccgtaaccgg

SEQ ID NO: 242737 - DNA, 719 bp, Homo sapiens
  misc_feature: GYAE6OF02JQUM9.35.85.H08.1.454.CMB.1.raw
  modified_base (135)..(135): a, c, t, g, unknown or other
  misc_feature (135)..(135): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagntatcactggagaaatagtgatgacgcagtctccaacctactctcgtctgtcgtctccgaggggacaggacgcccaccctctcctgcacgggccagtcagacgtgtaacgcagctaacttacgccgtaggtaccagtccgaagtaaacgttcggacctacgggcctcccgaaggtcctacccgtacacgtttccgtttcgggttagcgttaccgtaaccggtcggggtcccgtcgtacgggttccgttacccccgagttccgtaggtttacgacggttcgggtcgacggttcggtccgttcggtacggggtacgtaacgggttacgttcccgaccgttttaccgaccgtaacccgtaagtccgtaacgccgtaacgtcccgttcgaactaacggtcgtaacggtacttaacggttttcaccggtttaatttacgttactttcggtactaaggtaccttaaagtaactttaaagaccgtcgttaccgttcccgttagtacgttgtaccttacgtttggacccgtaaggggtaccctagccgttaggaagttactaaccggaaacggtattcgggtataccggtacg

SEQ ID NO: 242738 - DNA, 600 bp, Homo sapiens
  misc_feature: GYAE6OF02G0HQI.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaacttagcctggtaccagcagaaagttggccaggctcccgaggcctcctcattcgtttggtgttcgtcccacgtacggggcccgtcgttgggtcgtccccgagttccgagggtttcaggttcgggcaggttggccttcgtgggactaggtacggttccaccgtctaccaccactcgacgcgacgccctggcctacggtctaggtaagttagttttcgacttagttttacttacgttgtactagtactaattataattacgtcgttacggtcctccgtaagttcgtcgttactttacggccgtaaccggggtaaccacggtacgtacggagtacgtacgtaaacgtacgtcggtcggctacg

SEQ ID NO: 242739 - DNA, 568 bp, Homo sapiens
  misc_feature: GYAE6OF02GLJN0.35.85.H08.1.454.CMB.1.raw
  modified_base (286)..(286): a, c, t, g, unknown or other
  misc_feature (286)..(286): n is a, c, g, or t
  modified_base (313)..(313): a, c, t, g, unknown or other
  misc_feature (313)..(313): n is a, c, g, or t
  modified_base (370)..(370): a, c, t, g, unknown or other
  misc_feature (370)..(370): n is a, c, g, or t
  modified_base (400)..(400): a, c, t, g, unknown or other
  misc_feature (400)..(400): n is a, c, g, or t
tcagtacagatcgtcacgaccggtgctcgatttagtatcactcagtcggcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctccncatctttggtgtgtccactaggggccncttgggtcgtcccagtcaggttcagtggcagtggctcgtgggacagtagttcactcncaccatcagcacgcctgcagtctagaagtnttttcgcttagtttattacgtgtacagtactaaattaactaattagacgttcggtaccctccggtaagtttcgacgttacgtttttcgggacccggtaacgggggtaacctaacggtcgttagggaagtaactaccgaaaccgtaacgttcggtacggtaccgtacgg

SEQ ID NO: 242740 - DNA, 594 bp, Homo sapiens
  misc_feature: GYAE6OF02I3HAQ.35.85.H08.1.454.CMB.1.raw
  modified_base (186)..(186): a, c, t, g, unknown or other
  misc_feature (186)..(186): n is a, c, g, or t
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (289)..(289): a, c, t, g, unknown or other
  misc_feature (289)..(289): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (392)..(392): a, c, t, g, unknown or other
  misc_feature (392)..(392): n is a, c, g, or t
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
tcagtacagatcgtcacgaccggtgctcgatttagtatcactcagtcgcggggaggaactgctcagttaggacccagacggaaccatggaagcccagcgcagcttctcttcctcctgctattcctggcctaccagatactcactggagaaatagtgactgacgcagtctccagccacctgtctgtntactccgaaggggacagccatcctctactgcnggccagtcagatactcggaaanacgtagtccnggtaccagcaagaacctggaccaggctccgagctccctnatctagtcggtcactctccaacggnggacccnggttacgactcccaagctacggttcaggtcgcaggtcgggtctgggaaccagtcttccgatccgtacaacngtcacgcaacgcctgaccagtctagaacttattacncggtacttagttaacnccgttaacgcggtactaggtaactttaacgttaactccggaacgtcgcccggtaatccgtttcccgtcgttccggggaacggtaccggtacggtaaggcggtaataaccgtaccggaagtcggttagccgggtaactacggacccttaag

SEQ ID NO: 242741 - DNA, 621 bp, Homo sapiens
  misc_feature: GYAE6OF02IEH1N.35.85.H08.1.454.CMB.1.raw
tcagtacagatcgtcacgaccggtgctcgatttagtatcactcagtcgcggggagagctctggggaggaactgctcagttaggacccagacggaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcatggtaccagcagaaagttggccaggcctcccgaggcctcctcacgttcgtttggtcgtcgtccacgtacgggccgtcgtcggtcggtcccaagtccgaggtttcgaggtcggctagtcggccttcgtgggaaccaggtacgttcgaccttcgtacacctagtcacgccacgccttgaccgtagtcgtagtaacgttattttacgttagttttacttacgttcgtacgtacggtactaaagtttataaacgtacgtacttcggacccgtttaccggtaggtttccggtactttaccggtttcggaacccgttaacggggtaccctaaggtcccgtagggtaacgttacgttaacgtaaacccgg

SEQ ID NO: 242742 - DNA, 636 bp, Homo sapiens
  misc_feature: GYAE6OF02GEFJR.35.85.H08.1.454.CMB.1.raw
tcagtacagatcgtcacgaccggtgctcgatttagtatcactcagtcgcgggggaggaactgctctagttaggacccagacggaaccgatggaagcccccagccgcagcttctcgttcctcctggctattctggctcccagatatcactggagaaatagtgatgacgcagtcgtccaaccgactcgtcgtactgttgtcctccaggggacagacgccacctctccctgcacgggccagtccacgtagtgttacgcagctaacttagccgtgggtaccaggaccaaggaaaggttcggaccaggcctcccaggtcctcctcattcctttgggtgtcggtccctacggtacggggcccgtcgttgggtcggttacccccaggttccgtaggtttaccaggttgggacctaggtcgggtctcggtgggaacagcgtttcacttcctcaccatcgagcagcctgctagtctagtaagtattttcgacttagttttattactggttacagtactaattattaagtgtacgttcgtccgttaccgtagttcgtacgtttacgttttcgggaccggtaacggggtacctaacggtcggtaggtaagtacgtaacgaaaccggtaacgtggtacggtcgtacgg

SEQ ID NO: 242743 - DNA, 683 bp, Homo sapiens
  misc_feature: GYAE6OF02I6OQO.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccacctctcctgcacgggccagtcagagtgttagcagacaacttagccttggtaccagcaagaaagttcggcctaggcctccccgaggtcctccctacacttccgtttaggtcgtcgtaccgaacgtacggggccgtcggtgggtcgtacccctaggttctacggttacgacggtcgggctaggttcggtcgtcggttacgggaacctaggtacgttcgtaccttcgtaccgaacctagtccaacggtcaacgtcccgtgtaccgtaggtcgtaagtaagtttactttcggatttacgtttaacgttacttggtacctaatacccgtaaattaacgttaaagtacggtcgtaccggtccgttaccgtaggttacgtactttaccggttttacggacccgggtaacggggtaacccgtaaggtacccggtggtaaacgtaacgtaccgaaaacgttaccggtacggttagggaccctaccgg

SEQ ID NO: 242744 - DNA, 567 bp, Homo sapiens
  misc_feature: GYAE6OF02IA7LS.35.85.H08.1.454.CMB.1.raw
  modified_base (138)..(138): a, c, t, g, unknown or other
  misc_feature (138)..(138): n is a, c, g, or t
  modified_base (144)..(144): a, c, t, g, unknown or other
  misc_feature (144)..(144): n is a, c, g, or t
  modified_base (152)..(152): a, c, t, g, unknown or other
  misc_feature (152)..(152): n is a, c, g, or t
  modified_base (157)..(157): a, c, t, g, unknown or other
  misc_feature (157)..(157): n is a, c, g, or t
  modified_base (165)..(165): a, c, t, g, unknown or other
  misc_feature (165)..(165): n is a, c, g, or t
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (183)..(183): a, c, t, g, unknown or other
  misc_feature (183)..(183): n is a, c, g, or t
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
tcagtacagatcgtcacgaccggtgctcgatttagtatcactcagtcgcggggaggaacgtggctcagttaggaccagacggaaccagtggagcccagcgcagctctctctctgctatctgctccagatagcatgganaaatgngatgacgntagcncacactcngtcngtntcacagggcangccacctntcgngcgagctagcagngtatancagtacaatcgctgacaganaagtaagngacacgctacgagctctnacttcgttgagtcaacgagtcgccgngtcgtccgaaccgtatcggtagtcaggtcgcgagtgtcgtcggtacggtacgtagtacgtacgtacgtacgtactactacgtacgacgacgacgacgacgtacgtacgtacgtacgtaagtacgttagtacgttacgtttagttaacgttacgtacgtacgtacgtaataataataacgtacgtacgtacgtacgtacgtacgtacgtacgttacgtacggtaacggtaacggacgtacgtacgtacgacgtacgaacgtaacgtacggtacgtacgtacg

SEQ ID NO: 242745 - DNA, 697 bp, Homo sapiens
  misc_feature: GYAE6OF02GER8V.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtcctccaaccactctgtctgtgtctccaggggacagagcccaccctctcctgcacgggccagtcagagtgtagcagcaacttagcctggtaccagcaagaaagttggccaggcctcccgaggcctcctcattcgtttgggtgtgtcccacgtacggggcccgtcgtgggttcgtccccgagtccgtagggtttccgaggtggcctagggtcggtacgttcgtacggggacctaggtacgtttccgaccgttcctaccacctaacgtccgaacgtaccacgtcccgtcggaccgtaacgttccgttaggaaacggttaagtttttggacctttaaggtttttaactttaacgtttgtaccgtaacgtaaccttaaattaaagttaaattacgtaccgttacggtacccgttaccggtaacggtttcggtacccgtttaaccggttttccgggaacccggttaaccggggtaacccgtaacggtaccggttaacgggtaacgtaacgttaaccgtaaaacccgg

SEQ ID NO: 242746 - DNA, 653 bp, Homo sapiens
  misc_feature: GYAE6OF02JKW4P.35.85.H08.1.454.CMB.1.raw
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaagttcgcaggctccaggctcctnatcttggngtcgtccacgtagggccncgtggtcgtccagtcgaggttcaggtggcaggtcgtcgtcgtagggacaggtacgttacacgttccgtccaaccgtactacgacgaccgtacgtacccgttggaccgtacgttacgtacggtaaacggtttacttttacggactttaacggttttacttaccgttaggtacccgtaagtacttaaagttaagtttaaacgtacgtccggtacggttacccgtacggtaacggttcgttaccgttacgttttcgggacccggtaacggggaaccctaaggtcccgttaagggaaccggtacgttaaccgtaaacggttaacgttcggtaccggttacgtaccgg

SEQ ID NO: 242747 - DNA, 557 bp, Homo sapiens
  misc_feature: GYAE6OF02FQ3EY.35.85.H08.1.454.CMB.1.raw
  modified_base (197)..(197): a, c, t, g, unknown or other
  misc_feature (197)..(197): n is a, c, g, or t
  modified_base (411)..(411): a, c, t, g, unknown or other
  misc_feature (411)..(411): n is a, c, g, or t
  modified_base (444)..(444): a, c, t, g, unknown or other
  misc_feature (444)..(444): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctactctggctccgaggaaccactggagaaacagtgatgacgcagtctccagccatcctgtctgtgtctccagggganagagccaccctctcctgcagggccagtcagactattagtaccaattagcctggtatcagcagaaacctggtcacggctacccaggcctcctcatctagtggtcgcactccaccgacgggccaacgttcggtaactccccgagccgtaggttcaggtggctaggtcgggtctggggacagtagttcactcctacgactatcacgcacgcctgacngtctgacgtgtatttgcttagtttacttacgtntcgtacgctattatagtattacgtcgtccgtcggtcggtaccgttcgccggaacggtccggtaaggtacggaacgtaccgaacgtacgttcgtcggcgtacgcgtactcttcg

SEQ ID NO: 242748 - DNA, 636 bp, Homo sapiens
  misc_feature: GYAE6OF02GDRR4.35.85.H08.1.454.CMB.1.raw
  modified_base (263)..(263): a, c, t, g, unknown or other
  misc_feature (263)..(263): n is a, c, g, or t
  modified_base (324)..(324): a, c, t, g, unknown or other
  misc_feature (324)..(324): n is a, c, g, or t
tcagtacagatcgtcacgaccggtgctcgatttagtatcactcagtcggcgggggaggaactgctcagttaggacccagacggaaccatggaagccccagcgcagcttctcttcctcctgctattctggctcccagatatcactggagaaatagtgatgacgcagtctaccaaccactctgtctgtgtctccgaggggacaggacgccgaccctctcctgcgagggccagtcagagtgttagcagcaacttagcctggtaccngcaagtaagtcggcaggctcccgaggctcctcattcgtttggctcgtccacgtagggcccncgtgggtcgtcccgagtcgaggttcaaggtggcaggtcggcgttcgtgggaactaggtacgttaccacgttcctaccgacctattccagcgacgtcctcgtacgtaacgtcctaggtaacgttagtttacgacttaacgtttaacttaacgttcgtacctaggtaacctaaagttacgtaaacgtacgtccgttaccgacccgtaccggttaagttccgaccgtttacgtttaccgggaccgtaacggggaacctaacggccgtaggaacgtacgtaacctaaaccggtacgtcggttacggtccgttacgg

SEQ ID NO: 242749 - DNA, 853 bp, Homo sapiens
  misc_feature: GYAE6OF02GUHNB.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcaagaaacgttggccaggcctcccgaggcctcctcacttcgtttagggtcgttcgtacccgtacgtacggggcccgtcgtcgggttcgtcccccgtaaggttccgtacgggtttccaagggttcgggaccgtaagggttcgggtaccgtttccggtacggggggtaaccctaagggttaacggttttacccgaacccgtttcccgtacccgtaaccccgtaacgttacccgaacggtacccgtaaccgggtacccgttacggtaccgttacgggttacccgtttaacgggttaaacggtttaacgtttttacgggtaccgtttaacggtttttaaacgtttaaccgtttacggtttaccgtaacggttaaccgttaaaacgtttaaacgtttaaacgttaacggttaccggttaccggggttaccccgttaccgggttaacgggtttaccgttaccgtttaccggtttttaccgggaacccgggttaacgggggtaacccgttaaacgggttaccggttaacgggtaaccggttaaccgttaacccggtaaaaccggttaaccggttacgggtttaccgggtaccgttaacccgg

SEQ ID NO: 242750 - DNA, 518 bp, Homo sapiens
  misc_feature: GYAE6OF02GM4DB.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggctcctcatctttggtgtgtccactagggccgctggtgtcccagtcaggttcagtgcagtggctcgtgggacagagttcactctcacatcagcacgcctgctagtctcgaagtattttagcttagtttacttactgtcagctaatataatagctcggtcctccgagttcgctacgtttcggccgtaggggaccaaggtcgtaggagtacgtacgaaacggtactcggtacggcgtacgg

SEQ ID NO: 242751 - DNA, 804 bp, Homo sapiens
  misc_feature: GYAE6OF02FE9NJ.35.85.H08.1.454.CMB.1.raw
tcagtacagatcgtcacgaccggtgctcgatttagtatcactcagtcgcggggagagctctggggaggaactgctcagttacggacccagacggaaccatggaacgccccagcgcagcttctcttcctcctgctattctggctcccagatatcactggaagaaatagtgatgacgcagtcctacccaaccactctgtctgtgtcctccgaggggacagacgccccacccttcctccctcgcgacggggccaggtcaggtagttgttagcagctaaacgttagcccgttaggtacccagacgaaggtaaacggttcggacccgagggtccctaccccgagggtccttccctactattttccgttttgggtgttcgttacccacgttacggggcccgtcgtcggttcgtcccgaggtcgtacgggtttaccaggttcggcgtaggtcgggtccttcggtcggggaactaggtacggtttccgtacctccgtaccaacccgtacttaccgaacgtaccgaccggtcccgtcggaccgtacggttccgttaagggttaacgtttaacgttttttacggtaccgtttaacggttttttaacgtttaacgtttacggttaaccgttaacggtaactttaaacgttaaacttaaacgttacggttaccgttaccgggttaccccgttacccgggttacggttttaccggtacccgtttacccgggtttttaccgggtacccgggtaaccggggtaacccgtaaccgggtaccggttacgggtaacggtaacgttaacccggtaaaacccgg

SEQ ID NO: 242752 - DNA, 720 bp, Homo sapiens
  misc_feature: GYAE6OF02IH3AF.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtcctccaaccactctgtctgtgtctccgagggacagcgccaccctctcctgcgagggccagtcagtagtgttagcagacaacttagcctaggtaccagacaaggtaacgttcggaccgaggtcctacccgaggtcctcctcgtacttcgttttggtcgtcgtccgtacgtcgggccgtcgttcggtcgtccccgtaggttccgtacggttacgacggttcggaccgtagggtcggtcgttacggtacggggactacggttacgtttccgaccttacctaccgaacctacgttcgaacgccgtaacgtcccgtaggaccgtaggttaccgtaggtaaacgtttacgttttacggtacttaacggtttttacgtttaacgttcgtacgtaacggtacttaaatttaacgtaagtacgttaccgttcggttacccgtacggttacgttcgtaccgtttaccggttttaccgggacccgggtaacggggtacctaacggttaccggtaggtaacgtacgtaaaccggtaaaccggtaacgttcgggtacggtaccgttacg

SEQ ID NO: 242753 - DNA, 551 bp, Homo sapiens
  misc_feature: GYAE6OF02HXVUF.35.85.H08.1.454.CMB.1.raw
  modified_base (292)..(292): a, c, t, g, unknown or other
  misc_feature (292)..(292): n is a, c, g, or t
tcagtacagatcgtcacgaccggtgctcgatttagtatcactcagtcgcgggggagaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagacgtgttagcagcaacttgcctggtaccagcagaagttgcaggctccaggctctcatctatggtncatccacagggccacgtcggtactcccgagccctaggttcagtggctaggtcgggtctgggactagagttcactctcactatcagcagctgcacgtctagattgtactttgacttagtttactacttgtctagtctattagtcgtaattaaccgtggtacccttcggtacggtaccgttacggaccgtaacgggtaccgtaagggtcggtaaccgtaccgtaacggtacgtacggttacggtactcggtacctaaccgg

SEQ ID NO: 242754 - DNA, 692 bp, Homo sapiens
  misc_feature: GYAE6OF02J2E5W.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgagggacagagtccaccctctcctgcgacgggccagtccagagttgttagcagactaacttacgcctggtaccagcaaggtaaacgttcggaccaacggtcctaccccgaggtcccttaccctcgtacgtttccgttttgggtcgttccggtaccaacggttaccggggcccgtcgttcgggtccgttaccccgtaggttccgtaacgggtttcgacgggttcggtaccgaggtttcggccttacggtcggggaaccaggttacgttccaccgttcacccgactactcgacgcgtacgtccgtagctacgttcgtaagtaacgtttgttttacgactttagtttactcgtgtacagtactaagttaacttaagtacgtcgttcggtacccttacggtagtttacgaccgttttacgtttcgggacccggtaaagggaccctaaacgggtcgttaacgggaactaaccgtaaccgtaaacggtactcgggttacgaccgttacg

SEQ ID NO: 242755 - DNA, 706 bp, Homo sapiens
  misc_feature: GYAE6OF02JRK6N.35.85.H08.1.454.CMB.1.raw
  modified_base (209)..(209): a, c, t, g, unknown or other
  misc_feature (209)..(209): n is a, c, g, or t
  modified_base (318)..(318): a, c, t, g, unknown or other
  misc_feature (318)..(318): n is a, c, g, or t
tcagtacagatcgtcacgaccggtgctcgatttagtatcactcagtcgcgggggagggaacgtgcgtcagttaggaccagacggaaccatggaagcccagcgcagctctctcctcctcgtctattctggctccagatatcactgagaaatagtgatgacgcagtctccaaccactctgtctgtgtctccgagggcagcgcctaccgtcncctgccgacgggccagtcgacgagtcgttaggcagaccaattacgccgtacggtaccgagaccgaagaaacggtttcggacccaaggtcctcccgaaggtcctaccccngtaactttcgtttggtcgttcgtacccgacgtacggggtcctcgttcgggcggttccccagggtctaacggtttcacggggttcgacgtcgggttcggtcctacgggtcgggtaaacagggttacgtttccaccgttcttaccgaccgtactacgacgcgaacgtccacggtacgtacgttcgtacggtaactcgttttacgcttaaggttttacgttaacgttcggttaccaggttaacctaagttaagttaaactcggttaccgttaccgttacccgttaacggtagtccgtacgtttccgtttacgaccgggtaaccgggtagtaacggtccggtaaggaagttaaccgaacgtaaacggtaccgttaacgggtcgtacgtaccg

SEQ ID NO: 242756 - DNA, 661 bp, Homo sapiens
  misc_feature: GYAE6OF02G2V8M.35.85.H08.1.454.CMB.1.raw
  modified_base (334)..(334): a, c, t, g, unknown or other
  misc_feature (334)..(334): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgccacgggccagtcagagtgttagctagctaactgcctaggtaccagaccaagaaacggttcggccaggcctacccgaggtcctccctcacttcgttggtgtcgtcctacgtcgggccncgtggtcgtccagtcaggttcagtggctaggtggtctcgtacgggacagtacgttcaccgtcctaccgaacctacgtaccgaacgcctaacgtcccgtagaccgttacggtacgtaacggtaacggttaacgttttcgactttaacggtttttactttaacggttactacgaataacgtttaaataagtttaagtccggtacgttccgtacccgtacggtagtttccgaccggttttacgtttccgggaccggtaacgggggtaacctaggtccggtaagtaaccgtaacttaaccggaaaccgttacgtcggtacggtactaccgg

SEQ ID NO: 242757 - DNA, 582 bp, Homo sapiens
  misc_feature: GYAE6OF02FXI5F.35.85.H08.1.454.CMB.1.raw
  modified_base (230)..(230): a, c, t, g, unknown or other
  misc_feature (230)..(230): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagngtgttagcagcaacttagcctggtaccagacaagaaaggttggccaggcctcccgaggcctccctctattcgttttgggtgtcgtccacgtacggggccgtcttgggtcgtcccgagtcgtaggttcaggtggcaggtggctcgtgggacagcgttcactctcacatacagcacgcctgcagtcgtagaagttattttcgacttaagtttacttacgttcgtacagtactaaattaataagtacgtccgttcggccctacggttagttcgacctttacggtttcggaccggtacggggtaaccacggtcgtaggagtaacgtaacgaaacggtacgtcggtacggtcctacg

SEQ ID NO: 242758 - DNA, 534 bp, Homo sapiens
  misc_feature: GYAE6OF02GFMD8.35.85.H08.1.454.CMB.1.raw
  modified_base (308)..(308): a, c, t, g, unknown or other
  misc_feature (308)..(308): n is a, c, g, or t
  modified_base (414)..(414): a, c, t, g, unknown or other
  misc_feature (414)..(414): n is a, c, g, or t
  modified_base (509)..(509): a, c, t, g, unknown or other
  misc_feature (509)..(509): n is a, c, g, or t
tcagtacagatcgtcacgaccggtgctcgatttagtatcactcagtcgcgggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccaggcctcctcatctttggngtcgtccactaggggcctcgtggtcgtcccagtcaggttcagtggcagtggctcgtgggacaggtagttcactctcacctatcacgcacgcctgcagtctagaatntttgcttagtttattactgtacagtactaattactaatacgctacggcctaccggtagttcgcttacgtttcggaccgtacgggaccgtaacggngtacggacgtacgtaccgtaaacgg

SEQ ID NO: 242759 - DNA, 670 bp, Homo sapiens
  misc_feature: GYAE6OF02G9MLN.35.85.H08.1.454.CMB.1.raw
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatgtgatgacgcagtctccaaccactctgtctgtgtctccgaggggacagagcccaccctctcctgcagggccagtcagagtgtagcagcaacttgcctggtaccagcagaaagttgccaggctcccgaggcctccnctattctttggngttcgtccacgtcgggccncgttggtcgtcccagttcaggtttcaggtcggcaggttcggctcgtggggaacaggtacgttccacgttcctacgaacctagtccgacgtccgacgtcccgtacggaccgtacggttccgtacggtaacgttacgttttacggacgttaacgttttaacttacgttcgttactacgtactaaagttaacgttaaagttacggtaccgttacggttacccgttaccggttacggtttcgtaccgttaccgtttttacgggacccggtaacggggtaaccctaaacgggtccgttacgggtaacgtaacgttaaccggaaaccggtaaccgttacgggttaccggtaccgtaccgg

SEQ ID NO: 242760 - DNA, 670 bp, Homo sapiens
  misc_feature: GYAE6OF02FR43U.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaagttgccaggcctcccaggcctcctctattcgtttggtcgtcgtaccacgtacgggcccgtcgttgggtcgtccccgtagtccgtacggtttccaggttcgggactaggttcggccttcggtaggggaacaggtacgtttccgaccttccgtaccacctagtaccgacggccgacgtcccgtgaccgtacggttcgtaaggtaaacgtttagttttacgactttaacggtttttaacttaacgttcgttacgaacgtactaaagttaacgttaaagttacgtacgttacggtacccgttaccggtagttaccgtacgtttacgtttacgggaccggtaacgggtaaccctaaggtccgttaggacgtaacgtaaccgtaaaccggtacgtcggttacggtcgtaccgg

SEQ ID NO: 242761 - DNA, 734 bp, Homo sapiens
  misc_feature: GYAE6OF02HVSW4.35.85.H08.1.454.CMB.1.raw
tcagtacagatcgtcacgaccggtgctcgatttagtatcactcagtcgcgggggaggactgctcagttagacccagacggaaccagtggtaacgccccagcgcagcttctcttcctacctgctattctggcctccagattagtcacgtggagtaaaccagttgattgtaacgcgagtctccgagccatcctgtcttggtgtctccgagggggagagacgcccacctctccgtgcgaggccagtcacgtacttagttacgtaaccaacgttacgccttagggtactaccgagaccgtaacgtaaaccgtggtacgaggccctaccgaggtccctacctacgtattaccgtagtacggtacgactacgtacccgaccggtagggacccctaggttcggttaccacccgacgtaccggtaggttacaggtcggacgtaggttcgggtacgtacgggactaggtacgttcccgacgttccgacctactacgtccaacgtaccgtaccgcctagaccgtacttcgtacgaagtttacgtttattttacgacgtttaagttttactacgtagttaccagttacctaagtttacgtagtaacgttaaccggtcgtaccgttaccgtacggttaccgttaccgggaaccggtaacgggtaaacccggtaacggtacggtaaaccggttaccgaaaccggttaccggttccggttaccggtaccgtcggtacccgtaacccgg

SEQ ID NO: 242762 - DNA, 576 bp, Homo sapiens
  misc_feature: GYAE6OF02G78ZT.35.85.H08.1.454.CMB.1.raw
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgttagcagcaacttagcctggtaccagacaagaaagttggccaaggcctcccgaggcctcctcattcgtttggtgtcgtcccacgtacgggtcccgcgttggtcgtccccgagttccgaggttcgagtcggcaggtggctcgngggacagnttcactcncaccancagcagcctgcagtctagaagttgtttgacttagttttatactgtcagataataatagtagtctagccgttcgtagttctacgttacggtttcggaccggtaaggggtaaccaaggtccggtaacggacgtaacgttaccggaaaaccggttaccgtacgggttacggaccgttacgg

SEQ ID NO: 242763 - DNA, 273 bp, Homo sapiens
  misc_feature: GYAE6OF02F6HSK.35.85.H08.1.454.CMB.1.raw
  modified_base (183)..(183): a, c, t, g, unknown or other
  misc_feature (183)..(183): n is a, c, g, or t
  modified_base (209)..(209): a, c, t, g, unknown or other
  misc_feature (209)..(209): n is a, c, g, or t
  modified_base (214)..(220): a, c, t, g, unknown or other
  misc_feature (214)..(220): n is a, c, g, or t
  modified_base (224)..(227): a, c, t, g, unknown or other
  misc_feature (224)..(227): n is a, c, g, or t
  modified_base (229)..(229): a, c, t, g, unknown or other
  misc_feature (229)..(229): n is a, c, g, or t
  modified_base (237)..(273): a, c, t, g, unknown or other
  misc_feature (237)..(273): n is a, c, g, or t
tcagtacagatcgtcacgaccggtgctcgatttagtatcactcagtcggtcgggggagaactgctcagttaggacccagacggaaccatggaagccccagcgcagcttctcttcctcctgctattctggctcccaggactgtggctgcaccatctgtcttcatcttcccgccatctgaaccgntctgtactgagcgggctggcaaggcncatgnnnnnnngctnnnnangtagcatnnnnnnnnnnnnnnnnnnnnnnnnnnnnnnnnnnnnn

SEQ ID NO: 242764 - DNA, 619 bp, Homo sapiens
  misc_feature: GYAE6OF02F34QI.35.85.H08.1.454.CMB.1.raw
  modified_base (287)..(287): a, c, t, g, unknown or other
  misc_feature (287)..(287): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttgcctggtaccagcaagaaagttggccaggcctcccaggctccctnattcgtttgggtgtcgtccacgttacggggcccgtcttgggtcgtccccagttcaggttcaggtgcaggtggctcgtgggactaggtacgttccacgttcctacgaacctataccacgcacgtcctgccagttcgtagtaagttagttttgcttagttttacttacgttgtactagtacgtaaattaataaacgtagtaccgttacggtcccgttacggtacgtttcgtaccgttaccgttttcgggacccggtaacggggtaacctaaggtccgttaagggtaacgtaacgttaccgtaaaaccggtacgttcgggtacggtccgtaccgg

SEQ ID NO: 242765 - DNA, 737 bp, Homo sapiens
  misc_feature: GYAE6OF02H55WF.35.85.H08.1.454.CMB.1.raw
  modified_base (234)..(234): a, c, t, g, unknown or other
  misc_feature (234)..(234): n is a, c, g, or t
tcagtacagatcgtcacgaccggtgctcgatttagtatcactcagtcggcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccctaccctctcctgccgagggccagtcagngtgtagcagcaaacttgcctggtaccagcaaggtaaagttcggccacgggctcccgaggcctcctactagttcgtttggcgttcgtcccaaggtcgggccgtcgttgggttccgtccccgtaggtcgtaacggtttcgaacgggttggccgtaaggtcgggtccgttcggtaggggaactagggtacgtttaccctacgttcctacccaacctagttaccgacgccgtaacggtcccgtaggtccgtacgttaccggtagtaaacggtttaactttttcggtaccgtttaaggttttaactttacgttacgttaccgtaacgtaactaaacgtttaagtttaaacgttaacggtccgttaacggtcccgttaccgggtaaacggtttcgttaccgtttacggttttaccggggacccgggtaacggggtaacccgtaaggtacggtacggaacggtacgtaaccggtaaaccggttaaggttacggtacgggtacctaaccgg

SEQ ID NO: 242766 - DNA, 528 bp, Homo sapiens
  misc_feature: GYAE6OF02ID2RV.35.85.H08.1.454.CMB.1.raw
  modified_base (315)..(315): a, c, t, g, unknown or other
  misc_feature (315)..(315): n is a, c, g, or t
  modified_base (505)..(505): a, c, t, g, unknown or other
  misc_feature (505)..(505): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaacttagcctggtaccagcagaaagttggccaggctccaggctcctcattctttggtgtcgtccagtagggccgntggtcgtcccagtcaggttcaggtggcaggtggcttcgtggggactagacgtttccacgtcctcaccctatcaagccagccctgcagtctgaagtattttgcttagttttattacgtgtacagactaaatataaatgacttcggcctccgtagttgcttacgtttcggaccgagggaccaaggctggaanataccgaaacgactgtcggctcg

SEQ ID NO: 242767 - DNA, 777 bp, Homo sapiens
  misc_feature: GYAE6OF02IVDCA.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctaccaaccactctgtctgtgtctcgagggacagagcccacctctcctgcacgggccagtcagagttgtagcagcaacttagcctaggtaccagcaagaagttggaccaggcctacccgaggccttccctctactttcgttttgggtgttcgtaccctaacggttacggggcccgtcgttcgggttcgtaccccgtaagttccgtacggtttccgaagggtcggtacccgtagggtttacgggaccgtttcggtaacgggggtaaccctaagggtaaccgttttaccgaaccctttcccgtaacccaaccccgtaactaccgtacggccaacggtcccgttgaccgtacgttacgtaggtaaacggtttatttttacggtacgttttaacgttttaatttaccgttacggttacctaagtaccgttaaaagttaacttaaagtttaacggtcgtttaaccgggtcccgttaccggttaaccggtttcgtaccgtttacggtttttaccgggtacccgggtaacgggggtaaccctaaggggtaccggtaccggtaaaggttaaccgttaaccggaaaccggttaacggttcggttaccgggtccgtaacccgg

SEQ ID NO: 242768 - DNA, 667 bp, Homo sapiens
  misc_feature: GYAE6OF02F8LMW.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggcaggctccgaggctcctcatcgtttggtgtcgtccacgtagggccgctggtctcccgagtcaggttcaggtggcagtggcttcgtgggacaggagtttccaacgttcctacgacctatacgagacagtaccgttcggctacgttctaacggtaaagttagttttttacgacgtttaacggtttttaaactttacgtttacgttacgtaacggttaacaaaatttaattaaaacgttaaggtccgttaacgggtcccgttaaccggttaacggtttaccggtaaccgtttaccggtttttacgggacccggtaaacggggggtaacccgtaaacggtaccgtaagggtaacgtaaacgtaaccgtaaaaccgggtaccgtagggtacggtacgtaccgg

SEQ ID NO: 242769 - DNA, 542 bp, Homo sapiens
  misc_feature: GYAE6OF02FTLSZ.35.85.H08.1.454.CMB.1.raw
  modified_base (393)..(393): a, c, t, g, unknown or other
  misc_feature (393)..(393): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctcgtgggacagagttcactctcaccatcagcagcctgcagtctgaagtntttgctagtttattactgtcagtctaatattaatagtctggtcccttacggtagtttcgccttacgttttcggaccgtacggggtaacctaacggtccgttaggaagtacgtaccgtaaaaccgtaacgtcggttaggtaccgtaccgg

SEQ ID NO: 242770 - DNA, 564 bp, Homo sapiens
  misc_feature: GYAE6OF02GQPAS.35.85.H08.1.454.CMB.1.raw
  modified_base (314)..(314): a, c, t, g, unknown or other
  misc_feature (314)..(314): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgccagggccagtcagagtgttagcagctaacttagcctggtaccagcaagaagtggccaggcctccgaggctccctcattcgtttggtntcgtccacgtacggggcctctggtcgtcccagtcaggttcaggtgcgaggtgcttcggtggactaggtacgtctactcctacacctactcagcacgcctcgacgtgtcgtagtagttagtttcgtacgttagtttacttacttgtactacgtactaataataacgtagtcgtacgtccgtacgtagttcgtactacggtttcggaccggtacgggtaacgtacggtcgtaggacgtactaacgtaaacgg

SEQ ID NO: 242771 - DNA, 758 bp, Homo sapiens
  misc_feature: GYAE6OF02IQ63I.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccaccctctcctgcagggccagtcagagtgtagcagcaacgttagcctaggtaccagacaaggtaaacgttggtaccagggtcctacccgaggtcctcctctattcgtttggtcgtcgtcccaggtacgggtcccgctgggtcgtcccctaggtccgtaggttccagggttcggactagggttcgggcttcggtacggggaacctaggtacgtttccgaaccgttccgtaccgaacccgtacgttaccgtaacggtaccgtaaccggtcccgtcggtaccgtacggttaccgtacgggtaaacgttacgtttttacggtaccgtttaacgtttttaacgtttacgtttacggtaccggtagtaaccgtaaagttaaacgttaaagttaacggtaccgttaccgggtacccgttaccggttacggtttaccgtaccgttaccggtttttaccgggtacccgggtaacgggggtaacccgtaacgggtaccggttacgggtaacgtaacgtaacccggtaaaccggttaaccggtagggttaccggtaccgttaccgg

SEQ ID NO: 242772 - DNA, 776 bp, Homo sapiens
  misc_feature: GYAE6OF02JHHVH.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcgagggccagtcagagtgttagcagctaacttagcctggtaccagcaaggaaagttggccaggcctcccgaggcctcctcacttcgtttgggtgtcgtccacggttacggggcccgtcgttcgggtcgtccccgagttccgtaggtttccgaggttcgggacgtacgggtcggtccttcggtagggacagggtacgtttccgaccttccgtacctaccctacttccgacggtacctacggtaccctggaccgtacggttacgtaacggtaaacgtttacgttttacggtacctttaaggtttttaacctttacgtttacggtttaccgtaaacggttaaccttaaaagtttaaacgtttaaacgtttaaccggttacccggtttaccgggttaacccccgttaccggttacggtttaccgttacccgtttacgggtttttaccggggacccgggttaaaccggggggtaacccttaaacgggtcccggttaagggtaaccggtaaccttaaaccgggttaaaaccggtaaccgggttcggtaccgggttactaaccccggg

SEQ ID NO: 242773 - DNA, 607 bp, Homo sapiens
  misc_feature: GYAE6OF02IU558.35.85.H08.1.454.CMB.1.raw
  modified_base (318)..(318): a, c, t, g, unknown or other
  misc_feature (318)..(318): n is a, c, g, or t
  modified_base (341)..(341): a, c, t, g, unknown or other
  misc_feature (341)..(341): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccacctctcctgcagggccagtcagacgtgttagcagcaacttagcctggtaaccaggtcaaggtaaaaggttcggaccaggacctacccgaggtcctccgtctattcgttttggngttcgtaccacgtacgggccgtntgggtcgtacccaggtctagggttcaggttggctaggtggctcgngggacngattcactctacacatcacgcacgtcctgcgacgttcgtacgtaagttatttcgtacttagttttattaactgtacgtagtactaaattaataagttagtacgtcggtccttacggtagttacgtacgttacgttttacggaccggtaacgggacccgtaaggtaccgtacgggaacgtactaacgtaaaccgtacgtacggtcggtactaccgg

SEQ ID NO: 242774 - DNA, 660 bp, Homo sapiens
  misc_feature: GYAE6OF02INNZ9.35.85.H08.1.454.CMB.1.raw
  modified_base (230)..(230): a, c, t, g, unknown or other
  misc_feature (230)..(230): n is a, c, g, or t
  modified_base (354)..(354): a, c, t, g, unknown or other
  misc_feature (354)..(354): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtcctccgagggacaggacgcccaccctctcctgcagggccagtcagngtgtagcagacaacttgcctggtaccagcaagaaagttcggccgaggcctcccgaggtcctcctcacgttctttggtcggtcgtccctacgtacggggcccgtcgtcgggttcgttacccccgnggttaccgacggtttacctagggtcgggtacctagggtcggtcccgttcggttaggggaaaccgtaggtacggtttcaacccgttcctaccgacctatccgaagtccacgtcctgctacgtcgtagaagttagtttgacttaggttttacttacgttcgtacacgactaagttaattaagtagtccgtcggtacccttcggtacgttcgtaccgttacgttttcggacccggtacggggtaaccctaagggtccggtagtaacggtaccgtaacggtaaacccgtacggtacgtcggtacgtccgg

SEQ ID NO: 242775 - DNA, 610 bp, Homo sapiens
  misc_feature: GYAE6OF02JGHBR.35.85.H08.1.454.CMB.1.raw
  modified_base (258)..(258): a, c, t, g, unknown or other
  misc_feature (258)..(258): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagacgtgttagcagcaacttagcctaggtaccngcaagaaacgttggccaggtctcccaggcctctcacgttcgtttggacgttcgtcccaagtcggggcccgtcgttcgggtcgtccccgaagtccgtacggtttcgaacggtggtacgtggtacgggtctcgtggggaactaggtagttccacgttctacaccgtatccgagtcacgcgtcgctagtactaggaattacgtttgtcgttagtttacgttactttagtacagtacctaagtaactaattaggtacgttcggtccgtacggtagttcgtcgttacgtttcggacgttaacggggaacctaggtcggtacggaagtacgtacgtaacgacggtcgtacggctacgg

SEQ ID NO: 242776 - DNA, 539 bp, Homo sapiens
  misc_feature: GYAE6OF02GI5K2.35.85.H08.1.454.CMB.1.raw
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
  modified_base (430)..(430): a, c, t, g, unknown or other
  misc_feature (430)..(430): n is a, c, g, or t
  modified_base (528)..(528): a, c, t, g, unknown or other
  misc_feature (528)..(528): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtcgtccgacgtagggccgcgttggtcgtccccagtcgaggttcaggtcgnaggttgctcgtgggacngagttcactctcacatcagcacgcctgcacgtcgtagaagttcttttgcttagtttattactgttnagtactaattattaaacgtagtactcggtaccttccgtagttcgacttacgtttcgaccggtagggacctaaggcgtaggactatacgaaacggtacnggtcgactacg

SEQ ID NO: 242777 - DNA, 576 bp, Homo sapiens
  misc_feature: GYAE6OF02II0LA.35.85.H08.1.454.CMB.1.raw
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagtgccaggctcccaggctcctcatctttggngtgtccactagggccncgtggtcgtcccagtcaggttcaggtcggcaggtcggctcgtgggacaggtacgttcaccttctaccgacctatccacgcaacgtcctgcctaagttcctaggaagttagttttgacttagttttacttaacttcgtactagtactaaagttataatagcgttcggtaccctccggtagttcgtaccttacgttttcgggaccggtagggtaacccaaggtccgtaggaaggtactacgtaaaccggacgttggtacggactccgg

SEQ ID NO: 242778 - DNA, 671 bp, Homo sapiens
  misc_feature: GYAE6OF02IPWHN.35.85.H08.1.454.CMB.1.raw
  modified_base (201)..(201): a, c, t, g, unknown or other
  misc_feature (201)..(201): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagngcccaccctctcctgcgagggccagtcagagtgttagcagcaacttagcctaggtaccagcaagaaaggttggccgaggcctcccgaggtcctccctctactttcgtttggtcgttcgtacccgtacggtacgggtcccgtcgttcggtccgtcccgtaggtcgtaggttcgaggtggcgtaggtcgcgtcgtagggactaggtacgttctaccttccgtaccacctactacgacgtaccgacgtccgtagacgtacgtacgtaggtaattagtttacgtagtttaacgtttaacttacgtacgtacgtaacgtaacgtaaattaagtaacgtacgtacgttccggtacccgttacgtcgttacgttaccgttacggtttcgggaacccggtaaggggtaacccctaaggtccgttacggtaacgtacgtaaaccgtaaccggtaacggttcggtacggtaccgtaccgg

SEQ ID NO: 242779 - DNA, 727 bp, Homo sapiens
  misc_feature: GYAE6OF02H0Q3A.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgccacgggccagtcagagtgttagcagcaacttagcctggtaccagacaagaagtcggccaggcctccgacggtctccctctattcgtttggtctgtcccaacgtacgggccgtcgttcggtcgtcccagttcgacggttacacggtagggcctagggtcgggacttcggtacggggaactacggtagttccaccgttcctaccgacctaactcgtaacgaccgacgtcccgtcgccgtacgtccgtaaggtaagttacgttttacggtacttacggttttaactttacgttacggtacgtaacgtaacgttaaacgtaacttaaacgttaacgtaccgttaaccggtacccggttaccggttacggttttaccgtaccgtttacccggtttttacgggaacccgggtaacgggggtaaaccccttaaggggtaacccggttagggaacggttaacggttaaacccgaaaaccggttaaccgggttacggttaccgggttaccgttaacccgg

SEQ ID NO: 242780 - DNA, 554 bp, Homo sapiens
  misc_feature: GYAE6OF02I6EPY.35.85.H08.1.454.CMB.1.raw
  modified_base (318)..(318): a, c, t, g, unknown or other
  misc_feature (318)..(318): n is a, c, g, or t
  modified_base (421)..(421): a, c, t, g, unknown or other
  misc_feature (421)..(421): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcgagggccagtcagagtgttagcagcaacttagcctggtaccagcagaaagttggccaggctcccaggcctcctcattcgtttggtgtcgtccacgtacgggccnctggtctcccagtcaggttcagtggctaggtggctcgtgggacaggagttccactcctccaccatcagcacgcctgcagtctagaagtagtttgcttagtttnttacgtgtctagctaatagtaatgtcgtcgtccgtcgagttcgacttacgttttcggaccggtacggggtaacctaaggtccgtaggtacgtactaacggtaaaccggtacgtacgggttacggacgtaccgg

SEQ ID NO: 242781 - DNA, 541 bp, Homo sapiens
  misc_feature: GYAE6OF02JIMFC.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcagaaagttggccaggctccaggctcctcattcttggtgtcgtccacgtacgggccgctggtcgtcccgagtcgaggttcagttggcagtggctcgtgggacagtagttcactctcacctatcagcagcctgcagtctgaagtatttgacttagtttattacgtgtctagctaattataagtagtcttggtaccctcgtagttcgtcttacgtttcggaccggtaacgggtaccaacggtccgtaggtagtaacgtacgaaacgtacgtcggtaggactacgg

SEQ ID NO: 242782 - DNA, 617 bp, Homo sapiens
  misc_feature: GYAE6OF02JLNZ8.35.85.H08.1.454.CMB.1.raw
  modified_base (418)..(418): a, c, t, g, unknown or other
  misc_feature (418)..(418): n is a, c, g, or t
  modified_base (443)..(443): a, c, t, g, unknown or other
  misc_feature (443)..(443): n is a, c, g, or t
  modified_base (471)..(471): a, c, t, g, unknown or other
  misc_feature (471)..(471): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctcaaccatctgtctgtgtctccgaggggacagacgcccaaccctctcctgcacggggcccagtcaggacgtgttagctagcaacttagcctggtaccagacagaaaaggttggaccagggacctcccgaacggcccttcctacgtacttcttttgggtcgttcgtcccgacgtacgggtccgtctgggtcgtccctagtcgtaggttcctagtcggcctaggtcgtacgtcgtcgggacgngtacgttcaccgtctaccgacactnagtacagcctagctagtcctagaacgtnttttacgacgttagtttattacttgtctacgtacgtaattaacgttattaacgcttaggtccttaccggtagttcggtaccttagttttacggacccgtaaggggtaccctaacggtcgttacgggacgtacgttactaaaccggg

SEQ ID NO: 242783 - DNA, 677 bp, Homo sapiens
  misc_feature: GYAE6OF02ICOMU.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcgacgggccagtcaggtagtgttagcagactaacttgcctaggtaccaagcgaagtaaaggttcggaccacggtcctcccgaggtcctcccgtactagttcgtttcggtggttcgtaccgtaacggtacgggccgtacgtgggtccgtacccgagttcgtacggttcgaggtcggcgtaaggtcggtcgttcggtagggactagtagtacccgtactcctacccgacctactaccgacgaccacgtccgtcgctacgtacgttagtaacgttacgttttacggatttaacgtttaacttacgtagtacgtacgtactaaacttaagtaacgtacgtaccgtccggttacctacgggtacgttacgtaccgtttacggtttacgggaccggaacggggtaacctaggtaccggtaggtaatacgtaaccggtaaacggtacgttcgggacgtccgtaccgg

SEQ ID NO: 242784 - DNA, 779 bp, Homo sapiens
  misc_feature: GYAE6OF02JHQCW.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagacaacttagcctggtaccagacaagaagttggaccaggcctccaggcctcctcacttccgtttggtgtcgtcctacgtacgggcccgcgtgggtctccccgtagtcgacgttaccgaggtggactaggtcgggtcctcggtggggactaggtagtttaccgacttccgtaccaacccgtactaccgtacggacctaacggtcccgttacgtaccgtacgggttaccgtaacggtaaaccggtttaggtttttaccggacgttttaaacggttttttaagtttacccgtttacggttaccgttaacggaaacctttaaactttaaacgtttaaaacttaaccggttaccggtttccggggttacccgtttaaccggtttaacggtttacggttaaccctttagggttttttacccgggtaacccgggtaacggggggtaaacccgttaaacgggttacccggtttaaggggaaccggttaacggttaaaccggtaaaacccgggttaaccggttacgggttaccgggtaccgtttaacccggg

SEQ ID NO: 242785 - DNA, 661 bp, Homo sapiens
  misc_feature: GYAE6OF02GCJ45.35.85.H08.1.454.CMB.1.raw
  modified_base (227)..(227): a, c, t, g, unknown or other
  misc_feature (227)..(227): n is a, c, g, or t
  modified_base (432)..(432): a, c, t, g, unknown or other
  misc_feature (432)..(432): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagngtgttagcagcaacttagcctggtaccagcaagaaagttggaccagggcctcccaggcctcctcattctttgggtgtcgtccacgtacgggccgcgtgggttcgtccccgagtccgtaggttccaggtgggctaggtcggcgtcgtgggaccgaggtacgttcaccttcctaccaccatcagcacgcctgctagtctagtaagtnttttagctttagttttaacttacgttcgttactaacggtactaaagttaacttaaagttacggtacgttacggtacccgtttaccggttaacgtttacgtaccgttttaaccgttttccggggtacccggttaaccggggggtaacccgtaaacggggtaccgttacggggtaacggaacgttaaccggaaaaccggtaccggttaggggttaccggtacgttaaccgg

SEQ ID NO: 242786 - DNA, 633 bp, Homo sapiens
  misc_feature: GYAE6OF02HBVPW.35.85.H08.1.454.CMB.1.raw
  modified_base (230)..(230): a, c, t, g, unknown or other
  misc_feature (230)..(230): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacaggagcccaccctctcctgcaggccagtcaggntgtagcagcaactgcctggtaccagcgagaaggttggccaggcctccgaggccttccgtcacttcgtttgggtcgtcgtccgtacgtacggggcctcgttggtcgtccccgaggtccgacggttcgaggtcggctaggtcggcttacggtgggaactggtacgttccgacttcctacacctagtccgagccaacggtccctcgacgtacgttcgtacgtaagttacgttttcggactttagttttacgttacgttcgtaacgtacgtactaaagtacgttaaacgtgtacgttccggtaccttccgtaggttcgtacgtttaccgtttcgggaccggtacgggtaacctaacggtcgtacggaatacggtaaccgaacggttacgttcggtacgtgtaaccgg

SEQ ID NO: 242787 - DNA, 532 bp, Homo sapiens
  misc_feature: GYAE6OF02FJTXV.35.85.H08.1.454.CMB.1.raw
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
  modified_base (397)..(397): a, c, t, g, unknown or other
  misc_feature (397)..(397): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcatctttggtntcgtccacgtagggccntggtcgtcccagtcaggttcagtggcaggtcggctcgtgggacagattcactctcaccatcagcagcctgcagtctagaagtntttgctagtttatactgtcagctaatataatagtctcggcccgcgtcttccgttcgtttcgggacggtacgggtaccgtaagggtcgggaagtaagtaacgtaaaaggtacgtaggtaggctacggactaacccg

SEQ ID NO: 242788 - DNA, 584 bp, Homo sapiens
  misc_feature: GYAE6OF02FWO9M.35.85.H08.1.454.CMB.1.raw
  modified_base (244)..(244): a, c, t, g, unknown or other
  misc_feature (244)..(244): n is a, c, g, or t
  modified_base (429)..(429): a, c, t, g, unknown or other
  misc_feature (429)..(429): n is a, c, g, or t
  modified_base (500)..(500): a, c, t, g, unknown or other
  misc_feature (500)..(500): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggacncccatgctgcagtcggccagaggtgcccctgaacctgaaggccaatgagacccaagacaggccaaggtgggttgtggacgacccctggacggagcgtgggccctggtcccaggcagcgcgtcggcccctgctgcgtgcgttgggtcctcgggccagtcgggtcgcccgagtcggcctgctcgccnccgagtggtcgcaccgcgaacggccgggaccacggaccctggaccgcctcgagttagacgcgacgccgacnccgacgtcccgtcggccggtacgtccggtcgggtcggggacgtacgggtaccgacggaccccgaaccggacccctaacccccgg

SEQ ID NO: 242789 - DNA, 762 bp, Homo sapiens
  misc_feature: GYAE6OF02IX0NC.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcacgggccagtcagagtgttagcagcaacttagcctaggtaccagacaaggaaacgttggcccaggcctccccgaggtcctcccgtactacgttcgttttgggtcggttcgtacccgtacggttacggggcccgtcgttcgggtacgtccccctaggttccgaacgggtttccgaagggtcggccgtaggttcgggtaccttccggttaggggaaaccctagggttaccgtttaccgaccgttcccgtacacccgtactccgtaacggaccgtacgcccgtacggacctacgttacgtaagaagtttacgttttacggacgtttaaggttttaactttacgttacggtacctaacggtaccttaaagttaacgtttaaacgtacggttaccgtaccggtacccgttacccggttagtttacgtaccgtttaccggttttcgggaacccgggtaacgggggttaacccgtaacgggtaccggttagggtaaccgtaacggttaaccggtaaaaccgtaccggttaagggttaccggtaccgttaaccgg

SEQ ID NO: 242790 - DNA, 529 bp, Homo sapiens
  misc_feature: GYAE6OF02G1G5D.35.85.H08.1.454.CMB.1.raw
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagtgcaggctccaggctcctnattcttggngtgtccacgtagggccgtcgtggtctcccagtcgtaggttcagtcggcagtggctctgggacagagttcactctcaccatcagcagtcctgcagttcgtagtaagtattttcgactagttttaattactgtcagtcaaatataaatgtctggtcctacgtagttcgcttacgtttcggaccgacggggtaacctaggtcgtaggacgtaatacgaaacgtactcggtaggtctacg

SEQ ID NO: 242791 - DNA, 876 bp, Homo sapiens
  misc_feature: GYAE6OF02GLXL9.35.85.H08.1.454.CMB.1.raw
tcagtacagatcgtcacgaccggtgctcgatttagtatcactcagtcgcgggggaggaacgtggctcagttaggacccagacggaaccatggaagccccagcgcagcttctcttcctcctgctattctggctcccagatatcactggagaaatgtgatagacgcagtctaccaaccactctgtctgtgtcctaccgaggggacaggacgccacccctctcccgtgcctaagggccccagtccgagaggttcgttaagcagtacccaaacttacgcctagggtaacccagaccgaaggtaaaacggttcggacccgaacgggtctaccccgagggtacctacccttccgtaaacgttccgttttacggggttcgtttaccggtaccccgtaacgttaaccggggggccccgttcggttacccggggtttcggttaccccccagggtttacccggtacgggtttacccggtaaggttccggggaccgtaacggggtttcggtcccggtcggtttacgggggacctaggggttaccgttaccgtaaccgtttccaaccgtacccgtacgtacctaaccggtaccgtaacggtacccgttcggaccgttaacgggttcccttaaggtaaacggtttacgtttaacgggtaccctttaagggtttttaaccgtttaacgttagttttaaccgaacggttaaccgttaaagttaaaccgttaaacgttaacgttaccggttacggtacccccgttaggttaaccgttacggtacccgttacgggtttttaccggacccggttaacggggaaccccgttacggtaaccggtacggtacgtaacgtaaccgtaaacggtaaccgttacgggtcggtacgtacgg

SEQ ID NO: 242792 - DNA, 643 bp, Homo sapiens
  misc_feature: GYAE6OF02G58SR.35.85.H08.1.454.CMB.1.raw
  modified_base (294)..(294): a, c, t, g, unknown or other
  misc_feature (294)..(294): n is a, c, g, or t
  modified_base (376)..(376): a, c, t, g, unknown or other
  misc_feature (376)..(376): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaagttggccaggctccaggctcctcatctttggngtgtccagtagggccgtcgtggtcgtcccagtcaggttcagtggcagttcggctcgtgggacaggattcgactctcgaaccntcgacgcacggcctgcacggtacttaggaagttacgttttgaaccgttagttttaagtttaaccgttgtaccgtaacggtactaaagtttaacgttaaacttaacggtccgtttacgggtaccccgttaccggtaagttttccggtaccgttttaccggtttttacgggaccccggttaacgggggtaaccctaaagggtccgttaacggggaacggtaattaacccggaaaaccgggttaacttacgggtaccggtacgttaccgg

SEQ ID NO: 242793 - DNA, 501 bp, Homo sapiens
  misc_feature: GYAE6OF02FL1J3.35.85.H08.1.454.CMB.1.raw
  modified_base (311)..(311): a, c, t, g, unknown or other
  misc_feature (311)..(311): n is a, c, g, or t
  modified_base (387)..(387): a, c, t, g, unknown or other
  misc_feature (387)..(387): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaattagcctggtaccagcagaaagttggccaggctcccaggctcctcatctttggtgtgtccactagggccntggtgtcccagtcaggttcagtggcaggtggctcgtgggacagtagttcactctcaccatcagcagcctgcagtcngaagtatttgctagtttattactgtcagcaatataatagctggcctcgagttcgcttacgtttggccgtaaggggaccaaggctggagtactacgaaacgactcggtggctacg

SEQ ID NO: 242794 - DNA, 549 bp, Homo sapiens
  misc_feature: GYAE6OF02FSSCH.35.85.H08.1.454.CMB.1.raw
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (418)..(418): a, c, t, g, unknown or other
  misc_feature (418)..(418): n is a, c, g, or t
  modified_base (438)..(438): a, c, t, g, unknown or other
  misc_feature (438)..(438): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagagccaccctctcctgcacgggccagtcagagtgttagcagcaacttagcctggtaccagcagaagttggccaggctcccaggcctcccgtcattcgtttggtgtcgtccacgtacgggccgtcgttggtcgtccccagtccaggttcaggtggcaggtcgctgtgggacagtagttcactccncgacngtacacgcacgcctgcgagtctagaacgttntttcgcttagtttattactntcagtactaatactaaatcgtcgttcggcctcgtagttcgtacttacgtttcggaccgtacgggtaccaggtcgtacggagtacgtactaaacggtactaggtcgactacg

SEQ ID NO: 242795 - DNA, 588 bp, Homo sapiens
  misc_feature: GYAE6OF02FWUEU.35.85.H08.1.454.CMB.1.raw
  modified_base (310)..(310): a, c, t, g, unknown or other
  misc_feature (310)..(310): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtccagagtgttagcagcaacttagcctggtaccagcaggaaagttggccaggcctccaggcctcctcatctttggngtgtccacgtacgggccgtctggtcgtcccaggtccaggttccaggttcggcaggtggtcctcgtggggacaggtcgtttcacgtctcacctactcagcacgcctcgctacgtcgttacgaagtagttttcgacgttacgttttattaccttgtctacgtactaattactaaagtagtcgtcggtaccttccggtagtttcggtactttaccgttttacgggacccgtaacggggtaccgaacggtaccggtagggtacgtacgtacccgtaaaacgg

SEQ ID NO: 242796 - DNA, 636 bp, Homo sapiens
  misc_feature: GYAE6OF02G8QSD.35.85.H08.1.454.CMB.1.raw
  modified_base (366)..(366): a, c, t, g, unknown or other
  misc_feature (366)..(366): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaacttagcctggtaccagcagaaagttggcaggctccgagctcctctactcgtttggtgtgtccacgtacgggccgtcgtggtcgtcccgagtcgtaggttcagtggcgaggtggctcgtgggacnggtacttcacttcctacaaccgtatacacgccacgcctacgcgtacgttctaggtaagttacgtttgactttaggttttaacttacgttcgtacctagtaaccgtaaatttagtaaagttcgtaccgtttacgggtacccgtacggttagtttacgtaccgttacggtttttacggaccgggtaacgggtaacccgtaacggtccggttaagggtaacgtaacgttaacggaaaccggttaccggttacgggttacggtaccttaccggg

SEQ ID NO: 242797 - DNA, 628 bp, Homo sapiens
  misc_feature: GYAE6OF02I7CPH.35.85.H08.1.454.CMB.1.raw
  modified_base (308)..(308): a, c, t, g, unknown or other
  misc_feature (308)..(308): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggaagaaatagtgatgacgcagtctaccaaccacttctttctgtcgtctcgagggacagacgccacctctcctgcgacgggccagtcagtgtgtagcagcacgttagcctaggaccagcaagtaagtggccaggcctacccgaggtcctcctanacgttcgtttggtcgtacgtccctagtcgggtcctgttgggtccgtacccgaggttccgtaacgggtttcgaggttcgggctaggttcggtccgttggacgggaactagggtcgttaccgtacgtcctacacgttacgtcaggacacgctcgtgtacgttctaggaacgttgtttgacttagtttaacgttctacgttacacgtactaagttaattagtaacgtccttacgtccgtacgttagtcggttacttaccggtttggaacccgtaagggtaccgttacggtacgtaggtaactaaccggtaacgaacggtacgg

SEQ ID NO: 242798 - DNA, 569 bp, Homo sapiens
  misc_feature: GYAE6OF02GFCVM.35.85.H08.1.454.CMB.1.raw
  modified_base (319)..(319): a, c, t, g, unknown or other
  misc_feature (319)..(319): n is a, c, g, or t
  modified_base (389)..(389): a, c, t, g, unknown or other
  misc_feature (389)..(389): n is a, c, g, or t
  modified_base (416)..(416): a, c, t, g, unknown or other
  misc_feature (416)..(416): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaacttagcctggtaccagcaagaaagttggaccaggctcccaggcctcctcattcgttggtgtcgtcccagtacgggccncttgggtcgtccccagttccaggttccaggtcggcaggtggctcgtgggacagtacgttcactctcaccntacacgcacgcctgcagtctagaagtntttgctagtttactacttgtactagtacaattataaattgtcgttacggtcccttacggtagtttcgaccgttacgttttcggaccggtacggggaacctaagggtcctagggtacgactaccgaaaccggtacgtacggtaggaccgtacgg

SEQ ID NO: 242799 - DNA, 615 bp, Homo sapiens
  misc_feature: GYAE6OF02HJQJX.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtctccaggggacagagccaccctctcctgcacgggccagtcagagtgttagcagacaacttagcctggtaccagcaagaagttgccaggcctcccgaggcctcctcactcgtttgggtgtcgtccaacgtcggggcccgtcgttgggttcgccccaggtccgtaggttcaggttcggctaggtcggtcctcgtacgggacctagtaggtttcaccttcgtacctaccattccgaaggtcaacgtcctagcacgtctagtaagtatttcgactagtttattactggtctacgtactaaattaacgtaattacgcgttcgaccctacggtacggttacgtacgtttaccgtttacgggaccggtaacggggacctaaacggtcgttaacgggacgtacgtaaccgaaaccgtaccggtaggtcggtaccgtacg

SEQ ID NO: 242800 - DNA, 667 bp, Homo sapiens
  misc_feature: GYAE6OF02GHWTL.35.85.H08.1.454.CMB.1.raw
  modified_base (215)..(215): a, c, t, g, unknown or other
  misc_feature (215)..(215): n is a, c, g, or t
  modified_base (233)..(233): a, c, t, g, unknown or other
  misc_feature (233)..(233): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtcctcgagggacagacgccacccttctccngcgacgggcctagtcagngttgtagcagactaacttgccgtaggtaaccagacgaagtaaaggttcggccaggtcctcccgaggtccttcctactagtttcggtttaggtcgtcgtaccgtaacggtacgggccgtacgttggtccgtacccgtaggtcgtacggttcagggtcggactaggtcggtctcggtagggacaggttacgttcacgtcctacgactctacgacgtccaacggtcctaggactacgttcgtaaagtagtttctttgacgttttagtttaactccgtgtacaacggttataacgttaactaagtaccggtcgtacgggttccctaacggttagttcgtaccttttacggtttacgggacccggtaaacggggtacctacggtcggttaacggacgtaacttaaccgaaaccggttccgttagggtcgtacgtaccgg

SEQ ID NO: 242801 - DNA, 838 bp, Homo sapiens
  misc_feature: GYAE6OF02I04GW.35.85.H08.1.454.CMB.1.raw
tcagtacagatcgtcacgaccggtgctcgatttagtatcactcagtcgcggggaggaacgtgctcagttaggacccagacggaaccatggaagccccagcgcagcttctcttcctcctgctattcgtggcctcccagatatcactggagaaatagtgatgacgcagtctccaacactctgtctgtcgtctccgagggacagacgcccaccctctcctgcgacgggccagtcagacgttgttaacgcgtagaccgtaactttaggccctaggtacccagtaccgaaggtaaagtttcgggaccctaagggtcctaccccgagggtccctacccgtacgtaacgtttccgttttgggcgttaccgtaccccaaccggttacggggtcccgtcgtttcgggtccgtacccccgtaaggtccgtaagggttccagggttcgggacctagggttcggactcggttaggggaacctaggtacgttcacgttccgtaccaccgtacgtaccgacttaccgacgtcccgttagaccgttacggttacgtaacggttaaacgttacgttttcggtaacgttttaacggtttttaaccgttaccgttacgttaccgtaaacgttaaccttaaaacgtttaaggtaaaccgttttaccggtacccgggtttaaccgggttaaccccgtttcggttaaacgggtttaccgtaccggttttaccgggttttacccgggaacccgggttaaaccgggggttaaccctaaacggggtttcccggtaacggggtaacgttaaccggttaaccgtaaaaccggtacgtttaccgggtacgggttacctaaccggg

SEQ ID NO: 242802 - DNA, 569 bp, Homo sapiens
  misc_feature: GYAE6OF02I5PAE.35.85.H08.1.454.CMB.1.raw
  modified_base (198)..(198): a, c, t, g, unknown or other
  misc_feature (198)..(198): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacngagccaccctctcctgcagggccagtcagagtgttagcagcaacttagcctggtaccagcagaagttggccaggctcccaggcctcctcattcgtttggtgtcgtccacgtacgggccgtgtcggtgtccccagttccgaggtttccaggttcggactagggtggccttcggtggggacagtagttccactctaccacatcagcacgcctgcagtctagtagtagttttgcttacgtttattacgtgtcagtactaattataatacgtctcggtcctacgtagttcgtactaccgttttcggaccggtaacgggacctacggtacgtacgggtagtacgtaccgtaaacgtacgtcggttacggcgtacgg

SEQ ID NO: 242803 - DNA, 574 bp, Homo sapiens
  misc_feature: GYAE6OF02JBIJ0.35.85.H08.1.454.CMB.1.raw
  modified_base (380)..(380): a, c, t, g, unknown or other
  misc_feature (380)..(380): n is a, c, g, or t
  modified_base (406)..(406): a, c, t, g, unknown or other
  misc_feature (406)..(406): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctccccaggcctcctcatcgtttggtgttcgtccacgtacgggccgctggtcgtcccagtcaggttcaggtggcagtggctcgtgggacagagttcacttctcaccntacagcagcctgcacgtctgaagttntttgactagtttattactgtcagtactaattaataatagtaccgttcggtccttaccggtacgtttacggtcctacgttttcgggacccggtaacgggggaaccctaaagggtccgttacgggaactaacggtacgaaaaccgtaccgtagggtacggtccgttacgg

SEQ ID NO: 242804 - DNA, 526 bp, Homo sapiens
  misc_feature: GYAE6OF02GKJ69.35.85.H08.1.454.CMB.1.raw
  modified_base (378)..(378): a, c, t, g, unknown or other
  misc_feature (378)..(378): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgtctggtgtcccagtcaggttcagtggcagtggctcgtgggacagacttcactctcaccatcagcancctgcagtctagaagtagttttgcttagtttacttactcgtacagtacaattaataatagcttgcctcgtagttcgacttacgtttcggaccgaacggggtaccaggtcgtaggaacgtacgtaccgaaacgtactggtacgtctacg

SEQ ID NO: 242805 - DNA, 617 bp, Homo sapiens
  misc_feature: GYAE6OF02GBYN6.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttagcctggtaccagcagaagtggccaggcctcccgaggcctccctctacttcgtttgggtcgttcggtcccacggtacggggcccgtcgttgggtcgtccccgtaggttccgtagggttcaggtggctaggtgggcttcggtagggactaggtacgttccacttcgtaccacctactcgagccgacgtccctggctacgttcctaggaagttagttttcgacgtttagttttacttacgttcgttactacgtaactaattaagtaacttaggtaccgttcggtaccttacggtagttcgtcttacgtttcggaccggtaacgggacctaggtcggttaggaagtacgtaacgaaacgtacgtggtacggtcgtacg

SEQ ID NO: 242806 - DNA, 584 bp, Homo sapiens
  misc_feature: GYAE6OF02FWT2Q.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaaagttggaccaggcctcccgaggcctccgtcattcgtttggtgtcgtccacgtaggggcccgtcgtgggtcgtccccgagtccgtaaggttcgaagttgggctaggtcgggtcttcgtgggactaggtacgttaccacttcctaccaccactacagccgagcctgctagtcgtagtaagtatttcgacttagttttattacgttgtacgtagtacaattataaagtagtctcggcctcgtagttcgtacttacgtttcggaccggtagggaccaaggtcgtaggtacgtacgtaccgaaacgtacgtaggtcggtacgtacg

SEQ ID NO: 242807 - DNA, 623 bp, Homo sapiens
  misc_feature: GYAE6OF02IZN5G.35.85.H08.1.454.CMB.1.raw
  modified_base (286)..(286): a, c, t, g, unknown or other
  misc_feature (286)..(286): n is a, c, g, or t
  modified_base (444)..(444): a, c, t, g, unknown or other
  misc_feature (444)..(444): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtcgtctccgaggggacagacgcccaccctctcctgcgacgggccagtcagtagtgttagcagacaacttagccgtggtaccagacaagtaaagtggccaggccnccgagtcctccctctattcgtttgggtcgttcgtacccacggtacgggccgcgtttggtcgtccctaggtcgtaggttcgaggtcggcgagtggtctcggtgggtacagtacttccactctacaccacgtcacgcacgctagcagtcgtagtaagttntttcgactttacgttttactacgttgtactaacgtaactaaagttaactaaagtcgtacgttcggttaacccgttccggttagttacgtaccgttacggtttcgggaacccggtaacgggggtaacctaggtacgtagggaactacggtaacaaacggtacggttaggtcggctaacgg

SEQ ID NO: 242808 - DNA, 664 bp, Homo sapiens
  misc_feature: GYAE6OF02JZVWA.35.85.H08.1.454.CMB.1.raw
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
tcagtacagatcgtcacgaccggtgctcgatttagtatcactcagtcgcggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagccatccgtctcctgcagggccagtcagagtattcggaacgaacgtgtctggtaccagcagaacctggccaggctcccgagcctctcatcgtatggtgcactccaccgngggaccacgtggtactcccagccaggttcaggtcgactaggtcggactgggactagtacttcgacgtcctacaccagtccacgcgacgtcctgcctagttcgagtaaacgtagttaactcggtacgtaagttttaacgcctaacggttcgtaccgtaaggttactaaacggttttaacgtaggtaccccgtacgggtacccgttccgtaccggtttcccgtttacccgttttaccggggacggttaaccggggtaccccgtaaacgggggttcggaaacgttaacccggtaaccgtaaaagggttaaccgtaccgggttacggttacccgtaacggtacccctaaccggttaccgg

SEQ ID NO: 242809 - DNA, 733 bp, Homo sapiens
  misc_feature: GYAE6OF02IY8MY.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcacgggccagtccagagtgttagcagcaacttagccgtggtaccagcaagaaagttcggccgaggcctcccgaggtcctccctcattcgtttggtgtcgtccaacgtacgggccgtcgtggtcgtccccgagtccgtaggttccagtcggtacgaggttcggccttcggtcgggaactaggtagtttacccgaacgttcccgtacacctactacgtacgacgaacggtcccgttccgcgtacggttacgtacggtaaagtttacgttttaggtaccgtttacggtttttaactttacgtttcggttaacctaaggttaaccttaaagtttaaacgttaaaagtttaaccggtccggttaccgggttacccgttcccggtaagtttacgtaccgttttaaccggtttttccgggacccgggttaaacggggtaacccgtaaaccgggttccggtaacgggaaccggttaacgtaaaccggtaaaaccggttaaccggttggttaccggtccggtaaccgg

SEQ ID NO: 242810 - DNA, 594 bp, Homo sapiens
  misc_feature: GYAE6OF02G06OV.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgccgagggccagtcagagtgttagcagcaacttagcctggtaccagcagaaagttggccaggcctccgaggcctcctcatcgtttggtgtcgtcctacgtacggggccgcgtggtcgtcccgagtcaggttcaggtggacaggtcggactcggtggacaggtagttcacctctcaccgtataccagcgacgtcccgtgccgacgttctaggtaagtacgttttcgacttaagttttatttaccgtgtaccgtaagtacctaaattaattaaacgttagacgttacggacccttccggtagttcggtacctttacgtttcggaccgtacgggaccgtaacggtcgtacggaaggtacgtaccgtaaacgg

SEQ ID NO: 242811 - DNA, 846 bp, Homo sapiens
  misc_feature: GYAE6OF02GYE83.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacaagacgccaccctctcctgcgacgggccagtcagagttgttacgcagactaacgttacgccgtacggtaaccagaccaaggtaaaggttcggacccgaggtcctaccccgagggtcccttaccctcgtactttcgttttgggtggttccgtcccgaacggttacggggcccgtcggttgggttcccgtaccccgtaggttcggtacggttccgtaagggtcggacgtagggttcggtcgttcgggtacggggtaactaagggttaacgtttcccgtaaccgtttcccgtaaccgtaacccgtacgttaccgacgtaccgtaaccggtcccgtacgtaccgtacggtttccgtaacggttaacgtttacgtttttacggtacgttttaaacgtttttaactttacggttacggttaaccgtaacggttaacttaaaagtttaacgtttaaaagttacggttaccggttccgggttaccccggtttaccggttaacggtttacgttacccgttttaccgggtttttaccgggaacccggggttaaccgggggtaaacccgttaacggggtaccggttaacggggtaacgttaaccgtaaacccggtaaaaccgggttaccggtacggggttaccgggtaccgttaacccgg

SEQ ID NO: 242812 - DNA, 550 bp, Homo sapiens
  misc_feature: GYAE6OF02IIJRG.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtcctccaaccactctgtctgtgtctccaggggacagacgccaccctctcctgcagggccagtcagagtgttagcagcaacttagcctggtaccagcagaaagtggcaggctccaggctcctcattctttggtgtgtccacgtacgggccgcgtggtcgtcccagtcaggttcagtggcaggtcgcttcgtgggacagtagttccacttctccacctatcagcacgcctgcacgtctagaagtattttcgacttagtttattactgtacagactaattataatagcgttcggccctcggtagttcgtcgttacgtttcggaccggtaacggggaaccaaggtcgtaggaagtacgtacgtaaaccggtacggtcggtcggactacgg

SEQ ID NO: 242813 - DNA, 578 bp, Homo sapiens
  misc_feature: GYAE6OF02HQ6AM.35.85.H08.1.454.CMB.1.raw
  modified_base (366)..(366): a, c, t, g, unknown or other
  misc_feature (366)..(366): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctagtctgtgtctccaggggacagagccaccctctcctgcgagggccagtcagagtgttacgcagcaacttagcctggtaccagcagaaagttggccaggctcccgaggctcctcattcgttggtgtcgtccaacgtgggccgcgtaggtcgtcccaggtcaggttcagtggcaggtggctcgtggaacngacgttcactctccacatcagcacgcctgcgtacgtcgtacgagtattttcggacttagttttaactactacgtactagactaaatattaactaagcttacgggtacctaccggtaagtttcgacgttacgttttacggaaccgaagggggtaacccaaaggtccgttagggaagtataaccgaaaacgtaacgtaggttagggacttacgg

SEQ ID NO: 242814 - DNA, 679 bp, Homo sapiens
  misc_feature: GYAE6OF02JZEQB.35.85.H08.1.454.CMB.1.raw
  modified_base (255)..(255): a, c, t, g, unknown or other
  misc_feature (255)..(255): n is a, c, g, or t
  modified_base (359)..(359): a, c, t, g, unknown or other
  misc_feature (359)..(359): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgccagggccagtcagagtgttagcagcaacttgccgtgaaccngacagtaaagttcggaccagtcctcccgagccgtccctcgagttcctttggtctcgttaccgacgttacggggccctgtcggtcgtacccgagtcgtacggttnacggtcggctaggtgaccgttcgtgggactaacgtggttccaccgttctaaccgaccgtagtacgacgttaccgaccgtacccgtcggacctacgggttcctaacggtaacgttagtttttccgacttttaacggttttaaccttacggttacgttaccgtaagtaaccttaagttaattaacgtacgttcgtaccggtccttaccggtagttaccgttacttacgttttcggacccgggtaacgggtaaccctaggtaaccggttcgggaactaacggttaccgaaaccggttaacgttcgggtacggttacgacccgg

SEQ ID NO: 242815 - DNA, 590 bp, Homo sapiens
  misc_feature: GYAE6OF02JEEAO.35.85.H08.1.454.CMB.1.raw
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccacctctcctgcagggccagtcagagtgttagcagcaacttagcctggtaccagcagaaagttggccaggctccgaggctcctcattcgtttggtggtcgtccacgtacgggccgtcgtggtcgtccccaggtctagggttccaggtggcaggtggctcgtgggacaggtgttcacgtctccacctatcacgcacgcctgcncgtctagtaagttntttagacgttagtttacttagtcttacgtacgtaactaactaattaagtacgtacgttaccggtccgttaccgtagttcgtacttaccggttttcggaccggtaggggtaacccgaaggtcggtacggtaaggtacgtaaccgaaacggtaacgtcggtcgggtacttaccgg

SEQ ID NO: 242816 - DNA, 761 bp, Homo sapiens
  misc_feature: GYAE6OF02H5UEK.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccaggggacagacgccaccctctcctgcagggccagtcagagtgttagcagacaacttagcctaggtaccagcgaaggaaaggttcggaccgaggcctcccgaggcctccctctactttcgttttgggtcgtcgtacccgaacgttacggggcccgtcgttgggtccgttccccgaggttccgtagggtttcgaagggttcggtacgtaggttcggtctacgtaggggaacagtacggtttccacgttccgtaccaacctactaccgagcctacgtcccgtacgaccgtacgttacgttacggtaaacgttacgtttttcgtacgtttaacgtttttaacgtttaaccgttcggttaccgtaagtaaccttaaagtttaacgttaaaacgttacggttacccgtttaccggggttaaccccttaccgggttaacgtttaccgttaccgttttaaccgggtttttccgggaacccgggttaaccggggaacccggtaaacgggtaccggttagggaacgttacggttaaccggaaaaccggttaacgggtacggttaccgggtaccgttaaccgg

SEQ ID NO: 242817 - DNA, 799 bp, Homo sapiens
  misc_feature: GYAE6OF02HWVQ7.35.85.H08.1.454.CMB.1.raw
  modified_base (149)..(149): a, c, t, g, unknown or other
  misc_feature (149)..(149): n is a, c, g, or t
  modified_base (156)..(156): a, c, t, g, unknown or other
  misc_feature (156)..(156): n is a, c, g, or t
  modified_base (164)..(164): a, c, t, g, unknown or other
  misc_feature (164)..(164): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcttccagatatcacgtggaanaagtgtnatacgacntacgtcctaccaactactcgttcgtctgtcgtcctaccgggaggggacaagaccgaccctacccttcctcgtgacggacgggacctagcaaggtagttagttacgacaggaccttaaacgttacgtaccgttacggtaaccgagtaccgaaaggtaaagttccggaaccgtaacgggtccccttacccggaacggtccttacccgtataaccgttttcggtttgggtcgttccgtacctacgggaacgggtccgttcggtcgggttaccgtaccgtacgtaccggttacggttaccgtagggttccggacgtacggggttggaccgtttcgggacgggtaacaacggttacggttccctacgttaccgtccaacgttaactaccgtagaccgaccgtcgtagaccgtacgttccgtaagggtaactttagtttcgtagttaagtttttaacttacgttcgtacgaagtaataaacttaacgtaaagttccgtacggtcgttacccgttacggtagtttcgaccgttttacgggtttccggtacggggtaaaccgggttaaccgaagttaccgggtaaggtaacgtaccgttaaaccggaaaccgtttaaagggtcggtaccgggttataacccgg

SEQ ID NO: 242818 - DNA, 686 bp, Homo sapiens
  misc_feature: GYAE6OF02ITQTI.35.85.H08.1.454.CMB.1.raw
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
  modified_base (277)..(277): a, c, t, g, unknown or other
  misc_feature (277)..(277): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggcctcccagatatcactggagaaatagtgatgacgcagtctccaaccactctgtctgtatcctccgagggacaggacgcctaccctctccngccagggcccagtcagacgttgtancagacaacttacgcctggtaccngacaacgtaagtcggcaggccaccgaggctcctcgattcgtttgcgttactccgtagtacgggtccgcgttacggtcgtacccgaggttctaacgggtttcacggttcggggtacagggttgcccgttcggtacgggggactaggttacggttacctaccgtttaccgttaccgtaccgtactactacgggtacctaccggtaccgttcgacccggttaacgtcggttaaccggtaaggttacgttttacgaccgttagttttaactttacgtttacgtacgtacgtacttaattaactaaagttacgtccttacggcccgttacgttaccgtcgttaccttacggttttaccggccggtaacgggtaccgtaacggtccgttagggacgttaccgtaagtaaacccgg

SEQ ID NO: 242819 - DNA, 643 bp, Homo sapiens
  misc_feature: GYAE6OF02GAEZ4.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcgagggccagtcagagtgttagcagcaacttgcctaggtaccagcaagtaaagttcggaccgaggcctcccgaggcctcctctattcgtttgggtacgttcgtaccctacgtacggggcccgtgttcgggtccgttcccccgaaggttccgtacgggtttccagggtcgggacctagggtcgggccttcggtaggggaactaggtagttccacgttcctaccgaccgtactcgacgccgtaccgcctgctacggtacgtagtaagttagtttcgtacttagtttaacttagtcgtacagtactaattataacgtacgtcgtcgtcccgttacgtagttacgtacgttacgtttcggaccggtaacggggaccaacggtcgtaggaacgtacgttaaccgaaaccgtaacggtcggtacgtcgtacgg

SEQ ID NO: 242820 - DNA, 607 bp, Homo sapiens
  misc_feature: GYAE6OF02I36QP.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtctccaaccactctgtctgtgtctccgaggggacaggacgccaccctctcctgcagggccagtcagagtgtagcagcaacttgcctggtaccagacaagtaaagttcggaccgacggccctcccgaggtcctcccgtactacgttcgtttggtcgttcgtcccacggtacgggcccgtgttcgggtcgtccccgtaggtcgtaggttacaggtcggtacaggtcggtctcggtgggactaggtacgttccaccgttctcacctagtcgagccacgtcctgactacgttctaggtaattagtttcgactttagtttacttacgtgtaccagtactaagttatagtacgctacggtccctggtacgtcgactttacggttgaacccggtaggtaacctaggtacgtaggaactacgtaacaacgttaggtacgtggtcctacgg

SEQ ID NO: 242821 - DNA, 637 bp, Homo sapiens
  misc_feature: GYAE6OF02HSCXM.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagagcccacctctcctgcgagggccagtcagagttgttacgcagcaacgttgcctggtaccagacaaggaaaggttcggaccacggcctccgaggtcctcctctattcgtttggcgtcgtaccgagttacggggcctgttgggtctcccgtagtcgtacggttcaggtcggctaggtggctcgtggggacagtacgttcaccttctaccgacctatcgtacgcgacgtccgtggcgtacgtcgtaggtaaagttcgttttacggacgtttagttttaacgttaacgtcgtacgtacgtaataaagttaactaagtacgtccgtacggtacccgttcggtacgttcgtaccgtttacggtttccggaccggtaacgggtaccgtaacggtcgtacggtaagtaacgtaacgaaaccgtacggtacggtacgtaccgtaccgg

SEQ ID NO: 242822 - DNA, 546 bp, Homo sapiens
  misc_feature: GYAE6OF02I0AMM.35.85.H08.1.454.CMB.1.raw
tcagtacagatcgtcacgaccggtgctcgatttagtatcactcagtcgcggggaggaactgctcagttaggaaccagacggaaccatggaagccccagcgcagcttctcttcctcctgctattctggctcccagatatcactggagaaatagtgatgacgcagtctccaaccactctgtctgtgtctccaggggacagagccacctctcctgcagggccagtcagagtgttagcagcaacttagcctggtaccagcaagaaagttggacccaggctacccaggctcctcattcgtttggtgtgtacccacgtacggggcccgcgttgggtcgtccccgagtcaggttcagtggcagtggctcgtggactgagttcactctcaccatcagcagcctgcagtctgaatagttttgacttagtttacttacgtcgtctagactaattaataataggtcctggtcccttcgaggttccacttacgttttcgggaccgtaggggaccctaagggtcctaggatacgtacaaacggtacgtggtcgagtacg

SEQ ID NO: 242823 - DNA, 690 bp, Homo sapiens
  misc_feature: GYAE6OF02JI4WG.35.85.H08.1.454.CMB.1.raw
tcagtacagatcgtcacgaccggtgctcgatttagtatcactcagtcgcggggaggaacgtgctcagttaggacccagacggaaccatggaagccccagcgcagcttctcttcctcctgctattctggctcccagatatcactggagaaatagtgatgacgcagtctccaaccactctgtctgtgtctccgagggacagacgcccaccctcgtcctgcacgggccagtcagacgtgttacgcagacaacgttacgcccttggtaacccaggaccaaggaaaaggtttcgggaccccaagggtccttacccccgaaggggtccctcccgtactaacgttccgtttttgggtcgtcgttacccgacgttacggggccgtcttgggtccttccccgagtctaggttcaggtcggcagtggcctgtgggacaggtacgttccgacctttcgaccacctacgtacacgcacgccgtgctacgtctacggtaacgttatttcgtacgttacgttttacttacgtttagtactaggtacctaaattacgtaaagtagtaccgttaggtccccttacggtacgtttacgtacctttaccgttttcgggaccggtaacggggtaacccgtaaggtaccgttacgggtacggtaacgttaccggaaaaccggttaacgtacgggttacgtaccgttacgg

SEQ ID NO: 242824 - DNA, 756 bp, Homo sapiens
  misc_feature: GYAE6OF02HHH04.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcgaggccagtcagagtgttagcagcaacttagcctggaccagcaagtaagtcgaccaggcctccaggtctcctctattcgtttggtcgtacgtcccgtaacggtacggggcccgtcgttcgggtcgtaccccgtaggtccgtaaggggtttccaagggttcgggactagggttcggtaccgttcggtaggggaactaggtacgtttccaaaccgttcctaccaaccctaagttcccgaaaggcccgtaacggtcccgtacggaaccgtacggttacgtaaggtaaacgtttacggtttttacgacgttttaacggtttttaaacttaccggttagtacctaacggttaaacttaaaagtttaaacgtaaacgttacgggttccctaccgggttacccgttaacggttaacggtttaccgttaaccgttttacggtttaccgggggaacccggtaaacggggtaacccttaaagggtcggttaaacggtaacgttaaccgtaaaccgaaaaccggttcgtacggtaccgggtactaaccgg

SEQ ID NO: 242825 - DNA, 698 bp, Homo sapiens
  misc_feature: GYAE6OF02IANC2.35.85.H08.1.454.CMB.1.raw
  modified_base (396)..(396): a, c, t, g, unknown or other
  misc_feature (396)..(396): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgcccaccctctccgtgcacgggccagtcagagtgttagcagctaacttagcctggtaccagcagaaagttggccaggcctcccgaggcctccctctacttccgtttgggtcgttcgtcccgtaacgtagggggccctcgttcgggttacgtccccgtaggttccagggtttccgaaggtggacnggtcggcttcggtgggacaggtcgtttacacgttctaccgaccctactaccgaacgccgtacggcccttggaccctaggtttcccgtagggtaaacggtttactttttcggaccgtttaagtttttaaacgtttaaccgttacgttacgtacggtaacttaaagtttaactaaaggttaaccgtccgttaggtaccccgttaccggtacggtttcgttaccggttaaccggtttttacgggaccgtaacggggtaccgtaacggtccggttacgggtacgttaaccgtaacgtaaaacccgg

SEQ ID NO: 242826 - DNA, 606 bp, Homo sapiens
  misc_feature: GYAE6OF02F4WTF.35.85.H08.1.454.CMB.1.raw
  modified_base (341)..(341): a, c, t, g, unknown or other
  misc_feature (341)..(341): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctggtaccagcaagtaaagttcggccaggcctcccgaggtcctcctcattcgtttggtgtcgtccacgtacgggccgtgtcggtcgtccccngtccgtaggttcgaggtggcaggtcggctcggtgggactaggtacgttccacgttccgtactacctactcgacgccacgtccgtcgccgagtcgtagaagttgtttcgacttagtttacgttacgtgtacgagtactaattaacgtaagtagtcgttcgtcctacgtagttcgtacttacggtttcggaccggtaacgggaaccgtaagggtccgttagggtacgtacgttaaccgaaaccgtacgttacggtcggtacgtacgg

SEQ ID NO: 242827 - DNA, 524 bp, Homo sapiens
  misc_feature: GYAE6OF02FL8N3.35.85.H08.1.454.CMB.1.raw
  modified_base (521)..(521): a, c, t, g, unknown or other
  misc_feature (521)..(521): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccacccctctcctgcagggccagtcagagtgttagcagcaacttagcctggtaccagcaagaaagttggccaggctcccaggcctcctcattctttggtgtgtccacgtacggggccgcttgggtcgtccccagtcagggttcagtggcaggtggctcgtgggacagacttcgactctcaccatcacgcagactggaagctgaagtattttgactagttgtattactgtcagcagtagtaggttagttcgtaccgttactacgtttcgaccgagggtaccgaggtggtgatacgaacgtactgtggcgtacgcactactntcg

SEQ ID NO: 242828 - DNA, 540 bp, Homo sapiens
  misc_feature: GYAE6OF02G5639.35.85.H08.1.454.CMB.1.raw
  modified_base (313)..(313): a, c, t, g, unknown or other
  misc_feature (313)..(313): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccagctcctcattctttggtgtgtccacgtagggccncgtggtcgtcccagtcaggttcagtggcaggtggctcgtgggacaggtacgttcactctcaccatcagcagcctgcagtctagtaagtattttgcttagttttattactgtcagtctaattataagtagtcgtggtcctccgtagttcgtcgttacgttttcggaccgtacggggacctaacggtacgtggaagtacgtacgaaacgtacgttaggtcggtcgtacg

SEQ ID NO: 242829 - DNA, 570 bp, Homo sapiens
  misc_feature: GYAE6OF02HCO1V.35.85.H08.1.454.CMB.1.raw
  modified_base (341)..(341): a, c, t, g, unknown or other
  misc_feature (341)..(341): n is a, c, g, or t
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcaagaaaggttggccaggcctcccgagggcctccgtcattccgtttgggtcgtgtcccacgtaggggcccgngtcggtcgtcccgagtcgaggttcgaggtggctaggtcgcgttcgtgggacagtcgttcnctctcacatcagcncgtcctgctacgtctagtaagttagtttgtacttagtttacttacgtgttacagtactaataattaatagtacgtcgtcctaccggtagttcgtacgttacgtttcggaccggtacgggaccgtacggtcgtagggtacgtacgtacgtaaacgg

SEQ ID NO: 242830 - DNA, 603 bp, Homo sapiens
  misc_feature: GYAE6OF02G5L10.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcgacgggccagtcagagtgttagcagcaacttagcctggtaccagcgaagaagttggaccaggcctcccgaggtcctccgtcattcgtttggtcgtcgtccgacgtacgggccgtcgtggtcgtcccgagtcgtaggttcgaggtcgcgtaggtcggctcggtgggaacagtacgttcacgttcctaccaccatacagacacgccgtcgactacgtcgtagtagttatttcgacttagtttacttacgtcgtactacgtactaataagttaagtacgtcgttacggtccgtacgtagttcgtacgttaccgtttcggaccggtaacgggtaaccgaacggtcgtacggacgtaacgtaaccgaaacgtacgtcggtacggtcgtacg

SEQ ID NO: 242831 - DNA, 595 bp, Homo sapiens
  misc_feature: GYAE6OF02HM1Z5.35.85.H08.1.454.CMB.1.raw
  modified_base (430)..(430): a, c, t, g, unknown or other
  misc_feature (430)..(430): n is a, c, g, or t
  modified_base (456)..(456): a, c, t, g, unknown or other
  misc_feature (456)..(456): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttagcctggtaccagcagaaagttggccaggctcccaggctcctctattccgtttggtcgtcgtcctacgtacgggccgtcgtggtcgtccccgtaggtctaggttcgaggttcggcgtaggtggcttcgtgggacgagtacgttcacttctcaacctatccagcacgtcctgcagtctagaagttnttttgcttaagttttattacgtgtanaagctaaattataaatggtcgtacggtccctccgggtagtttccgactttaccggtttgggaccccgggtaaggggtaacccaagggtccgttacgggaactagtaaccggaaaccgttacggtaggtcggctaaccgg

SEQ ID NO: 242832 - DNA, 642 bp, Homo sapiens
  misc_feature: GYAE6OF02G2SKA.35.85.H08.1.454.CMB.1.raw
  modified_base (264)..(264): a, c, t, g, unknown or other
  misc_feature (264)..(264): n is a, c, g, or t
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (355)..(355): a, c, t, g, unknown or other
  misc_feature (355)..(355): n is a, c, g, or t
  modified_base (387)..(387): a, c, t, g, unknown or other
  misc_feature (387)..(387): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgttagcagactaacgttacgccgttggaaccngacgaaggtaaagttcggacctaggcctacccgaggtcctcccgtnacgttctaagtggtcnccactccaaccgngggcctacgtggtacnccctagcctaggtcagtggacgtgtcgggtcngggaactagtaccgttctacgtcctaccgaactacttcgaacgtccgacgtccttacgacgtacgttcgtaacggaattaacgttacgtggtaccttagttacctacgacgtttccgactacgtagttaacgtttaacgcgttaccggtccgtcccctgttacccgttcgtttaacgttccggggaaccgacgggttaacctaacggggtcgaagtaacctaacggaaaacgtaggttcggtaggtccctaacgg

SEQ ID NO: 242833 - DNA, 761 bp, Homo sapiens
  misc_feature: GYAE6OF02H34Z7.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctatttctggcctcccagatatcactggagaaatagtgatgacgcagtctccaaccactctgtctgtgtctccaggggacagacgccacctctcctgcagggccagtcagagtgtagcagctaacttagcctggtaccagcgaagaaagttggctaggctcccgaggcctacctcattcttttggtgtcgtccacgttaacgggccgtcgtgggtctacccgagtcgtaggttccaagggtcggcctaaggcggtctcgttaggggactaggacggtttaccaacttccgttacaccctaacgttccaacgtacgtaaccggtcccgtcggtaccgtaggtaccgtaggtaaagtttagtttttagtacccgtttaagttttaacgtttaaccgttaggttaccgtaacggtaacctaaattaaacgtttaaactttaaacgaccggtttaccggttacccgttaacccgggtttaacgttttaccgttaccgtttaaccgggtttttttccgggacccgggttaaaccggggggtaaccccttaaacgggtaaccgtttaacggggaacgttaaccggttaaacccggtaaaaaccggttaaccggttttaaggggttaccgggtaccgtttaaacccggg

SEQ ID NO: 242834 - DNA, 522 bp, Homo sapiens
  misc_feature: GYAE6OF02HC3ZT.35.85.H08.1.454.CMB.1.raw
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
  modified_base (352)..(352): a, c, t, g, unknown or other
  misc_feature (352)..(352): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttgcctggtaccagcagaaagttggccaggctcccgaggctcctcattctttggngtcgtccacgtagggccncgtggtcgtcccagtcaggttcagtgcagtggctcgngggacagtagttcactctcaccatcagcacgcctgcagtctagaagtatttgctagtttattactgtacagtacaatataatagtcgtacgtccgtcgtagttcgctacgtttcggaccgtacgggacctaaggcgtaggagacgtacgaacgtacgtcgtacgcgtacg

SEQ ID NO: 242835 - DNA, 507 bp, Homo sapiens
  misc_feature: GYAE6OF02GEPXK.35.85.H08.1.454.CMB.1.raw
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
  modified_base (365)..(365): a, c, t, g, unknown or other
  misc_feature (365)..(365): n is a, c, g, or t
  modified_base (403)..(403): a, c, t, g, unknown or other
  misc_feature (403)..(403): n is a, c, g, or t
tcagtacagatcgtcacgaccggtgctcgatttagtatcactcagtcgcgggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcatggtaccagcagaaagttggccaggctccaggctccnatctttggtgtgtccacgtagggccngtggtctcccagtcaggttcagtggcagtggctcgtgggacngagttcactctcacatcagcagcctgcagtctgaagtnttttgcttagtttattacgtgtacagtactaatataatgctcggacctcgtagttcgcttacgtttcggaccgtacgggaccaagtcgtaggacgtagtaaccg

SEQ ID NO: 242836 - DNA, 687 bp, Homo sapiens
  misc_feature: GYAE6OF02JJCK1.35.85.H08.1.454.CMB.1.raw
  modified_base (201)..(201): a, c, t, g, unknown or other
  misc_feature (201)..(201): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagngccacccttctctgcagggccagtcagagtgtagcagcaacttgcctgtaccagcaagtaagttggccaggcctccgaggcctccgtactagttccgtttggtgttcgtacccgacggtacggggcccgtgttcgggtacggtcccccaaggttccgtaacgggtttcgtacgggtcgggtaccgtaaggggttccgggtccgttacggtagggggtacctaacgggttaaccggttccaaccggtttcctaccgaacctacgtaccgacgtcgacgtccgtacgcgtaacggtcgtacgtaacgttacgtttcgacgtttaagtttacgttagttcggtactaggtactaagttaattaagttacgtaccgtacggttccgtacggttacgttacgtaccgttacggtttaccggccggtaacgggtacctacggtcgtaggtaacgtacgtaaccgtaacggtacgtaggtccggtacgtaccg

SEQ ID NO: 242837 - DNA, 557 bp, Homo sapiens
  misc_feature: GYAE6OF02FGZXX.35.85.H08.1.454.CMB.1.raw
  modified_base (424)..(424): a, c, t, g, unknown or other
  misc_feature (424)..(424): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaaccactctgtctgtgtctccaggggacagacgcccaccctctcctgcagggccagtccagagtgttagcagcaacttagcctggtaccagcagaaagttcgccaggcctccaggctcctcattcgtttggtgtgtacccacgtacgggccgcgttggtcgtcccagtcaggttcagttggcagtggctcgtgggacagacgttcactctcaccatcagcacgcctgctacgtctagtaagtntttgacttagtttatactgtacagtactaataataagtacgtctcggtcctacggtacgttcgtaccttaccgttttacggaccggtaacgggtaccgaacggtaccgtaggacgtacgtaaccgtaaaccgg

SEQ ID NO: 242838 - DNA, 755 bp, Homo sapiens
  misc_feature: GYAE6OF02GXSBU.35.85.H08.1.454.CMB.1.raw
  modified_base (186)..(186): a, c, t, g, unknown or other
  misc_feature (186)..(186): n is a, c, g, or t
  modified_base (227)..(227): a, c, t, g, unknown or other
  misc_feature (227)..(227): n is a, c, g, or t
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (324)..(324): a, c, t, g, unknown or other
  misc_feature (324)..(324): n is a, c, g, or t
tcagtacagatcgtcacgaccggtgctcgatttagtatcactcagtcgcggggagagctctgggaggaactgctcagttaggacccagacggaaccatggaagccccagcgcagcttctcttcctcctgtctattctggcctcccagatatcactggaagaatagtgatgacgcagtctccaaccnctctgtctgtcgtactccgagggacagtacgccacctctcngcnggcctagcagagtntacgnagactactagcctaggtaccagtacagtaaaggttcggaccgtaacgggtccaccccgaagggtccctacccgtntaacgtttcgttttcgggtacgttcggaccctaacggttccggggtacccgtggtacggggtttccgtaccccgaacggtttaccggaaggggtttttacccaaagggtttgggaccccgtaagggtccgggtcctttaccgggttacggggaacccgtaaggtaccgggtttaccgtaaccggtttccgtacccctaaccgtaacgtaccgtacgtaccgaacggtccgtacgaccgttaggtacgtacggtaagttatttacgtacgttaacgttttacgttacgttacgttacgaagtactaacttaacttaaacgtacgtacgtacggttcccgttaacgtaccggtttcggtaaccgttacggttttaccggaccggtaacggggtactaccggtacgtccgggtaagtacgtacgttaaaccggg

SEQ ID NO: 242839 - DNA, 533 bp, Homo sapiens
  misc_feature: GYAE6OF02HPOG6.35.85.H08.1.454.CMB.1.raw
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (408)..(408): a, c, t, g, unknown or other
  misc_feature (408)..(408): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcacgggccagtcagagtgttagcagcaacttagcctggtaccagcaagaagttggccaggctcccaggctccncattctttggngtgtccacgtgggccgcgtggtcgtcccagtcaggttcaggtggcaggtggctcgtgggacaggtacgttcactctccgaaccatcagccagcctgcagtctagaagtntttcgctagttttatactgtacagactaatataatagcgttcgaccttcgagttcgcgttacgtttcggaccggtagggtaaccaggtcgtaggacgtaagtaccgaaacgacgtcggtggctcg

SEQ ID NO: 242840 - DNA, 648 bp, Homo sapiens
  misc_feature: GYAE6OF02GELDL.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctggtaccagcaagaaagttcggaccaggcctcccaggcctccgtcattccgtttgggtcgtcgtccacgtacgggcccgctgggtcgtcccgagttcgtaggttcaggttcggcgtaggtcggcttcgtggggaactaggtacgttcaacgttcctacctaaccacgtacacgcaacggccctaggacctacgttcgtaggtaaacgttagttttacgacgtttagttttaactttacgttcgttacagtactaaagttaataaacgtagtaccgttacggtacccgttcggtaacgttcgtaccgttaccgttttacgggaccggtaacgggtaccaacgggtcgttacgggaattacggtaacgtaaaccggaacgtttcggtacggtcttacccgg

SEQ ID NO: 242841 - DNA, 659 bp, Homo sapiens
  misc_feature: GYAE6OF02IA0HX.35.85.H08.1.454.CMB.1.raw
  modified_base (319)..(319): a, c, t, g, unknown or other
  misc_feature (319)..(319): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgccacccttctccgtgcgacgggccagtcagagtgttagcagctaacgttcgccgtaggtaccaggacaaggtaagttcggaccaggtcctccgagtctcctacacgtttcgtttgggntcgtaccacgtacgggcctgtggtccgtaccgtagttcgtaggtttcaggtcggcgtaggtcggcttacggacgggactaagacgtttccaacttccgtacaacccgtataccgtacgacctacggtccgtgacgtacggtacgtacggtaaagttagttttacgacttaagttttacttacgtacgtacgtaacgtaccttaaattacgtaacgttcgtacgttcggtacccgtacgtagtttacgtctttaccgggtttacggaccggtaacggggtaacctaggtaccggtaaggaacgttactaacgtaaacggtacggtcggtacggtcgtaccg

SEQ ID NO: 242842 - DNA, 573 bp, Homo sapiens
  misc_feature: GYAE6OF02ILTCP.35.85.H08.1.454.CMB.1.raw
  modified_base (434)..(434): a, c, t, g, unknown or other
  misc_feature (434)..(434): n is a, c, g, or t
  modified_base (568)..(568): a, c, t, g, unknown or other
  misc_feature (568)..(568): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaacttagcctggtaccagcaagaaagttcggccaggcctcccaggtcctccctactacttcgttttaggtgttcgtccctacgtacgggccgtcgtcggtcgtcccctagtcaggttcagtggcaggtgctcgtgggacagtacgttcactctccacctatcgaagtcacgccgtgctacgtctaggtaagttnttttcgacttagtttattactgtcagtactaaattataattagcgttccgtccgttacgtagtttgtccgttacgtttcggaccgtaagggtaaccaggtcgtaggacgtagtaaccaacggtactggtacggntacgg

SEQ ID NO: 242843 - DNA, 737 bp, Homo sapiens
  misc_feature: GYAE6OF02HNGK4.35.85.H08.1.454.CMB.1.raw
  modified_base (135)..(135): a, c, t, g, unknown or other
  misc_feature (135)..(135): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggcctcccanaggtatcactggagaaatagtgatgacgcagtctccaaccactctgtctgtgtctccgaggggacagacgccaccctctcctgcgacgggccagtcagagtgttagcgagctaacttagcctggtaccagacgaagtaaaggttcggccaaggcctacccgaggtccctcccgtactacttccgtttggtcgtcgtacccgacggtacggggtccgtcgttgggtccgtaccccgtaggttccgtaaggttcccgtagggtacgggtacgtaggtccgggtcgttccggtaggggaacctagggttaacgttccgtaaccttcccgtacctaaccctacgttacccgacgtaccgaacgtcccgtagaccgtacggttcgtaacggtaaagttacgttttacggtacttaaggtttttacttacggttacgtacgtaaacgtaccgtaaattaacgtaaagttcggtacgttacgtcccgttaagtacgtttacgtaccctttaccggttttacggacccgggtaaacgggtacccaaagggttccgaaggtacgtaacgtaaccggaaaccggtaccgtttggtaccggtaccgtaaccgg

SEQ ID NO: 242844 - DNA, 693 bp, Homo sapiens
  misc_feature: GYAE6OF02H2FAY.35.85.H08.1.454.CMB.1.raw
  modified_base (618)..(618): a, c, t, g, unknown or other
  misc_feature (618)..(618): n is a, c, g, or t
tcagtacagatcgtcacgaccggtgctcgatttagtatcactcagtcggcggggagtagctctaggggaggaactcgctcaagttaggaccccaggacggaaccatggaagccccagcgcagcttctcgttcctcgtgtctatttcgtggctccagatatcactggagaaactagtcgagtgacgcacgtcgtaccaaccacgtcgtggtctggtagtataccggagggacaggtacgcccgtaccctcgtccgtgcgacggcacgtcgagaggtacgttacgacagactaaccgttacgccgtacgtaaccgacgacgtaaggtaaacgttccggaccaacgggtcccctaccggacggtacctcccttacgacgtttcgtttagggcgttacgtccgtaaccgtacgggtccgtcgtacggttactacccgaagttcgtacggttacgaggtcggcgtagtcgctacggacgggtactaggtacgtaccgtaccgtactaccaacctaactcgacgtcgtaacgtcctcggtactagtcgtaaggtaacgttacgttttagacgtttagtttacgttacgttagtaccgagtacttaaattaacgttagtagtcgngtaccgtacggtagtcgtacttacgtttacggaccggtaacggaccgtaggtcggaggacgtacgtacgtaaccg

SEQ ID NO: 242845 - DNA, 791 bp, Homo sapiens
  misc_feature: GYAE6OF02HTX1C.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcgaggccagtcgagtagtgttagcagactaacttagcctaggtaaccagacgaaggtaaaggttcggaccgaggcctacccgaggtcctcctactacttcgtttgggtcgttcgtaccacggtacgggtcccgtgttcggtccgtacccctagtccgtaggttcgaggttcggcgtaggtcgggtcttacggacggggtaactaaggtacgtttaccgacgttacctaccgaaccgtacgttaccgacggaccgtacggtacccgtacggtaccgtaacgttaccggttaaggtaaacggtttaacgtttttcggtaaccgtttaaagtttttaccgtttaaacgttcggtaaccgttaaagtaaaccgttaaaagtttaaacgttaaagtaacggttaccgtttaccgggtaacccgtttaccggttaacggtttccggttaaccgtttaccgggttttaccgggaacccgggttaaacggggtaacccgtaaacgggttacggtaacggggtaacgtaaccgtaaacccggtaaaacggttaacccggtttagggtaccggtaccgttaccgg

SEQ ID NO: 242846 - DNA, 520 bp, Homo sapiens
  misc_feature: GYAE6OF02GVJNM.35.85.H08.1.454.CMB.1.raw
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccactagggccnctggtctccagtcaggttcagtgcagtgctgtggacngattcactcncacatcagcagcctgcagtctgaagtatttgctagtttattactgtcagacaatataatagtctcggtcctccgtagttcgctacgttttcggaccgtaacggggacctaaggcgttagggagtacgtaccgaaaccgtaacgtacggttacggcgtacgg

SEQ ID NO: 242847 - DNA, 804 bp, Homo sapiens
  misc_feature: GYAE6OF02IZOQO.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccgagggacagacgccaccctctcctgcagggccagtcagagtgttagcagcaacgttacgcctaggtaccagcaaggaaacgttggaccaggtcctcccgaggcctccgtcacgttcgtttggtgtcgtccacgtacgggccgtcgtcggtcgtccccaggttccgacggtttacgaggttcgggcgtaggtcgggtcctacggtacgggggacctaagggttaacggtttaccgaacccgtttccgtaccgtaaccccgtacgttaccgtacggtaccgtaacggtccccgtacggaccgttaacgggttacccgtttaacggtaaacgggtttaacgttttttacggttaccgtttaacggttttttaacgttttaacccggtttcggtttaccgtaaacgttaaccgttaaaagtttaaacgtttaaaacggttaacggttacccgtttaccgggttacccgtttacccggtttaacggtttccggttaaccgttttaaccggtttttacggggtaaccccggttaacggggggttaaacccgttaacgggttaaccggttacggggtaaacggttaaccgttaaacccggtaaaaccggg

SEQ ID NO: 242848 - DNA, 602 bp, Homo sapiens
  misc_feature: GYAE6OF02F4MFB.35.85.H08.1.454.CMB.1.raw
  modified_base (285)..(285): a, c, t, g, unknown or other
  misc_feature (285)..(285): n is a, c, g, or t
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
  modified_base (406)..(406): a, c, t, g, unknown or other
  misc_feature (406)..(406): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttgcctggtaccagcaagaaagttgccaggcctccgagcctccnctattcgttggtgtcgtccacgtacgggccgtntgggtctcccgagtcgaggttcagtgctagtgctgtggacngagttcactctacaccatcagcacgtcctgctagtctagtaacgttntttcgcttaagtttacttactcgtaccgaagtactaaacttaagtaaacgttacggacgttaccgggtcccgttaaccgtaggtttccgtaccgtttaccgttttacgggacccggtaacggggtaacctaacgggtccgttaacgggtacgtaacgttaccgaaaaccggttacttcgggtacgtcgtaacccgg

SEQ ID NO: 242849 - DNA, 824 bp, Homo sapiens
  misc_feature: GYAE6OF02F85U5.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaacactctgtctgtgtctccgaggggacaggccaccctcctctcgcgcggccgacgtacgagagtcgttacgtcgacgacacgttaacgtccgtcggtacccgtaacgacgtagtaaaaggttaggtccccgaacgggtaccgtaccccgtacgggaccttcccgtacccgtaacgttccgttttgggttcggttacgtcccgtaaccgtaaggggtccccggtccgttgggttcggttaccccgttaacccggtgttaccgggttacgtacggtacgggtcgtacggtacgggttcgtgtttacgggggaacgtaaggtaccgttaccgttacctacgttcccgaaacccgttacgtacgtacggaccgaacgtcccgtcggtacgtaacggttacgttaacggtaaacggttaagttttacggttaacgttaacgttttaaacgttttcgttaaacgttaccgtaacggtaaccgttaaacttaaacgtttaaagtaacgttaccgttaccggaccgtttacccgtacggtttacgttaccgttacgttttaccgggccggtaacgggtaaccgaaccggttacgtaccggtaacgggtaacgttaaccgtaaacgggtaaaccgttacgggtacggttacgtacggtaacccg

SEQ ID NO: 242850 - DNA, 714 bp, Homo sapiens
  misc_feature: GYAE6OF02HZ561.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagcgccaccctctcctgcgagggccagtcagagttgttagcagctaacttagcctggtaccagcaagtaaacgttggccgaggcctcccgaggcctcctctattcgttttgggtcgtcgtcccgacgttacggggcccgtcgttcgggttcgtacccctaggtcgtaacggggtttcagggttcggccgtaggttcgggtccgttacggtacggggaaccgtaggttaacggtttcctacccgttcgtacccacctactaccgaacgtccgaacgcccgttagaccgtacgttccgtaggttaaacgttagttttcgtacgtttaacgtttttactttaaccgttggtacctaaggtaacctaaattaataacgttaagtccggtttaccggtcccgttaccggttaggtttaccgttaccgttaccgttttacgggacccggtaacggggtaccaagggtccgtagggtaacgtacgtaaccgtaaaaccggtacgtcgggttacggtcgtaccgg

SEQ ID NO: 242851 - DNA, 621 bp, Homo sapiens
  misc_feature: GYAE6OF02I1AKO.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcacgggccagtcagagtgttagcagcaacttagcctaggtaccagcagaagttcggccaggcctccgaggtctcccgtcattccgttggtcgtcgtccaagtcgggcctcgttcgggtctccccgtagttccgaaggtttccaaggttcggacgtaggtcggacttcgtaggggaccagtacggtttccaacgttctacaccgtacgtactacgacgtacgtccgttacgcgtaacgttcgtaggtaacgtagttttcggaccttaggtttaacttacgtcgtactagacctaagtactaagtacgtacgtcgtacctacgtagttcgtcgttacgtttcggaccgtacgggacctacggtcttacgggataacgtaccgtaaacgacgttaggtaccgagtaccg

SEQ ID NO: 242852 - DNA, 706 bp, Homo sapiens
  misc_feature: GYAE6OF02GY1QB.35.85.H08.1.454.CMB.1.raw
  modified_base (210)..(210): a, c, t, g, unknown or other
  misc_feature (210)..(210): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaatagtgatgacgcagtctccaaccactctgtctgtgtctccaggggacagacgcccaccctntcctgcacgggccagtcagaggttgttagcagcaacttagcctggtaccagtacaagtaacgttggaccaggcctccccgaggtcctcctcactttcgtttcggtgttcgtaccgtaacgtgggggccctcgttggtcgtcccctaggttcgacggtttcaggtcggactacggttggccgttggtacggggactacgggtagtttccgacctttcgtaccgtaaccgtactaccgtaacgccgtaaccgtccggtacgtacgtacgttcgtaacggttaagtttacgttttacgtacgtttaaacgtttttacgtttaacgttccgttacgtacgtaaccgttaaagtttaataaacgttacgtacggtttccgtacccgtttacgtagtttccgtacgtttaccgttttcgggaacccgggtaaccggggtaccctaagggtcgttacggaagtaaccgtaccggtaaaccggtacggtggtaccggtgtaccg

SEQ ID NO: 242853 - DNA, 689 bp, Homo sapiens
  misc_feature: GYAE6OF02I0CYX.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcgagggccagtcagagtgttagcagcaacttagcctggtaccagacaagtaaagttggaccaggcctcccgaggtcctccctctacttcggtttggtcgttcgtacctaaccggtagggcccgtgttcggtcgtccccgaggttccgtaggttcgacggtgggccgtaggtcggtctcggtgggaactacggtacgttccgaaccttctaccgtacctaactacgtacgccacggtccgtgaccgtagttacgtaggtaagtttacggttttacgacgtttagtttttaactaaccgtttgtacctaagtaacgttaaattaagttaactaacggtacttcggttacccgttaccggttagttacgttcctttacggtttccgggaccggtaaacggggttaacccgtaaggtccgttaagggacttaaccggtaaacgtaaacggtaaccggttcggtcggtaccgtacgg

SEQ ID NO: 242854 - DNA, 681 bp, Homo sapiens
  misc_feature: GYAE6OF02G0ZBJ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgagggacagagccacctctcctgcaggcagtcagagtgtagcagctaacttagcctagtaccagcaagaagttgaccgaggcctccgaggtccttaccctcgtattccgtttaggtcgttcgtacccgtaacggtcggggcccgtacgtcgggttccgttacccccgtaggttccgtaaggtttccgtagggtcgggtactagggtcgtcgttacggtacgggactaagtcgttacaccttccgtaccgtaacctactcaccgtacgtaccgtccgtacgcgtacgttcgtagtaagttacgtttgtacgttaagttttacttcgtacgttacaacgtacttaaattaataacgtacgtcgttaccgtccgttaccgttagttaccgtcgtttacgttttcggaccgggtaacgggtacccgtaaacgggtcggtaacggtacggtaccgttaacgtaaaccgggttacgtacgggtcgtaccgttaccgg

SEQ ID NO: 242855 - DNA, 667 bp, Homo sapiens
  misc_feature: GYAE6OF02JJW35.35.85.H08.1.454.CMB.1.raw
  modified_base (373)..(373): a, c, t, g, unknown or other
  misc_feature (373)..(373): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagtaagtgccaggcctcccgaggctccgctatccgtttggtgtcgtccacggtacgggcccgtcgtggtcgtcccgtagtcgaggttcaggtcggcctagttacgaccgttcgngggtaacaggtacttccaccttcgtaccacctacgttacacggccaacggtcctacgctacgtcgtaggaagttacttttggacttacgttttacttacgttcgtaccgtagtaaccgtaaattaacgttaaacgttacgtccgttaccgggttaacccgttccggttaaggttacgtaccgtttaccgttttacggggaccccgtaacgggggtaaacccgaggttaccggttagggtaacgtacgttaaccggaaaaccgttggttaaccgggttcggtaccgttacccggg

SEQ ID NO: 242856 - DNA, 506 bp, Homo sapiens
  misc_feature: GYAE6OF02FJL77.35.85.H08.1.454.CMB.1.raw
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtntgtccacgtaggggccnctggtgtccccagtcaggttcaggtggcagtggctcgtgggacagagttcactctcaccatcagcagcctgcagtctgaagtatttgctagtttattctgtcagctaatataatagctgcctcgagttcgctacgtttggaccgtagggaccaaggcctggtagactacgaaaccgtacgtggtggctacgg

SEQ ID NO: 242857 - DNA, 571 bp, Homo sapiens
  misc_feature: GYAE6OF02FHFCQ.35.85.H08.1.454.CMB.1.raw
  modified_base (369)..(369): a, c, t, g, unknown or other
  misc_feature (369)..(369): n is a, c, g, or t
  modified_base (400)..(400): a, c, t, g, unknown or other
  misc_feature (400)..(400): n is a, c, g, or t
  modified_base (425)..(425): a, c, t, g, unknown or other
  misc_feature (425)..(425): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccacccctctccctgcaggggcccagtccagagttgttagccagcaacttagcctggtaccagcagaaagttggccaggcctcccgagcctcctcatctttggtgtcgtcctagtacgggccgtcgtggtcgtccccagtctaggttcaggtggcaggttcggctcgngggacagtacgttcactcctcaccgatcgancagtcctcgctacgtctagaagttntttagcttagtttacttactacgtcagtacaattaataatacgcgtcggtacctcgtacgttcgtacttacgttacggaccggtaacgggtaccgaacgtcggtacggacgtacgtaacgtaaaccgtacgtggtacggtctaccg

SEQ ID NO: 242858 - DNA, 550 bp, Homo sapiens
  misc_feature: GYAE6OF02HQCWY.35.85.H08.1.454.CMB.1.raw
  modified_base (287)..(287): a, c, t, g, unknown or other
  misc_feature (287)..(287): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagcagagtgttagcagcaacttgcctggtaccagcaagaaagttggccaggcctcccaggctccncattctttggtgtcgtaccgacgtacggggccgcgtggtcgtccccaggtcagggttcaggtcggcaggtggctcgtggggacagtcgttccacgttctccaccatacagcacgcctgctacgtctagtaagtatttgtacttagtttattactgttcagtactaatataatagtacgtcgtccgtccgagttcgtacgttacgtttcggaccgtacgggtaccgacgcgtaggagtacgtacgaacgtagtagtacgctacg

SEQ ID NO: 242859 - DNA, 552 bp, Homo sapiens
  misc_feature: GYAE6OF02FN2HV.35.85.H08.1.454.CMB.1.raw
  modified_base (315)..(315): a, c, t, g, unknown or other
  misc_feature (315)..(315): n is a, c, g, or t
  modified_base (408)..(408): a, c, t, g, unknown or other
  misc_feature (408)..(408): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcattctttggtgtgtccactaggggccncgtggtcgtccccgagtcaggttcaggtggctaggtggctcgtgggacagtagttcactctcacctatccagcagcctgcagtctagaagttntttgctagttttattactgtacatactaattataattagcgttaggcccttaccggtagttcgtaccttacgttttcggaccggtaacggggtacctaaggtcgttaggagtacgtaccggaaacgtacgtggtacggctacgg

SEQ ID NO: 242860 - DNA, 668 bp, Homo sapiens
  misc_feature: GYAE6OF02H2XVD.35.85.H08.1.454.CMB.1.raw
  modified_base (206)..(206): a, c, t, g, unknown or other
  misc_feature (206)..(206): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctatttctggctcccagatatcactggagaaatagtgatgacgcagtctccaaccactctgtctgtgtctccgaaggggacaggacncccaccctcgttcctagccgagggccagtcaggtagttggttaagcagctaaacgttagcctaggtaccagacgaagaaagttgacctaggcctcccgaaggcctaccgtcacttcgtttggtgtacgtaccacgtacggggccgtacgtgggttctacccgtaggttcctagggtttaccagggttggtacctaggtcggtcgtcgtaggggaccagtacgtttcaacgtcctacacatcacgcacgccgtagacgtatacgtagtaaacgttatttaggtacgttaagtttaacttctacggtaactagaacctaaagttaataacgtagtccgtacggttcccgtacgtacgttacgtaccgttagttttaccggggaccgtaacggggtaaccgtacgtacgttacgggacttaacgtaaccgtaaaacggttaccggtaaggttacggaccttacgg

SEQ ID NO: 242861 - DNA, 890 bp, Homo sapiens
  misc_feature: GYAE6OF02I1CND.35.85.H08.1.454.CMB.1.raw
tcagtacagatcgtcacgaccggtgctcgatttagtatcactcagtcgcggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccgagggccaccgtcctccgagggacgcccatcgcgtcgacgaacggtccggggaccaggacgggttcgccccccgttaggaaaccccgttacggaaacgggaccccgtaaaagttcggaaacggaaaccccccgaaaaggaaacccgaaccggggacccgtaaaacggggttcggggggtttaggtacgggaaccggtaacccccccggttaggggaacggggtaacggtcccggttacggggggtccccccgttaccggggttacccccgaacggggtcccgtacgggacccgggtccggtccgggtccccccgttgggcccgttcggcccgttcgggtcccggttcgggggttccgttacggggtcccgtaagggtttcccgggtaccccggtccccgtaacggtccgggtcccgttcgtccgtccggcccgtaccccgaaggtttcggttccgtacccgacccggaccggtaaaccgggacccggggaacccaaccgggaccccgtagggacccggtccgtacggtacgggttacggaacggcccgacggacccgtacgtacccgacggtacccggtcggaccgggtaccggtaccggttcggggtccgggtaccggtacgggttaccggaacccggaccccgtaccgggaccccctaaacccccgg

SEQ ID NO: 242862 - DNA, 594 bp, Homo sapiens
  misc_feature: GYAE6OF02I1TJA.35.85.H08.1.454.CMB.1.raw
  modified_base (233)..(233): a, c, t, g, unknown or other
  misc_feature (233)..(233): n is a, c, g, or t
  modified_base (317)..(317): a, c, t, g, unknown or other
  misc_feature (317)..(317): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagaggaccagggcaccgtcnccaggagcccatcgctgcaagtccggccagaggtgcccctagaacctgaacggccaatgacgacccaagacaggccaagtggtntagacgaccctggaggacgcgtcgggcctggtccgacggcagcgctcggcccctgctgctggcctggggtcctgggcctagtcggtccgccgtagtcgggtcctcgacgtcgccgtacccgaagttcggttcgccgaccgtacgaaacggtccgggacccaacggcccgtaggaccgccgttacgacggttcgaacgtcgaaccgtcgactccgaacgccgtgaccggtacgcgtcggtcgggacacggtccacggtcccgaacgtcccgaaccccg

SEQ ID NO: 242863 - DNA, 726 bp, Homo sapiens
  misc_feature: GYAE6OF02IJQBT.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctctgctattctggctccagatatcactggagaaatagtgatgacgcagtctccaaccactctgtctgtgtctccgaggggacagacgcccaccctctcctgcgacgggcctagtcagagtgttagcagcctaacttcgccgtaggtaaccagaccgaagtaaacggttcggaccagggtccctcccgaaggtcccttcccgtacgtacgttccgttttgggtaccggttgtcccctacggttacggggccccgtcgttcggggtcccgttaccccgaagggttccgtaacggtttccggtaacggttacggggccgtaagggttcgggtaccgttcggtttaggggaacctgggtttaacgtcctaccgttcctaccgaccctaacgtccgaacgtccgacgtcccgtacgtccggtacggtaccgtaggtaaagtttacgtttaggttacctttaaggttttacttacggtttacgtaccgtaagttacaaactttaagtaaacgtacgtaccgttacgggtcccttacggtaacgttcgtacgttacgtttcggacggacgggtaaccacggtcgtacggagacttaacgaacgtaagtcgtagtcgtacg

SEQ ID NO: 242864 - DNA, 602 bp, Homo sapiens
  misc_feature: GYAE6OF02H1CDN.35.85.H08.1.454.CMB.1.raw
  modified_base (309)..(309): a, c, t, g, unknown or other
  misc_feature (309)..(309): n is a, c, g, or t
  modified_base (409)..(409): a, c, t, g, unknown or other
  misc_feature (409)..(409): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcgagggccagtcagtagtgttagcagctaacttagcctggtaccacgacagaaagttcggaccaggcctcccgaggtcctcctcacttcgttggngtcgtccacgtagggccgtcgtggtcgtcccagtcacggttcaggtcggcgagtcggcttcgcgggacaggtacgttcactctccgtactactcgacgcncgaccttggaccagtcgtaggtaagttactttacggacttaagttttacttacgtcgtacgtaacgtactaaagttaagttaaacgtaggtcgtacgggtcccgtacggtaagttcgtaccttacgtttcgggaccggtacggggaactacggcgtaggagtactaccggtaacgtacgtggtacgtctacgg

SEQ ID NO: 242865 - DNA, 639 bp, Homo sapiens
  misc_feature: GYAE6OF02GB21F.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctcccctcgcacggccgagtcagagtgttagcagcaacttagcctggtaccagcagaaagttggccaggctcccaggctcctcactcgtttggtgtgtcccacgtacgggccgtcctagggtcgtcccgacgttcgacgggttctacggtgggctaggtcggtccgttctggggaacgaggtaacgtttccaaccgttcctaccgtaacctacgtactacgacgaccgtcccgtcgtccacggttacttacggtaacggtaatttttggttactaagtttttaactttacgttagttcagtactaaagttaataacttagtacgtcggtccttaccgtagttacgtaccgttacgttttacggccgtaacggggaaccgtaacgtcgtacggagtaacgtacaacggtaacgttggaggtccgtagtaacccg

SEQ ID NO: 242866 - DNA, 609 bp, Homo sapiens
  misc_feature: GYAE6OF02HUS0G.35.85.H08.1.454.CMB.1.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcagaagtggcaggctcccaggctccncatctatggtncatccaccgngggccacgtggtatcccagccaggttcagtggcgagtgggtctagggacagtagttcacgttcncaccatcagcancctgcagtctgattcggtatttgacttagtttactacttggtctaagtcctaagtttacttaggaaacttaaccgtgggtaccccttttaccgggacgggttaccgggtttacccgggtacccgggaaaaccggggtacccggtaaaaggggttccgggtaaaccgtttaaccccggaaaccgtaaccgggtttggtaacgggtcgtttaccgggacccttaacccgg

SEQ ID NO: 242867 - DNA, 718 bp, Homo sapiens
  misc_feature: GYAE6OF02I87DA.35.85.H08.1.454.CMB.1.raw
tcagtacagatcgtcacgaccggtgctcgatttagtatcactcagtcgggcggggaggaactgctcagttaggacccaggacggaaccatggaagcccagcgcagcttctcttcctcctgctattctggctcccagatatcactggagaaatagtgatgacgctacgtctaccaaccactctgtctgtgtctccgagggacagacgccaccctctctcgcgacgggccagtcagagttgttagacagactaacttacgtccgtacggtaccgacgacgaacgtaacgtacggaccgacgaccgtaccgacgtactctacgtcttcgtttggtcgtcgtaccgtacggtacggccgtcgtcggtcgtccgtacgtcgtactacgggggggggggggggggtatcggtacgtacggtcggtcgtcggtacgggtacggtaacggtaccgttaccgtaccgtaccttaccgtaccgtacgtacgacgtaccgtccgtaccgtcgtacgtacgtacgtacgtaagttagtttacgttacgttacgtttactttacgttacgtacgtaacgtaactaattaacgttaactacgtcgtccgttacgttaccggtacgttcgtaccgttacggtttacggtaccgggtaaccgggtaccgtacggtacggttacggtaacgtaacgtaaccgtaaaccgtaacggttacggtacggtaccgtacg

SEQ ID NO: 242868 - DNA, 555 bp, Homo sapiens
  misc_feature: GYAE6OF02HCDRF.35.85.H08.1.454.CMB.1.raw
  modified_base (354)..(354): a, c, t, g, unknown or other
  misc_feature (354)..(354): n is a, c, g, or t
  modified_base (385)..(385): a, c, t, g, unknown or other
  misc_feature (385)..(385): n is a, c, g, or t
  modified_base (439)..(439): a, c, t, g, unknown or other
  misc_feature (439)..(439): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttagcctggtaccagacaagtaaatttggccagtcctcccaggcctcctcattcgtttggtgtcgtaccgacgtagggccgcgtgggtctcccagtcaggttcaggtcgnaggtggactcgtgggacagtagttcacgtcncacatcagcacgcgtgcgtagtctagtaagtatttgacttagtttattactgtnagtataatataatagtctacgtcctacgtagttcgtacttacgtttacggaccggtaacgggaaccgaagtcgtaggacgtaacgtaacgtaaacgtaacgtaggtacgtcgtacg

SEQ ID NO: 242869 - DNA, 770 bp, Homo sapiens
  misc_feature: GYAE6OF02IVN26.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcacgtggaagaaatagtgatgacgcagtcctccaaccactctgtctgtgtctccgaggggacagacgccaccctctcctgacgcggacctagtcagtagtgttacgcagacaacttacgccgtacggtaaccgagtacgaaggtaaacggttcggacccgaacgggtcctcccgaagggtcccttaccgtactacgtttccgtttggtcgttaccgtccgtacgtacggggtcctcggttcggtcgttaccccgtagttaccgtacgggttaccagggtcgtacggtcggtcggtaccgttacgggtacggtacgacggttaacggttccaacccgttccgtacaaccgtacgttacgacgtacgaccggtcctcggtacgattcggtagtaacgttaggttttcgaccgttttaagtttaccgttagtacgaccgttaacgaactttaaaacgttacgtaagttaccggtaccgttccggttaacccgtttacggtaacgtttcggttaacccgttcggtttaacggtacccgggttaacgggtaacccggttaggtacccggtaaccggtaaacgaacccgtttaaccgggaaacggttacccgggtacggttacgggcccttaaccggg

SEQ ID NO: 242870 - DNA, 566 bp, Homo sapiens
  misc_feature: GYAE6OF02HY15V.35.85.H08.1.454.CMB.1.raw
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaacttagcctggtaccagcagaagttgccaggctccagctcctcatctttggtgtcgtccacgtagggccgctggtgtcccagtcaggtttcaggtggcaggtggactcgtgggacagngttcactcncacactcagacagtcctgctagtcgtagtaagtatttagtcgttaagtttacttacgtagtcgtagtactaaattaataaagttaagtcgttacggtcccgttaccgtaggtttcgtaccttacgttttacggaccggtaacggggtaaccgtaaggtccgtaggagtactacgaaacgtaacgtggtacggactacg

SEQ ID NO: 242871 - DNA, 667 bp, Homo sapiens
  misc_feature: GYAE6OF02GPMM5.35.85.H08.1.454.CMB.1.raw
  modified_base (442)..(442): a, c, t, g, unknown or other
  misc_feature (442)..(442): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttagcctggtaccagcagaaagttggccaggcctcccgaggtcctcctcgtactcgtttaggtgtcgtacccagtacggggcctcgtggttcgtccccaggtccgtaggttccaggttcggcgtaggttcggcttcgtcggggaactaggtagttccactcctactaccactacgacgtcacgcctgcagtcgtagaagttntttcgcttaagttttacttacgtgtaccgtagtacctaaagttaacgttaaagtacggttaccgttcgggtacccttaccggtaagttacgttaccgttaccgtttttacgggacccgggttaaccgggggtaaccctaaaacgggtccggttaacggtaacggtaacgttaacccggtaaaaaccggttaacggttacgggtttacggtaccgtttaacccggg

SEQ ID NO: 242872 - DNA, 644 bp, Homo sapiens
  misc_feature: GYAE6OF02GDS4W.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcacgggccagtcagtagtgttagcagctaacttagcctaggtaccagcgaagtaaagttcggccacggtcctacccgaggcctcctacattcgtttggtgtcgtccacggtacgggccgtcgtcgggtcgtaccccgagttccgtacgggttcaagggttcggacgtaggttcgggacttcggtagggaactaggtacgttccaaccgtctaccgaccataccgacgtcacgtccgtcgaccgtacgttactaggaagtttacgtttgactttaagttttactacgttgtacaagtaacctaattaacgtaacttacgtcggttcgtacccgttacggtagtttccgtactttaccgtttcgggaccgaacggggtaaccaggtaccgtaggaacgtaacgaccgtaaacgtgtacggtagaccgtacg

SEQ ID NO: 242873 - DNA, 634 bp, Homo sapiens
  misc_feature: GYAE6OF02IHIXB.35.85.H08.1.454.CMB.1.raw
  modified_base (138)..(138): a, c, t, g, unknown or other
  misc_feature (138)..(138): n is a, c, g, or t
  modified_base (172)..(172): a, c, t, g, unknown or other
  misc_feature (172)..(172): n is a, c, g, or t
  modified_base (182)..(182): a, c, t, g, unknown or other
  misc_feature (182)..(182): n is a, c, g, or t
  modified_base (260)..(260): a, c, t, g, unknown or other
  misc_feature (260)..(260): n is a, c, g, or t
  modified_base (350)..(350): a, c, t, g, unknown or other
  misc_feature (350)..(350): n is a, c, g, or t
  modified_base (436)..(436): a, c, t, g, unknown or other
  misc_feature (436)..(436): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatancactggagaaatagtgatgacgcagtctccaacnctctgtctgngtctccgagggacagagcccacccgtctcctgcgacgggccagtccagtacgtgtagcagcaactagccgtagtaccngacagaagttcggacaggcctccacggcctcctcgacttcgttggtgtctccgagtacgggcctcgtcgggtcgtcccaggtcacggttnaggtcgctaggttgccgttgtggggatagtacgttcaaccgttctaccacactcgacgccgacgtctcgcgtagtactagtagttntttacgacgttagtttaacgtaccgttgtacgtacgtactaaagttaactaagtacgtaccgttggtacccctacggttaagttaccgttacgttaccggtttacgggtacccgtaacggggtaccttaacgggtccgttaagggtaaccgtacgttaaccggtaaaccggtaacgttagggtacggtaccgtaaccg

SEQ ID NO: 242874 - DNA, 774 bp, Homo sapiens
  misc_feature: GYAE6OF02HAJD2.35.85.H08.1.454.CMB.1.raw
  modified_base (184)..(184): a, c, t, g, unknown or other
  misc_feature (184)..(184): n is a, c, g, or t
  modified_base (211)..(211): a, c, t, g, unknown or other
  misc_feature (211)..(211): n is a, c, g, or t
tcagtacagatcgtcacgaccggtgctcgattttagtatcactcagtacgggcgggggaggaactgctcagttaggacccaggacggaaccatggaagccccagcggcagcttctcttcctcctgctattcctggcctcccagatatcactggacgaaatagtgactgacgcagtctccaaccnctctgtctgtgtctacgagggacagcncccacccttcgtctgcacggccagtcagagttgttaagcgagactaacgttacgtccgtggtaccagactaagtaacggttcgaccgacggtcctacccgacgtctcctctacgttctttcgggtcgttcggtacctacggttacgggcctcgttacgggtccgtaccgtacggtcgtacggttcacgggtcgacgtacggtcggtcgtcggtacgggacgtaaggttacccgttacgacccttccgtaaccgtaaccctacgtaccgtacggaccggtaacggtcccgtaggtacgtacggttaccggtaaggtaacgtttacgttttacggtacgtttagtttaacgtttacgtacgttactaagtaaccttaagttaacgttaagtttacggaccgttttaccgggttaccggtttaccgttagggttaccgttacgtttaccgggttttacgggacccggttaaacgggggtaacctaacgggttaccggtaacggtaacgggtaaccgttaaacccggtaaacgggttaccctacggggttacccggtacgtaacccg

SEQ ID NO: 242875 - DNA, 677 bp, Homo sapiens
  misc_feature: GYAE6OF02IQR3D.35.85.H08.1.454.CMB.1.raw
  modified_base (321)..(321): a, c, t, g, unknown or other
  misc_feature (321)..(321): n is a, c, g, or t
  modified_base (500)..(500): a, c, t, g, unknown or other
  misc_feature (500)..(500): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggaagaaatagtgatgacgcagtcctaccaaccactctgtctgtgtctccgaagggacagacgcccaccctctcctgcgacgggccagtcagagtgttagcaggcaaacgttgcctcggtaccagtacaaaggtaagtggccaaggccctaccgaggtcctaccgtntacttcgtttggtctacgtccgtacgtacggccgtcgtggtccgtaccaggttctaacggttcgaggtcggacgtaggtcggtccttcggacgggtaactaggtaccgttaccaccttaccgtacccgtaaccgtcgtacgagtccaacggtccctgaccgttgttagtagtaacgttntttacggacttttaagtttacgttacttcgtaactacgaacttaacttaagtacgtaacgtcgttaccgtaccccgtttaaggtacgttttccgtaaccgttttcggtttacccgggaaccggttaaccgggtaacctaaggtccgtaaaggtacgtaaccgttaacgtaaaaccgg

SEQ ID NO: 242876 - DNA, 581 bp, Homo sapiens
  misc_feature: GYAE6OF02G1DE7.35.85.H08.1.454.CMB.1.raw
  modified_base (437)..(437): a, c, t, g, unknown or other
  misc_feature (437)..(437): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagcaacttagcctggtaccagcaagtaaagttggaccaggcctacccgaggccttccctcacttcgtttggtgttcgtacccgacgtacggggcccgtcgtgggtcgtaccccgagttcgaggtttcaggtggcagtggctcgtgggacaggtacgttccactctcacctatcgacgcacgcctagctagtctagtaacgttnttttcgcttagtttacttactcgtacagtactaaattataatacgtaccgtacgtcctacggtagttcgtacgttacgtttcggaccgtaacggggaacctaggcgttacggatacgtacgaaacgtcgtaggtacgtcgtacg

SEQ ID NO: 242877 - DNA, 611 bp, Homo sapiens
  misc_feature: GYAE6OF02FY1K1.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgtagcagctaacttacgcctggtaccagccaagtaaagttcggccgaggcctaccccgagggccttccctcacttcgtttgggtgttcgtccagtacggggccctcgttgggtctcccagtccaggttcaggtcggctaggtcggcttcgtagggacaggtacgttccgacttccgtaccaccattccgagctaacgccctgactagtcgtagtaaagttacttttgactttaagttttaacttaccgtgttaccagtacctaaattataaacgttagtacgttcggtacccttccggtaagtttcgaccttacgtttcggaccgtaacggggaccaaggtcgtaggacgactaccgaaacgtacgtaggtcggtataccg

SEQ ID NO: 242878 - DNA, 590 bp, Homo sapiens
  misc_feature: GYAE6OF02IFGIY.35.85.H08.1.454.CMB.1.raw
  modified_base (240)..(240): a, c, t, g, unknown or other
  misc_feature (240)..(240): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctaccaaccactctgtctgtgtctccgaggggacagacgcccaccctctcctgccgagggccagtcagagtgtagnagctaacttagccttggtaaccagcgaagtaaagttcggccaggcctcccgaggtcctcccgtctagttccgttttgggtgttcgtccacgtacggggcctcgtcggtcgtcccgagtcgaggttcagtggctagtcggctcgtgggacagtacgttcactcgtccactatcagcacgctgacngtcgtagaagttntttcgtacttagtttactttacgtgtacgtagtactaaagttaataagtacgtcgttcgtccgttacggtacgttcgtacttacggtttcggaccggtaacgggtaaccgaggtcgtaggaagtacgtaacgaaccgtagtcggtacgctacg

SEQ ID NO: 242879 - DNA, 565 bp, Homo sapiens
  misc_feature: GYAE6OF02F5H8K.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttcggaccaggcctcccaggctccctcattcgtttggtgtcgtccacgtaggggccgcgttggtcgtccccagtcaggttcaggtggcaggtggcctcgtggggacagtagttcactctccacatcagcgagccctgcagtctagaagttagtttcgacgttagttttattacgttgtactagtactaattaataattagccgttcggccctacggtagttcgacttacgtttcgggacccgtaaggggacccaaggtccggtaggaagtactacgaaaccggtacgtcggtaggtctacgg

SEQ ID NO: 242880 - DNA, 786 bp, Homo sapiens
  misc_feature: GYAE6OF02G4JSX.35.85.H08.1.454.CMB.1.raw
tcagtacagatcgtcacgaccggtgctcgatttagtatcactcagtcgcggggaggaactgctcagttaggacccagacggaaccatggaagcccagcgcagcttctcttcctcctgctattctggctccagatatcactggagaaatagtgatgacgcagtctccaaccactctgtctgtgtctccgaggggacagacgccaccctctccgtgcgacgggccagtcgagagttgttagcagactaacgttacgccttaggtaacccaggactaaaggtaaacggttcggaccccgaagggtcccttaccccgaagggtccttacccctacgtaacgtttccggtttttagggtcggttaccgttacccgtaaccggttacgggggtcccctcggtttcggggttccgttacccccgtaaggttcccgaaggtttccgaaggttcgggaccgtaggtcggtcttacggtaggggactaggtacgttccaacgttcctacgaacctaacgtacaaccggaccgtacgtcccgtggtacgtacgttaccgtaggttaaacgttcgttttacgactttaaggttttaaacctttacgtacgttaacgtaaccgttaacttaaagttaaacgttaaagttacggacccgtttacgggtacccgttaccgggttaagtttccgtaccgtttacgttttaccggggacccggtaacgggggtaacccaacgggttcgtaacgggtacgtaacggtaaccgaaaacggttacgtcgggtacggtaccgtacgg

SEQ ID NO: 242881 - DNA, 726 bp, Homo sapiens
  misc_feature: GYAE6OF02HZ5VG.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggagaaatagtgatgacgcagtctccaaccactctgtctgtcgtctccgaggggacagacgcccacccttctccgtgcgacgggccagtcgagagttgttagcagctaaacttgcctaggtaccagcaagtaacgtcggaccaggcctcccgagtcctccgtcgtacttccggtttggtcgttctcccgagtccgggccgtcgtggtaccgtcccgaggtcgtaggttcgaggttcggaccgtaggtcggtctaggtacgggacctagggttacgttacctccgttaccgtaccctaacgtacgttaccgacggaccgtacggtcctcggtacgtacgttccgttaaggtaacgtttacgttttcggtacttttacggttttacttaacgttcgtaccgtaacgttactaaagttaacgttaacgtaccgttacggttccggtccccggttaggtaaccgtttcgttaccgttacgttttcccgggaacccggggtaagggtaacccgtaacggtcgtaacggggtaccttaacggtaacccggtaaacgttaccggttacggttaccggtaccgttacccgg

SEQ ID NO: 242882 - DNA, 732 bp, Homo sapiens
  misc_feature: GYAE6OF02JZGLQ.35.85.H08.1.454.CMB.1.raw
  modified_base (185)..(185): a, c, t, g, unknown or other
  misc_feature (185)..(185): n is a, c, g, or t
  modified_base (309)..(309): a, c, t, g, unknown or other
  misc_feature (309)..(309): n is a, c, g, or t
  modified_base (449)..(449): a, c, t, g, unknown or other
  misc_feature (449)..(449): n is a, c, g, or t
  modified_base (587)..(587): a, c, t, g, unknown or other
  misc_feature (587)..(587): n is a, c, g, or t
tcagtacagatcgtcacgaccggtgctcgatttagtatcactcagtcggcgggggaggaactgctcagttaggacccagacggaaccatggaagccccagcgcagcttctcttcctcctgctattctggctcccagatatcactggagaaatagtgatgacgcagtctccaacactctgtctgtntcctccgaggggacagacgcccaccctctcctgccagggcccagtcagagtattacggaacacgtagtctggacctagcaagaaaccgtggccgaggcctaccgaggcctacctcgatctaagngggtcacgtactacccgaccgacgggacccttacgtagggttacccacccggtacgaccgtacggtttcccgaagggtacggtcgtacggttcgggtacgtacggggactaaggtacttcccgacgtcctaccaaccgtntcacggacaacgtccgtaagcccttaggcgttacgaaacggttaactttgtaccgcgtttaaggttacctacgttaccgtaggttactacgttaccgttaaagtttttaagccggtacctttacgggaccccgggttnttacccgtttaccgttaccgggtttacgggccggggttaaaccgggtacggtaaacggggtttccgaaagggttaaccctaaacgggtaaaacggttaccgggttaacggttacgggaacccgtttacggaacccgttaaacccg

SEQ ID NO: 242883 - DNA, 575 bp, Homo sapiens
  misc_feature: GYAE6OF02FFSIT.35.85.H08.1.454.CMB.1.raw
  modified_base (300)..(300): a, c, t, g, unknown or other
  misc_feature (300)..(300): n is a, c, g, or t
  modified_base (430)..(430): a, c, t, g, unknown or other
  misc_feature (430)..(430): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccacccctctccctgcagggccagtcagagtgttagcagcaacttagcctggtaccagcagtaaagttggccaggctcccgagctcctcatctttggtntcgtccacgtacggggcccgcgttgggtcgttcccccgagttccgtaaggtttcaggtgggcaggttggcttcgtgggacaaggacgttcaccttctcacccatcagcagtcctgcagtcctagaagttntttgcttagtttattactgtcagtcaattaataatagcttcggaccttcgtagttcgtcttacgtttgggccgtaaggggaccctaaaggtccgttagggaagacgttaccgaaaaaccggttacgtaggttcggtaccgtacgg

SEQ ID NO: 242884 - DNA, 597 bp, Homo sapiens
  misc_feature: GYAE6OF02H48LH.35.85.H08.1.454.CMB.1.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (336)..(336): a, c, t, g, unknown or other
  misc_feature (336)..(336): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaacagtgatgacgcagtctccagccatcctgtctgtgtctaccgaggggganagacgcccaccctcgtctgcagggcctaggcagactattagaccaacttagcctggtatcagctaagaaacctggccaggcctcccgaggcctccncatctanggtnacactccacgaacgggcctacgtggtacncccagaccgtagggttcaaggtcggctacgggtcgggtacgtggggaactacgggtacgttcacctctccaaccactacgagcacgtccgtgctagtcgtgtagtgttagtttgacttaagtttatttacgttgtacgtagtactattatacgtattaaacgtcggtcccgtacggtcggtacgttcggtaccggtaacggtaacgtaacggtaacggtaaccgtacgtaacgtacgtagtacggtacgtacgtctaaccg

SEQ ID NO: 242885 - DNA, 670 bp, Homo sapiens
  misc_feature: GYAE6OF02I0EUR.35.85.H08.1.454.CMB.1.raw
  modified_base (370)..(370): a, c, t, g, unknown or other
  misc_feature (370)..(370): n is a, c, g, or t
tcagtacagatcgtcacgaccggtgctcgatttagtatcactcagtcggcgggggaggaacgtgctcagttaggacccagacggaaccatggaagccccagcgcagcttctcttcctcctgctattctggctccagatatcactggagaaatagtgatgacgcagtcctccaaccactcgtgtctgtgtcctccgaggggacagacgccaccctctcctgcacgggccagtcagagtgtagcaagcaacttgcctaggtaccagacgaagtaaagtcggacctaacggcctaccacgggtcctacccgtcgtaagttccgttttagggactcgtacccgtaagtcgggcctcggttgggtaccgtacccngtacggtacggttctaggtcggactaggtcgtacgcgtagggaacctagtacgttcccacttaccgtcgtaacctacgtcgaacgctacgtcctggactacggtagttaacggagttacgtttgacctttaagtttaacgtttcaggtaccgtagttaactaacgttaaataactaggttcgtacgtaccggttacgtaagttcgtaccgttacggttacgacccgggaagggtaaccctaaggtccgttagggtaaaccgaacttaccggaaaacgtcctttgggaccgtggtaacccg

SEQ ID NO: 242886 - DNA, 591 bp, Homo sapiens
  misc_feature: GYAE6OF02GNHQO.35.85.H08.1.454.CMB.1.raw
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacacagtctccaaccactctgtctgtgtctccaggggacaggagccaccctctcctgcagggccagtcagagtgttagcagcaacttacgcctggtaccagcagaaagttggccaggctcccgaggctctcatctttggtgtgtccacgtacgggccgcgtggtcgtccccagtctaggttcaggtggngngtggctcgtgggacagagttcactctcgaccatcagcacgcctggactggttcctaggtaacgttattttcggactttagttttaattaccttggtaactaggtaccttaattaacttaaagtaacttcgttacggtcccgtccggtaagtttcgatttaccgtttggacccggaaggggtacccaagggtcgagggtacgtaactaccggtaaaccggtacgttggtacggtacgttccgg

SEQ ID NO: 242887 - DNA, 740 bp, Homo sapiens
  misc_feature: GYAE6OF02I4URS.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagctaactagcctggtaccagacaagtaaagttggaccacggcctcccgaggtcctacccgtcgtactttcggtttggttcggttcgtaccccgtaacggtaccgggcccgtccgttgggttcgtccccctaggttctacgggtttcgtaacggttggggacctggtacgggtcttacggtaggggaacctaacggtcgtttccgtaccttccttacccgaaccctaagtcccaacggcctacggtaccccgtgaacctacggttacccgttaaggtaacgtttaagttttccgtacgttttaaagtttttaccgtttaccgttacggtaaccttacggtaacttaaaacgttaagttaaacgtacggttcgttaccggttacccgttacccggttagttccgtaccgtttccgttttaccgggaccggtaacgggtaaccgtacggtacggtacggtaagtaccgtaacgaaaccggttacgtacggttacggaccttacgg

SEQ ID NO: 242888 - DNA, 839 bp, Homo sapiens
  misc_feature: GYAE6OF02JL281.35.85.H08.1.454.CMB.1.raw
  modified_base (232)..(232): a, c, t, g, unknown or other
  misc_feature (232)..(232): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggcctcccagatatcacgtggagaaatagtgatgacgcagtcctaccaaccactctgtctgtcgtctaccgagggacagacgcccacctctaccnggcaggccagtcgagtagtgtacgcaagcaacgttacgaccgttacggacctaggtaccaaggtaacgttcggaccgacggtacctacccggaagtcccgtaccgtacctaacgtttccgtttagggttcgttaccggtacccgtaaccgggttaccggggacccgttcgggttaccggttaccggtaccccgtacgttcccggtaagggtttacccgaagggttccggacgttacgggtacggttaccgttcggtaacgggtaccgtaacggttacgtttcccggaaaccgttcccgtaaccgttaacccgtaaccgtcgtaaccggtacccgttacggtacccgtaaggaccgttaaccgggttaccgttaaacggttaacggtttacgttttaaccggtaaacgtttttaacgggtttaactttaaccgtacggttacgttaacgttaacgttaaagtttaaaccgttaacgttaccggttacgttacccggtttacgtaacggttaccgtttaacggttcgttttaaccggttaccggtaccgggttaacggtaaccgttaacgggtaccgttaagggtaaccttacggtaactaaacccggg

SEQ ID NO: 242889 - DNA, 645 bp, Homo sapiens
  misc_feature: GYAE6OF02IS7U3.35.85.H08.1.454.CMB.1.raw
  modified_base (331)..(331): a, c, t, g, unknown or other
  misc_feature (331)..(331): n is a, c, g, or t
  modified_base (347)..(347): a, c, t, g, unknown or other
  misc_feature (347)..(347): n is a, c, g, or t
  modified_base (406)..(406): a, c, t, g, unknown or other
  misc_feature (406)..(406): n is a, c, g, or t
  modified_base (448)..(448): a, c, t, g, unknown or other
  misc_feature (448)..(448): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatcgacgcagtcctaccaaccactcttgtcctagtcgtcctaccagggggaccagacgcccaccctctcctaggccgtacgggcccagtcaggtacgtgttagcagcaacgttagcctagtaccagcaacgaaggttcgaccgaggtacctcccgaggcctcctntagttccgtttggttnaagttcccgacgttacggggccctgttcggttacgtccccgtagtacgtaggtttcccngggtaggccgtacggttggccctttcggtggggaacttacgngttcacgtctacctaccgtactccgacgacgtacgcgttcgctacggtccttaggaacttgtttaacgccttaagtttcgtacttacggtagtacgtactaaatacgttaaactggtaccgtcgtacgttaaccgtggttctacgttcgttacggcgtaacgggactaacggtgtacggtacggtataccgtaaacg

SEQ ID NO: 242890 - DNA, 792 bp, Homo sapiens
  misc_feature: GYAE6OF02IDFLM.35.85.H08.1.454.CMB.1.raw
tcagtacagatcgtcacgaccggtgctcgatttagtatcactcagtcgcggggaggaactgctcagttaggacccagacggaacatggaagccccagcgcagcttctcttcctcctgctattctggctcccagatatcactggagaaaatagtgatgacgcagtctccaaccactctgtctgtgtctccgaggggacagagccaccctctcctgcagggccagtcagagtgttagcagcaacgttagcccgtggtaaccagacaagtaaagttcggaccaggctcccgaggcccttcctactctttacggtttgtcgttccgtacctaacgggtccggtcgtcggtcggtccgtaccgtagtacggttagtacggtggtaccggagtacggtcgtccgttaggaccgggtaacgtaacggttaccgttaaccgttaccgtactacccgtaactacgtacgaaccggtacccgtaacgtccggtacgtaaccgttacggtaccgtaaaggttaacgtttttacgtttacggttaacgtttttaaacggtttttaaccgtaacgtttacggtacgtaaacgttaaaacgttaaaagtttaaacgtaaaccgttacgtaccgggttacccgttaccccggttaaacggttcggttaacccggttaaccgtttttacggggtttaacccggaacccgggggttaaccgggtaaaacgtcgggttacggtaaacggaaccgttaaccggtaaaacccggaaacgtttaccgggtacgggttaccgtaccgtaaccgg

SEQ ID NO: 242891 - DNA, 693 bp, Homo sapiens
  misc_feature: GYAE6OF02J3KKX.35.85.H08.1.454.CMB.1.raw
  modified_base (93)..(93): a, c, t, g, unknown or other
  misc_feature (93)..(93): n is a, c, g, or t
  modified_base (114)..(114): a, c, t, g, unknown or other
  misc_feature (114)..(114): n is a, c, g, or t
  modified_base (136)..(136): a, c, t, g, unknown or other
  misc_feature (136)..(136): n is a, c, g, or t
  modified_base (143)..(143): a, c, t, g, unknown or other
  misc_feature (143)..(143): n is a, c, g, or t
  modified_base (147)..(147): a, c, t, g, unknown or other
  misc_feature (147)..(147): n is a, c, g, or t
  modified_base (153)..(153): a, c, t, g, unknown or other
  misc_feature (153)..(153): n is a, c, g, or t
  modified_base (155)..(155): a, c, t, g, unknown or other
  misc_feature (155)..(155): n is a, c, g, or t
  modified_base (165)..(165): a, c, t, g, unknown or other
  misc_feature (165)..(165): n is a, c, g, or t
  modified_base (168)..(168): a, c, t, g, unknown or other
  misc_feature (168)..(168): n is a, c, g, or t
  modified_base (215)..(215): a, c, t, g, unknown or other
  misc_feature (215)..(215): n is a, c, g, or t
  modified_base (670)..(670): a, c, t, g, unknown or other
  misc_feature (670)..(670): n is a, c, g, or t
tcagtacagatcgtcacgaccggtgctcgatttagtatcactcagtcggcgggggagaactgctcagttaggacccagacggaaccatggaanccccagcgcagcttctcttcncctgctatctgcctccagatcncagaganaatngatgcncngtccaccacnctntcgtactggtctacgacggacggacacggtccaccctcctcgtccgngccggtaggtccaggtacaggttacggtctacgccgaagttaccacgttcgccgtactacgagtcgaagttaccggtcgaactccggtcctacccggcgtttcctacgtattaccgttttgggttaccggtgtacccgtaaccggttccggacggccgttacggtacggtcccgtaccgtaagtccggtttaacggccaggttcaaccggcgggtttcgacccggtagaccgtacgtaacgtttaccgccctaacggttcacccgttacacgtcgtaaccgcgtacccgacgtagtaccgtagttactacggtatttacgacgttaaccgttacttaacttcgtactgtaaacgataacgttgtaacccgtgtacgtaccgtcctattccgggacttccgttaggaccggacgtacgacgtacgtagttaaccgacgtacggtaacgttaccggnggttaccgagttacctaacccgg

SEQ ID NO: 242892 - DNA, 700 bp, Homo sapiens
  misc_feature: GYAE6OF02HSTOB.35.85.H08.1.454.CMB.1.raw
  modified_base (502)..(502): a, c, t, g, unknown or other
  misc_feature (502)..(502): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtcctccaggggacagagcccaccctctcctgcagggccagtcagtagtgttagcagactaacgttagccctggtaccagaccaaggtaaagttggccagggcctacccgaggcctccctcattcgtttgggtagttcgtcccgacgtaggggcccgtcgttgggtccgtccccgtaggtcgtaagggtttccaaggtcggactagggtcggacgtcggtacggggactaaggtacgttactactcgtcccaaccgacttcacgtcagcctgcctaggtctacggaagttagtttcgtacttaggttttacttacgtnttaccgagtaactaaagttagtaaacgttacggtaccttacgggtacccgttacggtaaggtttcgtaccgtttaaccggttttccgggaacccgggtacggggtaaaccccgttaagggtaccggttaacgggtaagttaaccgttaaaccggtaaaacccggttaacgttacggggttacggaccgtttaacccgg

SEQ ID NO: 242893 - DNA, 570 bp, Homo sapiens
  misc_feature: GYAE6OF02GBDZ9.35.85.H08.1.454.CMB.1.raw
tcagtacagatcgtcacgaccggtgctcgatttagtatcactcagtcgcggggaggaactgctcagttaggacccagacggaaccatggaagccccagcgaagcttctcttcctcctgctattctggctcccagatatcactggagaaatagtgatgacgcagtctccaaccactctgtctgtgtctccgaggggacagagccacctctcctgcagggccagtcagagtgttagcagcaacttgcctggtaccagcaagaagttggccaggctcccaggcctcctcattcgtttggtgtgtccacgtacgggcccgctggttcgtccctagtccaggttcagtggcaggtgctcgtgggacagcgttcactctaccacatcacgcagcctgcagtctagtaagtgtttgtactagttttatacttcgtctagactaaattaattaagtacgtcgttcggtccgttcgtacgttcgtcttacgttttcggaccggtacgggaaccgtaacggtaccggtaggtacgtacgtaccgaaacggtaccgttacggtacggtcgtacgtacccgg

SEQ ID NO: 242894 - DNA, 659 bp, Homo sapiens
  misc_feature: GYAE6OF02I6SNR.35.85.H08.1.454.CMB.1.raw
  modified_base (259)..(259): a, c, t, g, unknown or other
  misc_feature (259)..(259): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctcgaggggacagacgccaccctctcctgcacgggccagtcagagtgttagcagcaacttagcctaggtaccngacaagaaagttggacccaggcctccgaggctacctcgatcgttggtgtcgtccaacgtcgggcccgtacgtggtcgtcccaagttccgaggtttcacggtggacctaggtggtcctacgtcggggaactaggtacgtttaccaccttcgtaccgaccgtacgtacctacgacgacgtccttcggacctacgtacgtacgtaagttactttcgtacgttagttttaattacgtcgtacgtacggactaagttaataagtacgtcgtccggtacctcggttacgtacggttacgttaccgttttacgggaccgggtaaacgggtaacccgaacggttacgtaacgggtaacgtaaccggtaaaccgtaaaccgtaacgttacggtaccggtcgtaacccgg

SEQ ID NO: 242895 - DNA, 776 bp, Homo sapiens
  misc_feature: GYAE6OF02JF6HS.35.85.H08.1.454.CMB.1.raw
  modified_base (609)..(609): a, c, t, g, unknown or other
  misc_feature (609)..(609): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagactatcactggagaaatagtgatgacgcagtctccaaccactctgtctgtgtctcaggggacagagcccacctctcctgccacgggccagtcaggagttgttagcagtcaacttagccgtaggtaccagcaaggtaaaggttcggcccaagggtcctccccgaggtcctccgtactattcgtttgggtcggttcgttcccgaacggttacggggccccgtagttggggttaccgtccccgtaggttcgtacgggtttctaagggtcgggtaccgtagggttcgggtcccgttacgggttcggggaaccttacgggtaccgttttacccgtaacccttcccgttaaccctaacccgtacgttacccgtacggaccgtaaccggtcccgtacggtcgtaaacggttctacgggtaaaacgtttacgtttttacggacgttttaagttttaaccttaacgttcggtaactaacggtnttaaacttagttaaacgttacgttacgttaccgtcccgttacggtaccggtttgttacccgtttacggtttaccgggaccggtaacgggggaacctaacggttaccggtagggtaaccgtaacgttaacggtaaaacccgtggtttacgggtccgggtatacccggg

SEQ ID NO: 242896 - DNA, 751 bp, Homo sapiens
  misc_feature: GYAE6OF02GSRH5.35.85.H08.1.454.CMB.1.raw
  modified_base (199)..(199): a, c, t, g, unknown or other
  misc_feature (199)..(199): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctactctggctccgaggaaccactggagaaacagtgaatgacgcagtctccagccatcctgtctgtgtctccgagggganagacgcccaccctctcctgccgagggccagtcagacttattacgtacctaattagccttggtactcacgacaaggaaaccttggtaccacggtccctacccgacggtccttcccctatacttccgttaggtcgggtcacctacctaccccaccggtacgggcccttaacgtcgggtaacctccccggaagtcccgtaagggtttcaacgggtcggtacgtacgggtttcggggtcgtaacggggaacgttaagggttaccgtttccgaaccttccgtaaccacccgttatccgaacgacgtaccggtccgtacggtacgtcgttcctagtacgtttagttaagtttttcgacgttttaaggttttaactttcgtacgttcacggttacttatttacgttacgtaacgttaaccggttccgtacccggttcggttaaccggttacggttccgggtaaccggtaacgggtaaccggtaacgggtaaccggtaaccgtaaccggtaaaccgttacggtcgggtaccgtccgtacggtaccctacgtacgtttccg

SEQ ID NO: 242897 - DNA, 714 bp, Homo sapiens
  misc_feature: GYAE6OF02JWYNW.35.85.H08.1.454.CMB.1.raw
  modified_base (234)..(234): a, c, t, g, unknown or other
  misc_feature (234)..(234): n is a, c, g, or t
  modified_base (307)..(307): a, c, t, g, unknown or other
  misc_feature (307)..(307): n is a, c, g, or t
  modified_base (324)..(324): a, c, t, g, unknown or other
  misc_feature (324)..(324): n is a, c, g, or t
tcagtacagatcgtcacgaccggtgctcgatttagtatcactcagtcgcggggaggaactgctcagttaggacccagacggaaccatggaagccccagcgcagcttctcttcctcctgctatctggctccagatatcactggagaaatagtgatgacgcagtctccaaccactctgtctgtgtcctccgagggacaggacgcccaccctctccgtgccagggccaggtcaaggngtgttagcagactaacttacgccttaggaccagcaaggtaacgtggacccacggtcctaccgagtccctcctnactcgtagtcgggtacnctacctaccgaccgacgggcctaacggtggtaccctaccggacgacccggtaggttaccgagggtacggtaccgtagggttcggggtacttagggggaacccgtaaggtacgttaccccggtacttacccgtacccgtaaccctacgttacgaacgtaaccgtccgtacccgtacggtaccgtaacggttccttaggtaactttaggttttatttacgttaccgtttaacgttttattacccggttaggttactaacgttaccgtaaattaccgttaattaacggtccgttacgtcccgtacgttagtacgttacgtttacggtccggaacggtacggtaaccggtatacggtacggtaagtaccgtaacgtaacggtacccgtgtacgg

SEQ ID NO: 242898 - DNA, 743 bp, Homo sapiens
  misc_feature: GYAE6OF02J2VKF.35.85.H08.1.454.CMB.1.raw
tcagtacagatcgtcacgaccggtgctcgatttagtatcactcagtcgcggggaggaactgctcagttaggacccagacggaaccatggaagcccagcgcagcttctcttcctcctgctattctggctcccagatatcactggagaaatagtgatgacgcagtctccaaccactctgtctgtgtctccaggggacagagccaccctctcctgcagggccagtcagactattagtaccattagcctggtatcagcaagaaacctggtacaggcctcccgaggtcctcccgtcagttcctagttggtacgccactcccgaccgacggggccctaacgttcgggtaactccccgaaggtccccgaaagggttttccaaacgggttcggggtacctagggtttcggggttaccgtagggggacctacgggtacgttccaccttccgtcccaacctagtccgaacggtcctaacggcccttacggccgtaggttcctcggtaatcgttaactttttcggacgtttacggttttaattaccttgggttacctaggtacctttaaagttttaagtacgttaaatttaaccggtccgggttccctaccgggtttacgggaacccggttttaccgggaaccggttaaacggggtaacccggttaaaggggttaaccgggtaaaccggtttaacccggaaacgggttaaccgttcggggttacggttcccgttacggacccttaccgttaccg

SEQ ID NO: 242899 - DNA, 711 bp, Homo sapiens
  misc_feature: GYAE6OF02HFPOJ.35.85.H08.1.454.CMB.1.raw
  modified_base (533)..(533): a, c, t, g, unknown or other
  misc_feature (533)..(533): n is a, c, g, or t
  modified_base (541)..(541): a, c, t, g, unknown or other
  misc_feature (541)..(541): n is a, c, g, or t
  modified_base (585)..(585): a, c, t, g, unknown or other
  misc_feature (585)..(585): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatgtgatgacgcagtctccaaccactctgtctgtgtcctccgaggggacaggacgcccaccctctcctgccagggccagtcagtagtcgttagcagactaacgttagccgtaggtaccagacgaaggtaaagttcggaccgaaggtcctaccccgaagggtcctcccgtactacgtttccgtttgggtcgttacgtacccgtaacggtaccgggtcccgtcggtttcggtcccgttaccccgtaggttaccgtacggttcgaagggtcggtaccggtaggtcgggtccttcggtacggggataggttaccgttccgtaacctccgtacccaccagttccgaacgtaccgaccgtcgttacgaccgtagttcctaaggaacgttntttacggntttaacgttttactacgtagtacctagtacttaaatacgttaanacggttccgtacgtcccgtagttacgttcgtacctttccgggttagacccggggtaacggtaccggtaagtccgttaagggaattaacctaacggtaaaaccgttggtacggtaccgtaggtaacc

SEQ ID NO: 242900 - DNA, 653 bp, Homo sapiens
  misc_feature: GYAE6OF02GK7LB.35.85.H08.1.454.CMB.1.raw
  modified_base (239)..(239): a, c, t, g, unknown or other
  misc_feature (239)..(239): n is a, c, g, or t
  modified_base (291)..(291): a, c, t, g, unknown or other
  misc_feature (291)..(291): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtcctccaaccactctgtctgtgtctccgaggggacagagccaccctctcctgcagggccagtcagagtgttaacngacaacttgcctggtaccagcaagaaagttggaccaggctccgaggctcctnattcgtttggtgtgtcccgacgtacgggccgtcgtcgggtcgtccaggtccgtagggttccaggttcggccgtaggttcgggaccttcggtcggggtaactaagggtacgtttaccaccttccgtaccaacctactacgacgaccgacgtcccgtgccgtagttacgtagtaagttacgtttcgacgttagttttacgttacgttacgtacgacgtactaaattaacgttaatcgtacgtcgtacccgttcggtacgttacgtcgttacgtttcgggaccggtaacgggtacctaacggtcggtaaggtacgtaacgtaaccgtaaaccggtaccgttacggtacggtacgtccgtaacccg

SEQ ID NO: 242901 - DNA, 543 bp, Homo sapiens
  misc_feature: GYAE6OF02FZA3K.35.85.H08.1.454.CMB.1.raw
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgttagcagcaacttagcctggtaccagcagaagttggccaggctcccaggcctcctcattcgtttggtgtcgtccacgtaggggccgtcgtggtcgtcccgagtcaggttcaggtggcaggtgctcgnggacagtctcactctcacntcagcacgcctgcgagtctagtaatgttttacgacgttagtttactacgttgtacacgtataattaataatacgtcgtcggtcctacgtagttcgacttacgtttcggaccgtacggggtaccaggtcgtaggacgtacgtacgtaaaccgg

SEQ ID NO: 242902 - DNA, 735 bp, Homo sapiens
  misc_feature: GYAE6OF02JALL1.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggagaaatagtgatgacgcagtctccaaccactctgtctgtgtcctccgagggacagacgcccacctcctccgcgcgacgggccagtcgagtaggttgttaacgcgagacctaacgttacgcgtacggtaaccagacgaagtaaacggttcggccgacggacctacccgacggtcccttccctaccgtcgtttcgttgggtacttccgtaccgtaacggtccgggcccgtcgttcgggttaccgtcccgtaacggttcggtacggttcgacggttcgggtcctagggtcgtccgtcggtacgggacgacgtagttccacttcgtaccgactagaccgtacgcgtacgtccgtgaccgtagttccgtaagggtaacttagtttaccgtagttaacgttttttaacgtcgtttacgttaacgaacggttaacgtaatttaaaacgttcgtaacggttcccgttaacgtcccgttacggtaaccgttttcgtaccggttttacctttacggggaccccggtaacggggtaactacgggttccgaggtaaacgtaccgtaacgtaaccgttaaggttcggtacggaccgttaccgg

SEQ ID NO: 242903 - DNA, 516 bp, Homo sapiens
  misc_feature: GYAE6OF02FURJK.35.85.H08.1.454.CMB.1.raw
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (356)..(356): a, c, t, g, unknown or other
  misc_feature (356)..(356): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctccncatctttggngtgtccactagggccnctgggtntccccagtcaggttcagtggcagtggctcgtgggacngagttcactctcaccatcagcagcctgcagtctagaagtatttgctagtttattactgtcagtcaatataatagctggcctcgagttcgctacgtttcggaccgtaagggacctaaggcgttaggagtacgtacgaaaccgtaacgtggtacggctacgg

SEQ ID NO: 242904 - DNA, 676 bp, Homo sapiens
  misc_feature: GYAE6OF02I4BWC.35.85.H08.1.454.CMB.1.raw
tcagtacagatcgtcacgaccggtgctcgatttagtatcactcagtcgcggggaggaactgctcagttaggacacagacggaaccatggaagccccagcgcagcttctcttcctcctgctattctggctcccagatatcactggagaaatagtgatgacgcagtctccaaccactctgtctgtgtctccaggggacagacgcccaccctctcctgcagggccagtcagagtgttagcagctaacttagcctggtacccagacaagaaagttcggccaggcctccgacggcctccgtactacttcgttttaggtcgttcgtcccgtacgtacggggcccgtcgtcggttcgtcccgaggtccgtacggtttcgaggttcgggctaggtcggcgtcgtagggctaggtacgttcactctaccaccgactcacgaccacgtccgtgactagtctaaggtaacgttattttcgacgttacgttttaacttacgtcgttacgtaagtaacttaagttaaattaaaccgtacgtaccgttacggtcccgtttaaccggtacgtttaccggtaccgtttacggttttaccgggaccggttaacccggggaacctaaacgggtccggttaaggaaccgtaacgttaaaccggtaaccggtaaccgttagggttacccggtacgg

SEQ ID NO: 242905 - DNA, 770 bp, Homo sapiens
  misc_feature: GYAE6OF02FQ7O2.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttacgcctggtaccagcaagtaaaggttgaccaggcctcccgaggcctccctctattcgtttggtgttcgtcctaacggttacggggcccgtcgttcgggtccgtccccgtaggttccgtacggtttccgtaagggttcgggaccgtagggttcgggtccgttcggtacgggggaaacctaagggtacgtttacccgaaccgttttcccgtaccctaccgtacgttaccgacggtacccgacggtcccttcgggactaacggttcctaagggtaaagtttacgtttttacggaccgttttaaagtttttacgttaaccgtttggtaccgtaacggttactaaaagtttaactaaacgtttacggtaccgtttccggtaacccgtttaccggttaaggtttccgtaaccgttttaccgggttacgggtacccggtaaacggggtaaccctaacgggtcgttaaccgggaacgttaaccgtaaacggtaaaacccggttacggttaggtacccggtacgttaacccggg

SEQ ID NO: 242906 - DNA, 604 bp, Homo sapiens
  misc_feature: GYAE6OF02JCDWO.35.85.H08.1.454.CMB.1.raw
  modified_base (593)..(593): a, c, t, g, unknown or other
  misc_feature (593)..(593): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaagttggccaggcctcccgaggcctcctcattcctttggtgtcgtccacgtacggggccctcgttgggtcgtcccctaggttccgaggtttccaggtggcctaggttcgggcttcggtggggacaggtacgttccaccgtttcacctaacctactccaggccacggccctagcctaggttacgtgaagttgtttttacgacttagtttatttactttacagtactaatataagttgacgttcggtcctcggtattcgctttacgttcggacgtacggggtaacctaggccgtaggtacgtacgtaaccgaaacggtaccgtagggttaccgngttaccgaccg

SEQ ID NO: 242907 - DNA, 580 bp, Homo sapiens
  misc_feature: GYAE6OF02GX4O2.35.85.H08.1.454.CMB.1.raw
  modified_base (297)..(297): a, c, t, g, unknown or other
  misc_feature (297)..(297): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (416)..(416): a, c, t, g, unknown or other
  misc_feature (416)..(416): n is a, c, g, or t
  modified_base (438)..(438): a, c, t, g, unknown or other
  misc_feature (438)..(438): n is a, c, g, or t
  modified_base (477)..(477): a, c, t, g, unknown or other
  misc_feature (477)..(477): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccagggacagagccaccctctcctgcaggccagtcagagtgttagcagcaacttagcctggtaccagcaagaaacgttggccgaggctcccaggcctcctcatctttggngtcgtccacgtgggccgcgtggtcctacccgtgtacgtcgtcgaggtgacgtgtacgtctcggnggtacgagttacgtacncttcnccactatcacgcacgctagctagttcagtattnttacgattagtttactcgtacngactaataagtataacgtcgtcgtacgtccgtacggttntacgttcctttacgggtttaccggcgggtaaacccggatacccggtacggttagaacgtaccggttaaaccaaaccggtggtaccgggtacgtcgtaaccccg

SEQ ID NO: 242908 - DNA, 652 bp, Homo sapiens
  misc_feature: GYAE6OF02GWGG0.35.85.H08.1.454.CMB.1.raw
  modified_base (457)..(457): a, c, t, g, unknown or other
  misc_feature (457)..(457): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttgcctggtaccagcaagaaagttggccaggctcccgaggcctccctcattctttgggtgttcgtccacgtaggggccctcgtgggtccgtccccgaggtacctagggtttccaggttcggctaggtacggtcttcggtaggggacctaaggtcgtttccaccttctaccaccatccgagccacgtccctgacctagttcctaggtaacgttnttttcggactttaagttttacttacgttgtacaggtactaaattactaaagtagtccgtacggtcccttaccggtaggttccgtccgtttacggttttccggggacccggtaacgggggtaacctaacgggtcgttaacgggagttaaccgtaccggtaaaaccggtaacggtttgggttaccggcgttaacccg

SEQ ID NO: 242909 - DNA, 614 bp, Homo sapiens
  misc_feature: GYAE6OF02HNJRJ.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcgagggccagtcagagtgttagcagcaacttagcctggtaccagcaagaaagttggccaggcctcccgaggtcctcctcattcgtttggtgtgtccacgtaggggccgtcgttggtcgtcccgagtctaggttcaggtggctaggtggcttcgtggggactaggtacgtttccacttcctaccacctatccagcacgccctgactacgtctaggtaacgtagttttcgcttagttttacttacgtgtacagtacctaaattaataagtacgtacgttcggtaccttccggtaagtttcgtaccgtttacgttttcgggacccgtaacgggggtaccctaagggtccgttagggaacgttacgtaccggaaaacgtaaccggttggtaccggtcctaacgg

SEQ ID NO: 242910 - DNA, 564 bp, Homo sapiens
  misc_feature: GYAE6OF02INHIG.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccacctctcctgcagggccagtcagagtgttagcagcaaacttagcctggtaccagcagaaagttgcaggctccaggctcctcattcttggtgtgtccacgtagggccgctggtctccagtcaggttcagtgcagtggctcgtgggacagagttcactctacacatcacgcagcctgcagtctagaagtattttgacttagtttattactagtacagactaaagtataaagtagtctacgggccttaccggtacgttgaccttacgttttacggacccggtaaaggggtaaccctaaaggtaccgttagggaacgtaagttaacccgaaaaaccggtaaccttagggtaccgggtacgtacgg

SEQ ID NO: 242911 - DNA, 675 bp, Homo sapiens
  misc_feature: GYAE6OF02HED0W.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgcccaccctctcctgcgagggccagtcagaggttgttagcagacaacttagcctggtaccagcaaggtaaagttcggccgaggcctcccgacggtcctccctactactttcgtttgggtcttcgtccgtacgtcgggccgtcgttcgggtctcccgtagtccgtaggttcgaggtcggtcgtaggttcggtacgttcggtggggactaggtacgtttccaacttccgtacctaaccgatccgaagcctacggtccgttagcggtacgttacgtaggtaagttacgttttacgtacgtttagttttacttacgttgtaccgtaagacttaaagttacttaagtcgtacgttacgtcccgttacggtaagttccgtacgtttaccgtttacgggacccggtaacgggtacctaacgggtcgtagggaacgtaacgttaaccggaaacggtttacggtacggttacggacgtaccgg

SEQ ID NO: 242912 - DNA, 715 bp, Homo sapiens
  misc_feature: GYAE6OF02HRU4T.35.85.H08.1.454.CMB.1.raw
  modified_base (162)..(162): a, c, t, g, unknown or other
  misc_feature (162)..(162): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgnagtctccaacctactctgtctgtgtctccgagggacagagcccacctctcctgcagggccagtcaggagtgttagcagcaacttagcctggtaccagcaagtaaagttcggccaaggcctacccgaggtcctccccgtctaagttccgtttaggtcgtcgtacccgtaccgttacggggccccgtcgttcgggtccgttccccgaaggttccgtaagggtttccaacgggttcgggctacggtcggtctcggtacggggactacgggtacgttccgacctcgtacccgaacctactccggagtaccacggtccgtacggtctaacgggttcgtaaggtaacggttacgttttacgacgtttaagtttttacgtaacgttgtacccgtaacgtacttaaataacgtaaagtacggtcgttacccggttacccgtacgtacggtttacgtaccgtttacgttttaccgggacccggtaaggggtaccccgtaaggtccggttaacggaacgttacgtaaccgaaaccggttacgtacgggttacggcttaaccgg

SEQ ID NO: 242913 - DNA, 854 bp, Homo sapiens
  misc_feature: GYAE6OF02IIPFP.35.85.H08.1.454.CMB.1.raw
  modified_base (548)..(548): a, c, t, g, unknown or other
  misc_feature (548)..(548): n is a, c, g, or t
  modified_base (775)..(775): a, c, t, g, unknown or other
  misc_feature (775)..(775): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagggcgacgtccgacggaggagacgagagacactagcgtacgggtggtactagtaacgaacgccgtcgcgtcggtcggacgagggaaccggacgggacggtacccgtacccgttacccgacgggacggacccgaccgtacgtccgtccgtacgaaccggtacggggcccgacggaacgggttcggcccccgttaccgtaaccggtaaccggaacggaacccgtaactacggaacgaaacccgaaaccgaacgaccgggaaccgtaacgggtaggggtttcgggtacgacggtaaaccccccgttgggaagggaacggtaccggttccgggtaccccgggttaccggtacccggtaccggacggaccggccgggtccccgtaccgacccccgtttccggngttccggtaccggttccgtcgggttccgggtaccgggttcgcccgggttaaccgttccgggtacccggttccccgaaaccggttccgggttcccgtcggtccgttcccggacccggtacccgtacggtttcgggtaccgtcccgaacccgtacgggaacccggtacccgggacccggtaactacccgggcggtaaccgtaccggtcgtagtacgggtaccacggacnccgtaacgcgacctcggcgtaccggtcgccggtcggtagggccgtacggtcaccgacccggaacgccctaccgtacccg

SEQ ID NO: 242914 - DNA, 830 bp, Homo sapiens
  misc_feature: GYAE6OF02H3PB8.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaaatagtgatgacgcagtctccaaccactctgtctgtgtctccgaggggacagagcccaccctctcctgcacgggccagtcagagttgttacgcagactaaacttgcctggtacccagacagaaacgttggccaaggcctcccgaggcctcctcattccgttttgggtcgttcgtccgtacgtacggggccccgacgttcggttcgtacccctaggttccgtaagggtttccgaagggtcgggacgtacggttcggggcctttacgggtcggggaacctaagggttaccggtttacctaacccgttcccgttacctaaccccggtaacttacccggtaacggtacccgaaccggtcccgtttacggtacccgttacgggttaacccgtttacgggtaaaacggtttaacggttttttacggtaacgttttaacgttttttaaacgttttaacgtttaccggtttaacgttaaccggttaacgtttaaaaacgttaaacgtttaaaacgttaaccgggttaccgttaaccggggttccccgttaaacccggttgggtttttaaccggtaccgtttttaccggtttttaccgggaacccggttaaacgggggtaacccgtaacgggttaccggttaacggggtaacgttaacccggtaaccgtaaaacccggg

SEQ ID NO: 242915 - DNA, 766 bp, Homo sapiens
  misc_feature: GYAE6OF02HPOUF.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgccagggccagtcagagtgttagcagactaacttgcctaggtaccagactaagtaacggtcggaccaggcctcccgaggccttccgtctacttcgtttgggtcgttccgtccgacggttacggggtcccgtggttacgggttcgtaccccgtaggttaccgtacggggtttcaggttcgggaccgtagggtttcggcccgtttacggacgggggtaacctaagggtttaaccgtttcccgaaacctttccgtaccctaacccgtacttaccgacgaccgtaccgtcccgtgtaccgtacgttacgtaacggttaaagtttagttttccgtaacgtttaacggtttttaactttaccgttagtaccgtaacgttaaccttaaagttaacgtttaactacggtaccgtttaccgggtcccgttacggtacggtttcgtaccggtttacgttttaccggggaaccgggtaccgggtaacccgaacggttacggtaacgggtagtaacgtaaccggttaaaccggtacgttacccgggttaggtaccgtaccgg

SEQ ID NO: 242916 - DNA, 893 bp, Homo sapiens
  misc_feature: GYAE6OF02I4RDW.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatgtgatgacgcagtctccaaccactctgtctgtgtctccgaggggacagacgccaccctctcctagcacgggcctacgtcgaggtacggttgttaacgcgtaacggacctaaacgtttacggcccgttagggttaacccgaacggacgtaagggtaaaacggttaccgggaccccgtaacggggcccttacccccggtaagggtcccttaccccgtccgttaacgttttccggttttggggttaccggttaccggttacccggtaaccggttacggggccccggtacgtttcgggttaccggttaccccgtaggttaccggacggggtttccgtaagggttcggaccgtggggtttacgggtccgttacgggttagggaaccgtgggttaaacgtttcccgttaacctcccgtttaacccgtaacccgtaccgtacgtacgaccgtaacggtaccgtcggtaccgtacgttacggtacgggtaacgtttacgttttacgtacgtttaacgtttacgttaccgtttacgtacgtaacgtaacttaaagttaagttaaacgtttaggtaccgttaccgggttacccgttaccggtttaagtttaccgggttaccgtttaacggtttttaccgggaaacccgggtaaccggggtaaaccggtaacggtaccgggttaacggtaacgggtaaaccgttaaaccggttaaaccggtaaccggtttcggtacggttacccgtaacccgg

SEQ ID NO: 242917 - DNA, 662 bp, Homo sapiens
  misc_feature: GYAE6OF02G47LV.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagacaacttacgcctggtaccagacagtaaacgttggacccgaggcctccccgaggcctccctctacttccgtttggtcgtcgtaccctacggtacgggccgcgttgggtcgtccccagtccgtaggtttcgaggtggcctaggttcggctcggttacggggacaggtagttccacgttcctaccaccacgttccgacgaccgacgtccctcgacgtacgttacttacggaagttagttttacgacgtttagtttactttaccgttgtacgtacgtacttaaacttagttaaacgttcgtaccgttcgggtccccgttacggttacgttcgtaccgttacgttttcggggacccggtaacggggacccgtaaggtccggtaggtagtaaccgtacgaaaccgttacgtacggtcgtacgtaccgg

SEQ ID NO: 242918 - DNA, 757 bp, Homo sapiens
  misc_feature: GYAE6OF02IDRUW.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccacccttctctgcgacgggtccagtacagaggttgttacggcagactaacgttacgccgtggtaaccagcgtaaggtaaacggttcgggaccgacggtacccgtaccgtacgggccttccctaccgtacgtttccgttttaggtcggttacgtaccgtacgtaccggggccgtcgtcgggttactccccgtaggtccgtagggttacgagggttcggctaagggtcgtcgtccggtggggaaccaaggttacgtttccgaccgttaccgtacctaaccgtagtaccgtaacggtccgaacgtacccgtggtaccgtacggtcgttaacggtaagtttaacgttttcgtagtttaaccggtttttaatttaacgttcgttaaccaagtaaccttaaagtaattaaacgtcgtacggttacggtcccgttaacggacgtttacgtacctttaccgggtttacgggtaccgggtaacgggaaccggttaacggtccggttaacggtaagttaacccggaacggtaaaacggtagttaccgggtaggcgttaacccgg

SEQ ID NO: 242919 - DNA, 576 bp, Homo sapiens
  misc_feature: GYAE6OF02HJ7MZ.35.85.H08.1.454.CMB.1.raw
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcaagaagttgccaggctcccaggctcctcatctttggngtgtccacgtagggccgngtcggtcgtccccagtcaggttcaggtgcagtggctcgtgggactagagttcactctcaccatcagctagcctgcacgtctagaagtattagngtacttagtttacnctacttgtacagtactaagtttaatacgtccgttacggtcccgcgtccgttccgttccggttttccggggcggggtaaccgggaaccgttaaggggtcggtaaacgtaagttaccggaaaacggtacgttacgggttacggacgttcggtaacccg

SEQ ID NO: 242920 - DNA, 652 bp, Homo sapiens
  misc_feature: GYAE6OF02GPPK1.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcacgtggagaaatagtgatgacgcagtctccaaccactctgtctgtgtctccgaggggacagacgccaccctctcctgcagggccagtcagagtgttagcagcaacttagcctggtaccagcaaggaagttggccgaggtcctccgacggcctccgtactattcgtttcggtgtcgttccgacggttacgggccgcgttcgggtcgtacccgtagttacgtaggttcaggtcggtcaggtgctcgtgggacagtcgtctaactccgtacaacctacgtacgacgtaccgaacgtcccgttgaccttaggtaccgttaggaaacgtttacgtttaggacctttaacgtttttaacttacgttacggttaccagtaccgtaaattatttaaacggtacacgttggttacccctaggtacgtttacgcgtttaccgtttcgggaccgggtaacggtaccgaaacgtgtacgggtaaagaccgtaacggtaaacgaacgtttgggacggtctaacgg

SEQ ID NO: 242921 - DNA, 566 bp, Homo sapiens
  misc_feature: GYAE6OF02HA88K.35.85.H08.1.454.CMB.1.raw
  modified_base (271)..(271): a, c, t, g, unknown or other
  misc_feature (271)..(271): n is a, c, g, or t
  modified_base (310)..(310): a, c, t, g, unknown or other
  misc_feature (310)..(310): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagctaacttagcctggtaccagcaagaagtgcagcnccaggcctctcattcgttggtgtgtccacgtagggcccngtcggtgtccccgagtctaggttcaggtcggctaggtggctggtcgggactaggacgttcacttctcgaaccatcacgcacgtcctgctagtctagtaagtagtttgacttagtttacttacgtgtactagtactaattataagtacgtcgttacggtcctcgtagttacgtacgttacgtttcggaccggtaacgggtacctaacggtaccgtaggtacgtaacgtacgaaacgtaacggtggtacggtcgtacg

SEQ ID NO: 242922 - DNA, 676 bp, Homo sapiens
  misc_feature: GYAE6OF02HIJL3.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaaatagtgatgacgcagtctccaaccactctgtctgtgtcctccgaggggacagagccaccctctcctgcgagggccagtcagagtgttagcagcaattagcctggtaccagcaagaaagttcggcaggcctcccgaggctcctcattcgttggtgtcgtccacgtacgggccgcgtcgggtcgtcccgaggttccgaggttccgaaggtcggactagggtcggcgttacggtggggaactacggtagtttccaccttcctaccgaacctacgtcgacgacaacgccctaggctacggtcgtaggtaacgttagttttcggtacgttaagttttacttacgtcgtacgacgtaactaaagttaagttaaactacgtacgttaccggtaccgttaccggtaggttacgtaccgtttacggttttccgggacccgtaacggggtaaccctaacgggtacggttaacggtaacggttacgttaaccggtaaaaccggttaccggttacgggttaccggaccggttaaccgg

SEQ ID NO: 242923 - DNA, 753 bp, Homo sapiens
  misc_feature: GYAE6OF02J1AO2.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccctaccctctcctgcagggccagtcagagtgttacgcaggctaacttacgccgtaggtaccagacgaagtaaacggttcggccgaggtcctaccccgaggccttacctccgtattccgtttaggtcggttcgtcccgacggtacggggcctaccggttgggtccgttccccgaggtccgtaggtttccgaggtcgggtaccaggttcgggtccttcggtaggggaaccgtaaggttacggttacccactttccgtccaacccgtagtacctacggacctacgggtcccgtcgtacgtaccggttcgtaacggtaacgtttagttttcggtactttaaggtttttaccttacgtacggttcctaagtaaccttaagtttaacttaaagtacggttcgtacccgggttcctaaccggttacggttaccgtacccgttttacggtttaccgggtacccgggtaaaccgggggtaaccctaacgggttccggttacggaacggttaaccgtacggtaaaaaccggttcggttcggtacgggttactacccggg

SEQ ID NO: 242924 - DNA, 684 bp, Homo sapiens
  misc_feature: GYAE6OF02JVLM4.35.85.H08.1.454.CMB.1.raw
  modified_base (160)..(160): a, c, t, g, unknown or other
  misc_feature (160)..(160): n is a, c, g, or t
tcagtacagatcgtcacgaccggtgctcgatttagtatcactcagtcgcggggaggaactgctcagttaggaccagacggaaccatggaagccccagcgcagcttctcttcctcctgctattctgctccagatatcactggaagaaatagtgatagacgnagtctccaaccactctgtctggtctcttccgaggggacagacgccaccctctctgcagggccagtcagactattacgtaaccaattacgcctggtatcagtcacgtaacctaggtccacggcctacccgacgggtctaccctcgtaactcctagttcggtcgacgtaacctcccgaaccgtaaccggggtccaaccggttcgtaaccgttccccgaggtcccgtaaggttccgaacgggttggaccgtagggtaccgggttcgtacggggaacgtaaggcgttaaccgtaccgttcgttccgaacctctacgtacgtccaacgtccgccgtacgtctacggtgtacgtagtaacgttttcgacttaagtttacttcgttcggtactacgtattaaccgtttagtattaacgttaactcgggttacctaccggtggttaccgtcgggtaacggtaccggaacgggttacggaaggtaaccggaccgtaacgtaaccgttggttggaccgtcgtacaccgtaacgg

SEQ ID NO: 242925 - DNA, 786 bp, Homo sapiens
  misc_feature: GYAE6OF02H41NG.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggcctccagatatcactggagaaatagtgatgacgcagtctccaaccactctgtctgtgtctccgaggggacaggacgcccaccctctccgtgaccgacggggcctaggtcaggagttgttagcagactaacttgcctggtaccagcaaggtaagttcggacctaggcctaccccgaggtccctcccgtactagtttcgttttcggtacggttcgtacccgacgttacgggggtccctcggttcgggttccgtaccccgtaggttccgagggtttccagggttcgggacgtagggttcggtaccgtcggttacggggactacgggttacgtttcccaacttcccttaccgaaacccgtacgttacccgacgtacccgtacgggtcccttaacggccgttaggttacccgttaaggttaaaccgtttagtttttcggtaacttttaaggtttttaaactttacgttcgggtaacctaaggttaacccttaaaatttaaccgttaaagttacggtccgtttacgggtccccttacgggttaacggttttcgtaccttttaccgggttttaccggggaacccggtaagggggtaacccctaacgggtcgttaagggacgttaacgttaccgaaaacggttaccgtagggtaccggtctacccgg

SEQ ID NO: 242926 - DNA, 613 bp, Homo sapiens
  misc_feature: GYAE6OF02I2W57.35.85.H08.1.454.CMB.1.raw
  modified_base (259)..(259): a, c, t, g, unknown or other
  misc_feature (259)..(259): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagtagtgttagcagcaacttagcctggtaccngcaagaagttgccaggctcccaggtcctcctctacttcgttttggtcgtcgtaccaccggttacggggcccgtcgttcgggttcgtacccctaggttccgacgggtttcaggttcgggctaggtcggctcggtagggacagtacgttcacctcgtacaccgtactccgacgcgacgtcctcggcgtagttcgtaggtaagttcgtttcgtacttagttttacttacgttgtacgtagactaattataagtgtcgtcgtccgtacgtagtcgtacgttacgtttcggaccggtacgggaaccgtagtaccgtaggacgtaacgtacgtaaaccgtacgtcggtacggtcgtaccg

SEQ ID NO: 242927 - DNA, 592 bp, Homo sapiens
  misc_feature: GYAE6OF02FJ15P.35.85.H08.1.454.CMB.1.raw
  modified_base (216)..(216): a, c, t, g, unknown or other
  misc_feature (216)..(216): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcngggccagtcagagtgttagcagcaacttagcctggtaccagcaagtaaagttcggccagggtcctccccgaggccttccgtctattcgttttggtcgttcgtcccacgtacggggcccgtcgttgggtcgtccccagtcgaggttcagtggctaggtggctcgtgggacaggtacgttcactcctcacctatcacgcgacgcctgcgtacgttctaggaagttattttcgcttaagttttaacttacttgttacaagtacaaattaacgtaattagcgttacggccttccggtaagttcgcttacgtttcggacccggtaacggggaacctaaggcgtaggagtactaccgaaaccgtacgtcggtacggcgtacg

SEQ ID NO: 242928 - DNA, 775 bp, Homo sapiens
  misc_feature: GYAE6OF02IVEYU.35.85.H08.1.454.CMB.1.raw
  modified_base (183)..(183): a, c, t, g, unknown or other
  misc_feature (183)..(183): n is a, c, g, or t
  modified_base (231)..(231): a, c, t, g, unknown or other
  misc_feature (231)..(231): n is a, c, g, or t
tcagtacagatcgtcacgaccggtgctcgatttagtatcactcagtcgcgggggaggaactgctcagttaggaccagacggaaccatggaagccccagcgcagcttctcttcctcctgctattctggctcccagatatcactggagaaatagtgatgacgcagtctccaacactctgtctgtntctccgaggggacagacgccaccctctcctcgcgagggccagtcaggngtgttagcagactaacgttacgccgttaggtacccagtacgaacggtaaaacgttcggacccgaagggtccctacccgaacgggtccttacccgttacgacgtttcgtttcgggtcgttcgtacccgtacggtacggggcccgttgtcgggtaccgttccccgaaggttccggttacgggttacgaacggggttcggccgtaacgggtttcgggaccgtttacggggttacggggaacctacggggttaacgtttccgtaaaccgtcccgtttacccgaaaccgtacgtccgtaacggtaccgtacggtcccgtacggtaccgtacggttaccgtaagggttaaaccgttaggttttacgtaacgtttaacggttttacttaacgttgtaacgtaacgtaactaaaggttaactaagttaccgtacgttccgtaccggttaacgtgggttactaccgttacggttttcggaccggtaacgggtaacccgtgtaccggtacggtaacggtactaaccgtaaccgtaacggtcggtaggtctacgg

SEQ ID NO: 242929 - DNA, 660 bp, Homo sapiens
  misc_feature: GYAE6OF02HWFY3.35.85.H08.1.454.CMB.1.raw
  modified_base (186)..(186): a, c, t, g, unknown or other
  misc_feature (186)..(186): n is a, c, g, or t
  modified_base (473)..(473): a, c, t, g, unknown or other
  misc_feature (473)..(473): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtctccaaccactctgtctgtntctccgaggggcagacgcccacctctacctgccgacgggccagtcgaagtacggtgttagcagtacctaattacgtccctggtaaccgagacgaaggaaacgttggcccaaggtcctcccgacggccttaccctcgactttcgtttggtagttccgtacctacgttacgggccgtccggtaggttccggtaccccgtaggtccgtacggtttacagggtacggtcgacgggttcggcgtcggtagggactaggtacgttccacttccgtacgacatcgagccagtcngtacgtagtacgagtagttcttacgtcgttatttacgttcgtagttaccgatactaattacgtaatcggtacgtcgtccgttagtcgttcgtaccgtttacgtttcggacccggtaacggggacctaaggtaccgtacggacgttaacggttaaccgaacgtaaccggttaggtcggtacgtaaccg

SEQ ID NO: 242930 - DNA, 737 bp, Homo sapiens
  misc_feature: GYAE6OF02HACNP.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtctccaaccactctgtctgtgtctccgaggggacagacgcccaccctctccgtcgcgacgggccagtcgagagttcgttagacgagacctaacgttacgccctaggtacccaagaccgaaaggtaaacggttcggacccgacgggtccctaccccgaaggtccccttccctacgtactttcgttttaggtcgttccgtaccgaccggtacggggtcccgtcggttcgggttacccgtccccgtaaggttccgtacgggttactacgggtcggacgtagggttacggtccgttacggttcgggtaacctaggtaccgttaccgtaaccttcccgtaccctacgtaactccgacgtccgacggtacctcgtacgtacgttacgtaggttaacgttagttttacgtacgttagtttttaacgtacgttcgtaacgtagtaactaattaacgttagtaaccgtccgtacgtcccgttacggtagttctaccgttccggttacggaccggtaacggtaccgtaacggtcgtaacgtagtaccgtaacgaaaccgtaggttcgtcggtacgtaaccgg

SEQ ID NO: 242931 - DNA, 563 bp, Homo sapiens
  misc_feature: GYAE6OF02F8BHF.35.85.H08.1.454.CMB.1.raw
  modified_base (286)..(286): a, c, t, g, unknown or other
  misc_feature (286)..(286): n is a, c, g, or t
  modified_base (425)..(425): a, c, t, g, unknown or other
  misc_feature (425)..(425): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccgagctcctnatctttggtgtgtccacgtaggggccgcgttggtcgtcccagtcaggttcagtggcagtggctcgtgggactaggagttcacttctcaaccatcagcagtcctgccagtctagaacgtatttgactagtttattacgtntacagactaatataaatacgtcgttcggtccttacggtagttacgacttacgttttcgggacccgtaacgggggtaaccctaaggccgttaggaacgtaacgtaccgtaaaaccgtaccgtacggtacggtcgtacgg

SEQ ID NO: 242932 - DNA, 766 bp, Homo sapiens
  misc_feature: GYAE6OF02ISV6M.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggaagaaatagtgatgacgcacgtcaccaaccactctgtctgtcgtctcgagggacagacgccacctcctccgtgacgacggacctaggtacgaagacgttacggttaggacctaagactaaacgtttacgcccgttaaggtaccaggaacgaaggtaaacggttacggaccgacggcctacccgacggtcctccttacgattttcggtttacggcggttaccgtaccgtaacggtacggggtccgtacggtttacgggtccgtacccgtaggttccggtaggtttaccgaggttaccgggtacgttacggtagggtcttacgggtagggactaagtacgttacacctctaacccaacctagactacgcctaacggtaccgtacgtacgtaacggttcgttaaggtaacgtttagttttacgtaacgtttacgttttacttacgttaacgttactaacgtaacttaaacttaagttaaacttacgggtaccgttacgttacccgttacggttacgttacgtccgtttacgggtttccgaacgggtaaccggtaaccggtaacggtacggttagggtaactaacggtaaccgtaaaaccggacggtaggtaccgtactaaccgg

SEQ ID NO: 242933 - DNA, 691 bp, Homo sapiens
  misc_feature: GYAE6OF02ICYXY.35.85.H08.1.454.CMB.1.raw
  modified_base (181)..(181): a, c, t, g, unknown or other
  misc_feature (181)..(181): n is a, c, g, or t
  modified_base (503)..(503): a, c, t, g, unknown or other
  misc_feature (503)..(503): n is a, c, g, or t
  modified_base (512)..(512): a, c, t, g, unknown or other
  misc_feature (512)..(512): n is a, c, g, or t
  modified_base (668)..(668): a, c, t, g, unknown or other
  misc_feature (668)..(668): n is a, c, g, or t
  modified_base (685)..(685): a, c, t, g, unknown or other
  misc_feature (685)..(685): n is a, c, g, or t
tcagtacagatcgtcacgaccggtgctcgatttagtatcactcagtcggcgggggaggaactgctcagttaggacccagacggaaccatggaagccccagcgcagcttctcttcctcctgctattcgtggcctcccagtatatcacttggagaaatgtgatgacgctacgtctaccaaccncttctggtctggtgtctccgaaggggcagagtcccacccttctctcgaccgagggccagtacacgtgtgtagcagtactaacgttgccgttaggacctagacgtaagtaacggttcgaccgacggtcctaacccgtgggtccttacccgtctagttccgtttgggccgtttcgaccctaaggtccggggcctcggttacggttccggtacccaagttcggtaggttccgaaggtcggtcggtaggtcgtcggttcggaacggacgtacgttaccgttcgtaccgtctacgtaccctagtcgaacgtcgactccgtgtaccgngttaaccgngttagttaacgttggtacttaaaggttttctaccgtagtacggtaagttacctaaaggttatacgggttcaacggtccggtttacccgaggttaacggttctaacgtttcggttacgggaccgaacgggtactaggtcgtaggaattacccggaanaccggtttagtgccggntaccgg

SEQ ID NO: 242934 - DNA, 565 bp, Homo sapiens
  misc_feature: GYAE6OF02HIXNB.35.85.H08.1.454.CMB.1.raw
  modified_base (208)..(208): a, c, t, g, unknown or other
  misc_feature (208)..(208): n is a, c, g, or t
  modified_base (313)..(313): a, c, t, g, unknown or other
  misc_feature (313)..(313): n is a, c, g, or t
  modified_base (559)..(559): a, c, t, g, unknown or other
  misc_feature (559)..(559): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgagggacagagccaccctntcctgcagggccagtcgagagtgttagcagcaacttagcctggtaccagcagaagttgccaggctcccaggctcctcattctttggtgtgtccacgtacgggccncgtggtcgtccagtcaggttcagtgctagtggactcgtgggacaggtcgttaccgacttcctcacctatccgaagcgacgcctgctagtacgtagacgttatttcgccttaagtttacttaactgtaccgtagtacctaaattaattaagtagtcgtaccggtaccttccgaagtttcaccgttacgtttcggaccgtacgggacctaaggcgtaggaacgtacgaacgtaacgtaggtacggtgntaccgg

SEQ ID NO: 242935 - DNA, 730 bp, Homo sapiens
  misc_feature: GYAE6OF02H4WYH.35.85.H08.1.454.CMB.1.raw
  modified_base (301)..(301): a, c, t, g, unknown or other
  misc_feature (301)..(301): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggagaaatagtgatgacgcagtcctccaaccactctgtctgtgtctccgagggacagacgcccaccctctcctgcgacgggccagtcagagtgtagcagactaacgttagcctaggtaccagcaaggtaagtcggcgacggcctccgaggcctccctntactttcgtttggtagttccgtaccacggtacggggtcccgtcgtcgggtccgtccccgaggttccgtaacgggttcgacgggttggaccgtaggtcggtcccgttcgggtaggggtacctaaggttaccgttaccctaccgttacctacccgtaccgtacgtacgacggtaccgacgtcccgtaggaccgtaggttaccgttaggtaacgtttacgttttcggaaccgtttaagttttaaccgttcgttacgtacgtaagttaaccttaaagtttaagttaaacgtcggtaccgttaccggtcccgttaacggttgtttacccgtacgtttaccggtttaccgggacccgggtaacgggtaacccgaggttcggttaacgggacttaacgtaacccggtaaacgttcggtagggttccgacgtacccg

SEQ ID NO: 242936 - DNA, 691 bp, Homo sapiens
  misc_feature: GYAE6OF02IPI9L.35.85.H08.1.454.CMB.1.raw
  modified_base (148)..(148): a, c, t, g, unknown or other
  misc_feature (148)..(148): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatactcactggaanaaatagtgatgacgcagtctaccaaccactctgtctgtgtcctccgagggacagcgcccacctctccgtgcgacggccagtcgacgagttcgtacgctagacctaacttcgccgtacggtaccagacgagtaaagttcggaccgacgggcctaccgaggtcctcccgtcgtacgtttcgtttgggtcgtcgtaccgacggtacggcccgagttcggttcgtcccagtccgtggtctaggtcggctaggtcgccgtgacggacgtagtacgttacgaccttcctaccgtacctacgtaccgtacggaccacgtccgtacgtaccgtacggttaccgtaaggtacgttaacgttttcggacgttttacgttttaactttacgttacgtacgtaacgtacgtaaacttaattaaagtacgtcgtaccgggtacccgtcgtaggttcgtaccgtttacgtttcggaccggtaacggtacctaaggtaccgtaggttaagtaccgttaaccgaaaaccggttacgtacggttacggtaccgtaaccgg

SEQ ID NO: 242937 - DNA, 706 bp, Homo sapiens
  misc_feature: GYAE6OF02HFP3V.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcgacgggccagtcagagtgttagcagctaacttgccgtggtaaccagacaaggtaaagttcggaccgacggcctacccaggcctccgtctacgttcgtttggtgttcgtccgacgtacgggcccgtgttcggtcgtccccgtagtccgtaggttcgacgggtggtacgaggtcggtcgttcggtagggacacggtacgtttaccgaccttcctcaaccgtactaccgacggtacctaccgtccgtcgaccgtaggtaccgttagtaacgtttacgttttcgtactttaggtttttaacttacgtttcgtacgtaacgtaccttaaagttagtaaacgttacgtaccgttaggttaccccggttacgtacggtttacgtaccgttacgttttacgggacccggttaacgggggtaacccgtaaggtacccggtaggtaacggtaaccgttaaccgtaaaaccggttaccgtgggttacggtaccgtaccgg

SEQ ID NO: 242938 - DNA, 687 bp, Homo sapiens
  misc_feature: GYAE6OF02H44N4.35.85.H08.1.454.CMB.1.raw
  modified_base (299)..(299): a, c, t, g, unknown or other
  misc_feature (299)..(299): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatccactggagaaaatagtgatggacgcagtctccaaccactctgtctgtgtctccgagggacagacgcccacctctcctgcgacgggccagtcagtagtgttacgcagctaaacttgcctggtaccagcaagaaagttcgccacggctccgaggcctcccgtnacgttcgtttggcgttcgtaccctaacggttacggggccctacgtcggtccgtcccgtaggtaccgtacgggtttccaagggtcggtcaggttggccgttcggacggggtactaggtaccgtttctaccgtacctcccgaacctactaccgtacggtaccctaccggtccgttacggacgtacggttcgttacggtaaacgttcgttttacggacctttagttttaacctttaacgttcgtaaccgacgtaactaaagttaacgttaacgtacgtacgtaccgtccgtacggttacgttcgtaccttacgtttcggaccggtaacgggtaaccgtaacgtcgtaggtacgtacgtaccgtaaacggtacgtaggttccggattaccgg

SEQ ID NO: 242939 - DNA, 796 bp, Homo sapiens
  misc_feature: GYAE6OF02IRAO6.35.85.H08.1.454.CMB.1.raw
  modified_base (319)..(319): a, c, t, g, unknown or other
  misc_feature (319)..(319): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcacgagtgttagcagcaacttagcctggtaccagcagaagttggcaggctccgaggctcctcattcgtttggtgtcgtccgacgtacgggccgngtggtcgtcccaggtcctaggttcaggtcggctaggtggtcctcggtacgggactaggtacgttcgtaccgttctacctaaccgtacttcgaacgggtcctaacggtccccgttaggtaaccgttaggttacccgttagggtaaacgtttacggttttttacggaccgttttaaaggttttttaactttaccggttacggttaccgttaacgggttaaacccttaaaaggtttaaacgtttaaacggtaaccggtttacccgggtttaccgggttacccccggtttaaacgggttaacgggttttaccgggttaacccgtttttaccgggttttttaaccgggggaccccgggggttaaaacccggggggtaacccttaaacggggtcccggtttacgggggtaaacgttaccggttaaaacccggaaaacccggttttaacggggtacggtttaccgggggaccctttaacccggg

SEQ ID NO: 242940 - DNA, 578 bp, Homo sapiens
  misc_feature: GYAE6OF02HGCS4.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcgacgggccagtcagagttgttagcagacaacttacgcctaggtaccaggacaagtaaagttcggccgaggcctcccgaaggtcctaccctcctaatttccgtttggtgttcggtacctacgtacggggcctcgttgggtcgtacccctagtccgtaggttcgagttggcagtgctgtgggactagacttcactctacacatcgagcgacgctagcagtctagtattgttagacttagtttactacttcgtctagactaatataagtcgtacgtcgtacctcggtattcgtacgttacgtttcggacgtaacgggacctaaggtcgtaggaagtacgtaacgaacgtagtcggtacgtcgtacg

SEQ ID NO: 242941 - DNA, 721 bp, Homo sapiens
  misc_feature: GYAE6OF02IOP8U.35.85.H08.1.454.CMB.1.raw
  modified_base (86)..(86): a, c, t, g, unknown or other
  misc_feature (86)..(86): n is a, c, g, or t
  modified_base (194)..(194): a, c, t, g, unknown or other
  misc_feature (194)..(194): n is a, c, g, or t
  modified_base (481)..(481): a, c, t, g, unknown or other
  misc_feature (481)..(481): n is a, c, g, or t
tcagtacagatcgtcacgaccggtgctcgatttagtatcactcagtcgcgggggactgcttcagggcagttggtagatgccccctntgggagagatccccgaggggtgacagccatggaccctggaagggcctgggcgtagggacagggaccagagccagtccagggagaggacagagccaatggactggggtntactgtaacagccctgctggcgagagggaccagggcaccgtcctccgagggacgcccagtgcctggaccaaggtcgggaccaggacggtcgcccgtgaaccctggaacggcaaatcggaacgacccgaaaggaccaggaccgaaaggttcgggttacgtacggaccggtaccccgtaggaacggcggtccgttacggggccccgttagggtaccccgaggggacccacgggccgtaccgttccgggccccctggtacctcggtccgttggtaccggtcgggttccgngggacccgtcggtacggtcccggaccgtacgttcggacccttggtccgtcgggaccctaccgtaagtccggttagacccgacgaaccggtaacgggccgggaacccgacggaccgtcggacgcccgtagtacgggtcgaacggacgaacggccgtacgaccgacgacccgtgggaccgagggtcccgtaggttacgggccgtacggtacgaccggggaccaacccgggccctaaccccgg

SEQ ID NO: 242942 - DNA, 687 bp, Homo sapiens
  misc_feature: GYAE6OF02JHZ3M.35.85.H08.1.454.CMB.1.raw
  modified_base (295)..(295): a, c, t, g, unknown or other
  misc_feature (295)..(295): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaacactctgtctgtgtctccaggggacagacgccaccctcgtcctgcgagggccagtcagtagtgttagctagctaacttagcctaggtaccagcaagaagttgacaggactcccgagcctccgtanacttcgtttaggtgtacgtccacgtacgggccctcgtggtcgtacccgagttccgacggtttcaggttcggctacggtggtactcggtagggacnggtaattccgacctntccacgtactacgacgtacgaccgtcgttcgacgtaccgtacgttacgtaaaggttacgttttacggtaccgtttaacgttttacgttaccgtttgtacccgttaacgtactaaacttaacttaaacgttaaccgtaccggttaccgggttacccgttaccggttacgtttacgttaccggttaccgttttaccgggaccgtaaccggggtaacctaacggtacgtacggtaacgtaacgttaccgaaaacggttaccgtacggttaccggaccgttaccgg

SEQ ID NO: 242943 - DNA, 709 bp, Homo sapiens
  misc_feature: GYAE6OF02H1UWS.35.85.H08.1.454.CMB.1.raw
  modified_base (382)..(382): a, c, t, g, unknown or other
  misc_feature (382)..(382): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacaggacgcccacccttctcctgcgagggccagtcgagagttgttagcagctaacttagcctggtaccagcaagaaagttggccacggtcctacccgaggtcctccctactacgtttcgtttgggtcggttcgtaccgacggttacggggcctcgtcggttcgtaccccgtggtcgtacgggtttcncgggtggcctaggttcggtaccgtcggtacgggtacgtacggtacgtttcctacgttcctcccgtaccgtacgttaaccgcgaccgtaacggtcccgtaggtaccgtacggttcgttaagggtaaattttaacgttttcggtacgttttaacgtttttacgttacttacgtaacgtagaacttaaattacgtaagttacggtccgttaggtccccgttacggtaagttcgtaaccgttcgtttacgggccggtaacgggtacgtaacggtccgtaggaacgttaccgtaacgtaaaccgtaccggttcggttacggaccgttaccgg

SEQ ID NO: 242944 - DNA, 655 bp, Homo sapiens
  misc_feature: GYAE6OF02JZZ79.35.85.H08.1.454.CMB.1.raw
  modified_base (330)..(330): a, c, t, g, unknown or other
  misc_feature (330)..(330): n is a, c, g, or t
  modified_base (405)..(405): a, c, t, g, unknown or other
  misc_feature (405)..(405): n is a, c, g, or t
  modified_base (522)..(522): a, c, t, g, unknown or other
  misc_feature (522)..(522): n is a, c, g, or t
  modified_base (648)..(648): a, c, t, g, unknown or other
  misc_feature (648)..(648): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccacgtctgtctgtgtcctccgaggggacaggacgccctacccgtctcctggccgacgggccctagtccgaggagttgttaaggcagctaacttacgccgtggtaaccagaccgaagtaaacgtcggaccaggcctccggagctccgatactcgtttggngtctaccgacgtacgggcctcgtaggtcgtcccagtcgtacggtcgtaggcggtgtacggtcggtccttacgggngggtaaccgtagttaacgtttcccacgttacgttaccacgtacttacgcgtaccgaacgtcccgtagccgtaacgtaccttggtaacttggtttacgtaccttaggttttaaccgtnttacgtacgaacgtaacgtaacttaagttaacgtacgtcgtcgtaccgtcgtagttacgtcgtttacgttcggacggacggtacctagacgtaggtactacgtaacgaacggtaccgtggtaccgngtaaccg

SEQ ID NO: 242945 - DNA, 537 bp, Homo sapiens
  misc_feature: GYAE6OF02H3I0K.35.85.H08.1.454.CMB.1.raw
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagacaacttagcctggtaccagcagaagtgccagctccaggctccncatctttgtcgtgtccactagggccngtggtcgtcccagtcacggttcagtggcagtgctcgtggacagagttcactctcaccatcagcagcctgcagtctagaagttatttgcttagtttattacgtagtactagactaaagttataatacgacttcgtcctaccggtagttcgttccttacggttttcgccggtaacggggtaaccaggaccgtaggacgtacgtacgaaaccgtacgttacgtcggtctacgg

SEQ ID NO: 242946 - DNA, 680 bp, Homo sapiens
  misc_feature: GYAE6OF02IAZ5W.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttcttcttcctcctgctattctggctcccagatatcactggagaaatagtgatgacgcagtctccaaccactctgtctgtgtctccgaggggacagacgcccacctctcctgcagggccagtcagtagtgttagcagctaacttagccgtaggtaccagcaagaagttggaccagcctccgagctcctactattcgtttggcgttcgtaccgacgtacgggccgtcgtcgggttccgtcccgtaaggtcgtacgggttacgaggtcgggcgaggttcggtcgttcggtcgggaacgtaggtaccgtttccgaccttcccgtaacccaaccgtaacttaccgacggtaccaacgggtccctacggtacgtaacggttacgtacggtaaagtttagttttcggtactttaacggtttttacttacgttcgtacgtacgttaactaaattaaacgtaacttacggtaccgttcgtacccgttcggttaacgttcgtacgttacgtttcgggacggtaacgggtaacgacggtcgtacggagtcgttaaaaacgacgtaacggtcgttacggcgttacg

SEQ ID NO: 242947 - DNA, 614 bp, Homo sapiens
  misc_feature: GYAE6OF02HFQRO.35.85.H08.1.454.CMB.1.raw
  modified_base (480)..(480): a, c, t, g, unknown or other
  misc_feature (480)..(480): n is a, c, g, or t
  modified_base (507)..(507): a, c, t, g, unknown or other
  misc_feature (507)..(507): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtattcggaacaacgtagtctggtaccagcaagaacctggccacggcctacccgaggcctcctcattctagtcggtcgcactcccaccgacgggcctacgtcggtactcccgacgaccgtagggttcagggtcggcgtacgggtcgggtcgtaggggactacggtaccttccgacctcctaccacctagtacgacggccacggtcctggacctagtcgtaagtaacgtattacgtgtacgttagtttacncgtactagtacacgtacttaagtttanacgtacgtcgtcccgtcgtccgttccgttcgttccgggacggtacgggtaccgtagggtacgtaagtacgtaacgaacggtacgtggtacggtcgtacgacctaacg

SEQ ID NO: 242948 - DNA, 671 bp, Homo sapiens
  misc_feature: GYAE6OF02HP88S.35.85.H08.1.454.CMB.1.raw
  modified_base (192)..(192): a, c, t, g, unknown or other
  misc_feature (192)..(192): n is a, c, g, or t
  modified_base (247)..(247): a, c, t, g, unknown or other
  misc_feature (247)..(247): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccaggggagaggacagagccaatggactggggtntactagtaacagccctgctggcgagagggaccagggcaccgtcctccgagggacncccatgctgcaagtccggccagaggtcgcccctagaacctggaacggccaagtgacgaacccaagacgaggccaaggtcgggttagtaggacgacccgtggacggagcgtcgggccctggtcccaggcgaggcgcgtcggccctgctcggctcggctcgggctacggcgtagtcggtccgcccgacgtcggccgtcgtcgtcgaccgtcccgtacggtcggttccgaccggtaaccgcgaaaaccgggcccgggaacccgaccgggtaaccccgtacggaccgtacccgtacgtaacggttacgggaaacggtcgaaccggaccgacgtacccgaacggtccggtacggccgggtaacgtccggtacgggtccggggacgacgggtaccgtaccgggacccgaaccggacccgtaaacccccgg

SEQ ID NO: 242949 - DNA, 766 bp, Homo sapiens
  misc_feature: GYAE6OF02I7OW4.35.85.H08.1.454.CMB.1.raw
  modified_base (126)..(126): a, c, t, g, unknown or other
  misc_feature (126)..(126): n is a, c, g, or t
  modified_base (150)..(150): a, c, t, g, unknown or other
  misc_feature (150)..(150): n is a, c, g, or t
  modified_base (164)..(164): a, c, t, g, unknown or other
  misc_feature (164)..(164): n is a, c, g, or t
  modified_base (246)..(246): a, c, t, g, unknown or other
  misc_feature (246)..(246): n is a, c, g, or t
  modified_base (337)..(337): a, c, t, g, unknown or other
  misc_feature (337)..(337): n is a, c, g, or t
tcagtacagatcgtcacgaccggtgctcgatttagtatcactcagtcggcggggaggaactgctcagttaggacccagacggaaccatggaagccccagcgcagcttctcttcctcctgctattcnggcctccagatctcaacgtggaanaaatgtgatgacgntagtctaccaccactctgtctgtgttccaccggaggggacaggacgccctacccttgtccctgaccgagggccagtcgaagnggttgtacgcagacctaaacgttcgaccgtggtacccagactaagtaaacggttcggaccgtacggcctccgaacgggtcctaaccggtcnctttcgtttcggagttccgtaccgaacggtaccggggtccgtacgttcgggtaaccgttccccgtaggtaccggttaaggtttccgaagggtttcggggaaccgtaggtttcgggcccgtagggttacccggagaggtttaccctcgtaaactccggtacctacggacttacgacggtctcgaccgtaggctaacgggtcttaaggtaaaccgtgttttacccggtatttaggtttttaaccttcgtacggtttaccgaagttacccgttaaattaatttaacgtaaccgtttacggcggttacccgttaccggtagtttacccgtacgttttacccgttcgggttaaccgggaacgggttaacacggttacggtagtaaccggtactaaacgggtaacgttaacggtttacggcgggttaactcccgg

SEQ ID NO: 242950 - DNA, 706 bp, Homo sapiens
  misc_feature: GYAE6OF02I18J9.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagagccaccctctctagcagggccagtcaggagtcgtagcagcaacttagcctaggtaccagcaagaaagttgggacccagggtacctacccggagggtacccttccctacgtactttcgttttagggtcgtacgttcccaacgttacggggccctcgtagggttcgtacccgtaagtctaggggtttccaaggtcggaccgtaggttcggtcttacggtaggggaacctaggtagtttcccaaccttctaccgacctacgtcgacgcgtaacggtcctcgtacgtacgttacgtagtaaggttactttgtacgttaagttttaacttacgttggtactaacgtacgttaaattaactaaagttacgtcgtacggttaccgtacggttaacgttcgtaccgttacggttttacgggacccggtaacggggtaacccgtaacggtaccgtagggtaacgaacggttaaccggtaaaaccggttaccgtacgggttaccggtacgtaaccg

SEQ ID NO: 242951 - DNA, 632 bp, Homo sapiens
  misc_feature: GYAE6OF02HFLQB.35.85.H08.1.454.CMB.1.raw
  modified_base (233)..(233): a, c, t, g, unknown or other
  misc_feature (233)..(233): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
  modified_base (387)..(387): a, c, t, g, unknown or other
  misc_feature (387)..(387): n is a, c, g, or t
tcagtacagatcgtcacgaccggtgctcgatttagtatcactcagtcgcgggggaggaactgctcagttaggacccagacggaaccatggaagccccagcgcagcttctcttcctcctgcttattcgtggcctcccagatatcacgtggaagaaatagtgatgacgctagtcctacccaaccacttctgtctggtcgtcctaccggaggggacaggactaccccacctctcgngaccgacgggcctagcgagtacgttgtagactagactaacttcgcctaggaccagtacgaagtagtccgacacggcctaccgnggcctccntagtttcttggctcgtacacggtcgggcctgttggtcctccgagtcgtaggttcaggtcgacnggttcgctcgggaggtaataggtcttaccgtactccgtacacgtactcgacgcgacgtcctaggtcctaggtctaaggtaattgtttacgacgttaagtttcttaacgtcgtactacgaacttaagttaactagtacgttccgtcgtccgtaagtcgttacgtccgttacggttcgggaccgaagggacctaaggtacgagtaacgtaacgtaaccgtaaggtaaccgttggtacgtacgtaccg

SEQ ID NO: 242952 - DNA, 780 bp, Homo sapiens
  misc_feature: GYAE6OF02IBYRO.35.85.H08.1.454.CMB.1.raw
tcagtacagatcgtcacgaccggtgctcgatttagtatcactcagtcggcggggagagctctggggaggaactgctcagttaggacccagacggaaccatggaagccccagcgcagcttctcttcctcctgctattctggctcccagatatcactggaagaaatagtgatcgacgcagtcctccaaccactcttgtctgtgtcctccgaggggaccagacgcccaccctctcctgcgaggccagtcaggagttgtagcagactaacttacgaccgtggtaccagaccaaggtaaaggtttcggaccgtacggcccttaccccgagggtcccctccgtactacgtttccgttttggtcgttccgtaccgtaaccgggttcggggccccgtacggttcggttaccggtacccccgtagggttacccgtacgggttttacggaacgggttcggaccggtagggttacggggtccctttccggggttaacgggggaccttaaacggggttccggttttacccgtaaccgtttacccgtaacccgtacccgtaaacttaccgaaccgtccgtaaaccgtccgtaccggtccgtaacgttaccgttaaggtaacgtttaagttttcggtacgtttaacgtttttaacttacgttaccgtaggttaactaacgttaaactaaagtttaaagtaccgtcgttacccggtccgttaccgttgttacgttaccgttacggtttccggacggtaacgggtacacggtcgtagtacggtacgtacgtaacgg

SEQ ID NO: 242953 - DNA, 562 bp, Homo sapiens
  misc_feature: GYAE6OF02GNJ4P.35.85.H08.1.454.CMB.1.raw
  modified_base (556)..(556): a, c, t, g, unknown or other
  misc_feature (556)..(556): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcattctttggtgtcgtccacgtacggggcccgtcgtggtcgtcccgagttcgaggtttcaggtggcaggtggctcgtgggacaggtacgttcacgtctaccacctatcagcacgcctgcgagtctagtaagttagtttcgacttagttttattacgtgtacagtactaatattaatagcgttcgtcctacggtagttacgtcgttacgtttcggaccgtaaggggtaccaaggtcgtaggaagtacgtacgaaaccggtacgtggtacgngtaccg

SEQ ID NO: 242954 - DNA, 767 bp, Homo sapiens
  misc_feature: GYAE6OF02H9IBJ.35.85.H08.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccagccatcctgtctgtgtcctccgaggggagagacgcccaccctntcctgccgaggtccagtcagactatagtaccaagttanccttggatcagacgaagtaaacctggtacgacggtcctccgaacggtcctccctctacttcgttagtcggtacgacctaccgtacccgtaaccgacggggtaccctaaccgttcgggtaaccctacccgaccggttcccgtaacgggtttcgaacgggtttccggacgttaagggttcggggttacggttacgggggaaactagggttaacgtttaccgtacctttccgtacctaacctacgttacgacgtccgaacgtccgtagccgtaacggttcttaaggtaacgtttagttttacgtaagttttaacgttttaacgttactacgttacgtaactaacgttaattaacgttaaacggttacgttaccggtaccggtacccggttacgttacgggtttacctaccggtttccggttttaaccgggacccggtaaaccggggtaccttaaccgggtacggtttacggaacggttaacgaacccgtaaaacgggttacctttaggggtcctaaccgg

SEQ ID NO: 242955 - DNA, 610 bp, Homo sapiens
  misc_feature: GYAE6OF02IP1FJ.35.85.H08.1.454.CMB.1.raw
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtctccaaccactctgtctgtgtcctccgaggggacagagcccaccctctcctgcacgggccagtcagagtgttagcagcctaacttagcctggtaccagcagaaagttgcaggctccaggctccncattcgttggngtcgtccacgtagggcccncgtgtgtccctagtcgaggtttcaggtggcgtagtcggtcgtcgtagggactaggacttccacttcctaccaaccgtactcgtaacgcctacggcccgtacgcagtcgtacgtaaagttcgtttcgctttacggttttatacttacgacctaagtaactaagttataaactggtacctcgggtacctccggtagttagttccgttacgtttaccggaccggtacggggtaacctaacggcgtacggtaactacgtaaccggaaccgtaggttcggtaggtccgtaaccgg

SEQ ID NO: 242956 - DNA, 884 bp, Homo sapiens
  misc_feature: GYAE6OF02I8I2M.35.85.H08.1.454.CMB.1.raw
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggacgtggggtgtactgtaacagccctgctggcgagagggaccagggcaccgtcctccgaggggacgcccagtcgctcgacgaaggtccgggccaggacggtcggccccctggaaaccctggaacggaccctaaagtacggaacgaacccccgaaaggaaccgaacgggaccctaaaacgggttgggggttacggtacggtaaccggtaaccccccgttaggaacggggtaacggtcccggttacgggggtcccccgttcggggtacccccggaacgggtacccgaacgggccggccggttcccggggtaccccccgttggtccgttcgggtcgttcgggtccggttcgggggttccgttcgggtacccgtacgggtttccggggtccccgtcccggtaaccggttccggggtcccgttacggccggttacccggcccggtaaccccgtaacggtttccggggttaccggacccgtaacccgggaaccgggaaacccgggtaccccggggaaccccgtaaccgggtaacccgtacgggtaccgtcccgttacggtacgggttacggaaacggaccgacgggtacccgtacgtacccgtcggtacccggtacgggacccgggtcggtcccgggtcggggtaccgggtacggtaccgggttaccggaacccgggtaccccggaacccggacccccgtaacccccgg

SEQ ID NO: 242957 - DNA, 510 bp, Homo sapiens
  misc_feature: GYAE6OF02IT0OP.35.85.H08.1.454.CMB.1.raw
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (344)..(344): a, c, t, g, unknown or other
  misc_feature (344)..(344): n is a, c, g, or t
  modified_base (370)..(370): a, c, t, g, unknown or other
  misc_feature (370)..(370): n is a, c, g, or t
  modified_base (506)..(506): a, c, t, g, unknown or other
  misc_feature (506)..(506): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggngtgtccactagggccnctggntcccagtcaggttcagtgcagtgctgnggacagtagttcactctcacactcancacgctgcagtctagaagtattttgactagtttattactgtacagacaataataatagtctgcctcgagttgctacgttttcggaccgtaagggacctaacggctaggagtactacgaaacgaacgtacgtacggntacg

SEQ ID NO: 242958 - DNA, 757 bp, Homo sapiens
  misc_feature: GYAE6OF02IZ8H9.35.85.H08.1.454.CMB.1.raw
  modified_base (146)..(146): a, c, t, g, unknown or other
  misc_feature (146)..(146): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactgganaaatagtgatgacgcagtctccaacactctgtctgtgtctcaggggacagagccacctctcctgcgacgggccagtcagagtgttagcagacaacttgccgttggaccagcaagtaaagttcggaccagggcctaccgacggtcctccctactacgtttcgttttcgggcaccgtacctacccggaaaccccgacggggtaccctacgttacgggttaccctacccgacggtacccgtaagggtttcgaagggttcggacggtacgggttcgggtcggttacggggaaactacggttaaccttccgaacctccgtaccgtaaccaggttaccaaccggtcgaccgtccgttacgcgttaagttccgtaaagtagtttacgttttagaccgtttaaagttttaccgtttacgttaggtaccttacgtaacgtttaaattcgttaaacggttaaccgtaaccgtttccggtaacccgttacgggttaaccgggttaccgttacccgggtaacggtaaccgggtaaagggtaccgggtaacggtaaccgtaacccgggtaacgtaaccgggtttgtaccgggtactaccggtaaccgtaacccttcgttaccgg

SEQ ID NO: 242959 - DNA, 583 bp, Homo sapiens
  misc_feature: GYAE6OF02HA6KE.35.85.H08.1.454.CMB.1.raw
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (441)..(441): a, c, t, g, unknown or other
  misc_feature (441)..(441): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcacgggccagtcagagtgttagcagcaacttagcctggtaccagcaagaaagttcggaccaggctcccgaggctcctctattcgttggtgtcgtccacgtagggccgtcgtcggtcgtccctagtcgtaggttcaggtggcaggtcggctcgngggacngtagtcactctcactatcacgcagcctgctgtctaggaagttcgtttagctttaagtttacttacgtntacgagtactaataataatacggtcgtacgtacctcggtaagttcgtaccgttcggtttcggaccggtaacggggaccctaaagggtcgtaagggtaactacggttaaccgaaaccggtacgtacgggtacgtcgtaaccgg

SEQ ID NO: 242960 - DNA, 619 bp, Homo sapiens
  misc_feature: GYAE6OF02GQWUT.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcgagggccagtcagagtgttagcagcaacttagcctggtaccagcaagtaaagttcggccaggcctcccgaggcctaccgtctattcgtttgggtcgtcgtacccgtacgttacggggcccgtcggttcgggtcgtccccgaggttccgtagggtttccagggtcggtcgaggttgggcttcggtaggggacaggtacgttcacttctacccactactcacgcacgcctgctagtctagtattatttcgacttagttttacttactgtacgacgtactaattataagttacgtcttacggtccgtacgtagttcgtacgttacgttttcgggaccggtaacgggtaacctacgggcgtacggaacgtacttaacggaaacgtacggtaggtacggtacgtcgg

SEQ ID NO: 242961 - DNA, 754 bp, Homo sapiens
  misc_feature: GYAE6OF02F8K21.35.85.H08.1.454.CMB.1.raw
  modified_base (186)..(186): a, c, t, g, unknown or other
  misc_feature (186)..(186): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatgtgatgacgcagtctcccaaccactctgtctggtntcctccgaggggacagacgcccaccctctccctgccacgggccaaggtcaggagtgttagccgagcctaaacttacgaccgtcggtaaccagacaagtaaaacggttcggccaagggtccctacccgaggtccctaccctcgtagtccgttttgggtacgtcgtaccgtaacgtacgggcccgtacgttacggtcggttacccccaggtccgtaacggtttccaggtacgcgtaggtcggcctgtcggggaacagggtacgtttccaacctttcgacctaaccgtactacacgctaacggcctgactagtcctagagttgtttacgaccgttagttttaactattacgttacctacggtaaccaaagtttaacaaacgttaacggttaccgttaccgggttaccctaccggttaaggttttacccgacggttttaacgttttcccgggaaacccgggtcgggggtttaaacccgtaaacggtacccggttttaacgggaaccgttaaaccgggttaaccgtaaaaacccggggtacgtttaccggggttacgggccctttaacccggg

SEQ ID NO: 242962 - DNA, 801 bp, Homo sapiens
  misc_feature: GYAE6OF02HZYOM.35.85.H08.1.454.CMB.1.raw
  modified_base (348)..(348): a, c, t, g, unknown or other
  misc_feature (348)..(348): n is a, c, g, or t
  modified_base (454)..(454): a, c, t, g, unknown or other
  misc_feature (454)..(454): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccatctgtctgtgtctaccgaggggaacgagccactcctcctactgaccgagggtccagtacaggaagttacgtaccgggaactaacggtagtcgacggttaccaaggacaacggtaaaccctacggaccgaacggtctacccgacggtcctaccctactaacgtccttattcgggtanacgacgtaccgacccaggggacctaaccgtggtacctccgaacggtccgtaacggttccgaaggttcggactaggttggggtactacggggaactacggtactacncctcgtacaacctatacacgacctaacgtcccgtacgacgtaacggtcgtaacggtaaggttacgttaaagtacgttaaccgtaacgttttaaccgtccgttaaactcgggttacctaaggttaacctttaaacggtttaacgtaacggtaccggttaccgggtacccgggaccttaccgtttacccgggttacggttttacccggggtaacccggggttaagggggtaaaccccggttaaaggggggttacccggtaaacggttaaaacccgtaaaacgggttaaaaccggttaacgggtttacggtaaccgggttaacccggtaccgggttacctaaaaccccgg

SEQ ID NO: 242963 - DNA, 598 bp, Homo sapiens
  misc_feature: GYAE6OF02FWBF7.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcagggccagtcagagtgttagcagcaacttagcctggtaccagcaagtaaagttcggaccaggcctcccgaggcctcctcattctttggtgtcgtccacgtacgggccgtcgttggtcgtcccagtcgaggttcaggtgcaggtcggctcgtgggactaggtacgttccacttcaccaccatcagcacgcctgcgtacgtctaggaagttagtttcgactttaagttttattacgttcgtacgagtactaaattaagttaagtacgtcgttacggtcctacggtagttacgtcttacgtttcggacccggtaacggggaaccgtaacggtaccgtaggtaacgtacgttaaccgtaaaccggtacgtggttaccgagtaccgg

SEQ ID NO: 242964 - DNA, 543 bp, Homo sapiens
  misc_feature: GYAE6OF02HNZ5O.35.85.H08.1.454.CMB.1.raw
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttgcctggtaccagcaagaagttggccaggctccaggctcncatctttggtntcgtccacgtacgggccncgtggtcgtcccaggtcaggttcaggtggctaggtggctgtgggactagtagttcactctcaccatcagcacgcctgcagtcgtagaagtatttgcttagttttattactgtacagactaattataatagcgtacgtcctcgtagttcgcttacgtttcggaccggtaagggaaccgtaaggtcgtacggaagtacgtaaccgtaaacggtaacgtacggtcggtactacgg

SEQ ID NO: 242965 - DNA, 734 bp, Homo sapiens
  misc_feature: GYAE6OF02I11FB.35.85.H08.1.454.CMB.1.raw
  modified_base (205)..(205): a, c, t, g, unknown or other
  misc_feature (205)..(205): n is a, c, g, or t
tcagtacagatcgtcacgaccggtgctcgatttagtatcactcagtcgcgggggaggaactgctcagttacggacccagacggaaccatggaagccccagcgcagcttctcttcctcctgctattctggctccagatatcactggagaaatagtgatgacgcagtcctaccaaccactctgtctgtcgtctccgagggacagacncccaccctctccgtgaccgacgggcctaagtcgaagtagttacgttacgacgacgacgtaaccgttacgtccgtacgtaccacgacgaagtaaacgttcggaccacggtacctcccgacgtcctccgtactacgtttcggttggtcgtcgtaccgaacgtggtccgtcgtcggtcgtcccgagttcgtacggttcgagtcggcgtaggtggaccttgtagggaactcggtacgttaccaccttcctaccgactacgtacgtacgccgtactcgtacgtacgtacggtacgttaaggtaacgttacgtttacgtacgtttaacgttttacgttaaccgtttgtacgaaaacgtaacttaaagttaaacttaacggtacgtccgttacccgggtcctaaccgggtttactaccggtttaccgttacggtttacggaacccgggttaacgggtacccgttaagggtccgttaacgggtcgtaaacggtaacccgttaaacgggtacgtacgggttaccgggtactaacccgg

SEQ ID NO: 242966 - DNA, 606 bp, Homo sapiens
  misc_feature: GYAE6OF02G7WVD.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctaccaaccactctgtctgtgtctccgaggggacagacgccaccctctcctgcgacgggccagtcagagtgttagcagcaacgtagcctggtaccagacaagaaagttcggccaaggcctcccgaggtcctcctcattcgtttggtcgtcgtccgacgtacgggccgtcgtggtcgtaccctagtcgtaggttcaggtggtcaggtcgctcggtggacgtgtacgttccactcctacgacctactcgacgcacgcgtcgcgtacgtcgtagagttacgtttagacttatttattacgtacgtctagtactaattaacgtattacgcgttcgtaccgttacgtacgttacgtcttacgtttccggaccggtaccgggtaaccgtacggtccgttacggaagtaccgtaacggaaccgtaacgtcgggttacggtacgtaaccgg

SEQ ID NO: 242967 - DNA, 606 bp, Homo sapiens
  misc_feature: GYAE6OF02F7MVA.35.85.H08.1.454.CMB.1.raw
  modified_base (209)..(209): a, c, t, g, unknown or other
  misc_feature (209)..(209): n is a, c, g, or t
  modified_base (403)..(403): a, c, t, g, unknown or other
  misc_feature (403)..(403): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgtcagtctccaaccactctgtctgtgtctccgagggacagagccacctntcctgcagggccagtcagtagtgtagccagctaacttagccgtcggtaacagcaagtaaaagttcggaccacggtctacccgaggtcctcctcacttcgtttaggtgtcgtccaacgttacgggcctcgtcggtcgtccagtcgtaggtcgagtcgcaggtgctcgtggacagtagttccacgtcctcaacgtntacgagccagcctgacgtacgtctagagttactttcgactttagtttactacgtgtacaagtctaaattactaagtacgtccgtacggtcccttacgtaggttccgtacgtttaccggtttaacgggacccggtaacggggtaaaccctaggtaccgttaagggagtaacctacggaaaccgtagttcggtacggacgtacgg

SEQ ID NO: 242968 - DNA, 835 bp, Homo sapiens
  misc_feature: GYAE6OF02IXDHG.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctaccaaccactctgtctgtgtctccgaggggacagacgccaaccctctcctgcacgggccagtcagtagtgttacgcagctaacttagccttaggtaccagtacaaggtaaaagttcggacccaaggccttcccgaacggtccttaccctcaacgtttccgttttgggtacggttcgtacccgtaacgttaacgggggtccccgacgtttgggtccgttaccccgtaaggtttacctaaggggttttccaaacgggttagggtacccgtaagggttcggggttaccctccggtttacggggggaactaacgggttaacgttttcccgaaacccggtttccttaaccctaaacccgttaacgttacccgaacgtacccgtaaccgtaccccggttagtaacccgtaacggttccgtaaacggtaaacggtttacgttttttaaccggacgttttaaacggtttttaacgttacccgtttaggtaccgtaacgtaaacttaaacgttaattaaaacgttaacgccgttaaccgggttaccccttaaccgggttcgtttaacgtaccgtttaacgtttttaccggggaaccggtaaccgggggtaaaccctaagggtacgttaacggaagtaacgtaacgtaaaaccgtacggtaacgttccgggtactacgg

SEQ ID NO: 242969 - DNA, 834 bp, Homo sapiens
  misc_feature: GYAE6OF02JHCWQ.35.85.H08.1.454.CMB.1.raw
  modified_base (177)..(177): a, c, t, g, unknown or other
  misc_feature (177)..(177): n is a, c, g, or t
  modified_base (237)..(237): a, c, t, g, unknown or other
  misc_feature (237)..(237): n is a, c, g, or t
tcagtacagatcgtcacgaccggtgctcgatttagtatcactcagtcgcggggaggaactgctcagttaggacccagacggaaccatggaacgccccagcgcagcttctcttcctcctgctattctcggcctcccagatatcactggagaaatagtgatgacgctagtcctccaacnctctgtctgtcgtctcgagggacagacgcctacctctccgtgcgacgggccagtccaagngttgtacgcagacaacgttacgccttaggtaccaggtacctaaggtaacgttcggacctacggtccgtacccgaaggtccctacccgtacgttacgtttccggttttcgggtcgttccgtaccccgtaacggttccggggtaccctcggttcgggttacctaccccggtaagttaccgtaacggttcgtaacggttcggacgttacggtacggtccgttaacgggtaggggtaacctaggggttaaacccgttccgtaaccgtttcccggtaaaccctaaccgtaaccgttacgtacggtaaccggtaccgtacccgttacggaccgttaacggttaccgttaacgttaacggtttacgtttacggttacgtttaaacggttttaccgtacgtttacgtaccgttacgtaaccgttaaagttaacgttaaacgtacggtacccgttcgtacccgttacggttaaccgttcgttaacccgttacgggttttaccgggaaccgggtaaaccggggttacctaacggttacgggtaacggtaacgtaaccggttaaccggtaaacggtaaccgggtttaccggtacggtaccgtaaccgg

SEQ ID NO: 242970 - DNA, 735 bp, Homo sapiens
  misc_feature: GYAE6OF02GZTTY.35.85.H08.1.454.CMB.1.raw
  modified_base (205)..(205): a, c, t, g, unknown or other
  misc_feature (205)..(205): n is a, c, g, or t
  modified_base (247)..(247): a, c, t, g, unknown or other
  misc_feature (247)..(247): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcacgtggaagaaatagtgatgacgcagtcctaccaaccactctgtctgtgtcctcgagggacagacncccacctctctgacgacgggccagtcagtaggttgtacgcanacctaaacgttacgccgttacggtaccagacgaagtaacggttcggaccacggcctcccgaggtccttacctacgtacttcggtttaggtcgttcgtaccaacggttcgggcctcgttcgggtccgttacccgtaggtctacggttcaacgggtcggacggtagggtcggttaccgtcggggtacggggtaactaggtttaccgttaccgcccgttaccgtaacgtaacccgttacgtaaccggacgtccgaaccggtcctcggactacggtaccgttaaaggttaaacggtttcttttacggttacgttttaacggttttacgtttacgtagttaacggtaacgtaacttaaagtaacttaaagtccgtacggttaccgtaccgttcggttagttaccttaccggttacggtttaccggacggtaacggtaaccgaggtacgttaaccggagtaaccgtacgaaacgtacggttcgacggtactacg

SEQ ID NO: 242971 - DNA, 574 bp, Homo sapiens
  misc_feature: GYAE6OF02FMFNM.35.85.H08.1.454.CMB.1.raw
  modified_base (410)..(410): a, c, t, g, unknown or other
  misc_feature (410)..(410): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttacgcctggtaccagcagaaagttggccaggctcccgaggcctcctcatctttggtgtgtccacgtacgggccgtcgttggtcgtccccgtagtcctaggttcgtagtcggcgaggtcggtctcgtgggacaggtagttcacctctccaccatcagcacgcctgcgngtcgtagaagtatttgcttagttattactgtcgagtacgtaattagtaactagtacgtcgtccgtaccgagtttcgcgttacgtttcggaccggtaacgggaccgtaaggtacgtaggtaacgtacgtaaccgtaaaccggaacgttaggtacggtactaccgg

SEQ ID NO: 242972 - DNA, 850 bp, Homo sapiens
  misc_feature: GYAE6OF02G8RGN.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgaggggacagacgcccaccctctcctgcacgggccagtcagagtgtagcagctaacttagcctaggtaccagcgaaggtaaaggttcggacccgaggcccgtacccgacgggtcccttcccgtacgtacgtttcgtttcggtcggttcgtacccggtaaccggttacggggccccgtcggttcgggttccgttcccccgtaaggttccgtaacgggtttccgtaacggggttcgggacgtacgggtacgggtccgttccgggtacggggaaccgtaaggttaccggttttccaaccgtttcccgtaccgtaaccctacgttaccgaccggtaccgaccggttccctagggtaccttaacggttaccgttaacggttaaacgttttgttttaccggtacctttaaggtttttaacgttaaccggtttgttaccgtaaggttaaaccttaaagtttaaacttaaacggttacggttcccgttaaccgggtaccccgttaccggttaaacgttcccggttaaccgttttaccggttttacccggggacccggggttaaaccggggtaacccgtaagggttcccgggtttaacgggaacgttaacccgttaacccggtaaaaacgggttacccgggttacggttacgggttacccgtaacccggg

SEQ ID NO: 242973 - DNA, 718 bp, Homo sapiens
  misc_feature: GYAE6OF02HNJSD.35.85.H08.1.454.CMB.1.raw
tcagtacagatcgtcacgaccggtgctcgatttagtatcactcagtcgcgggggaggaacgtgctcagttacggacccagacggaaccatggaagccccagcgcagcgttcctcttcctcctgcctagttctggctcccagatatcactggagaaatagtgatgacgcagtctccaaccactctgtctcgtgtctccgaggggacagcgccacccgtctacctgcgacggccagtcagagtcgtagcagcaacttgcctaggtaccagtcgagaaagttcggcaaggcctaccccgaggcctcctcattccgtttcggtgtctaccgacggtaggggcccgtcgtggtcgtcccctaggtccgtaaggggttccaggtcgacgtagtcggcgttcggagggtactagttacgttccgactccgtaccacctactccgaacgccgtaacgtccgttacgaccgtacgttaccgtaggaacgttacgttttacggtaccttaagttttaactttacgttacgtttaccgtaacgtaaccttaaagttaactaacgttagtaccgttaccggttcccgttaaccggttacgttaccgttcctttacggttttccggacccggtaaaccggggtacccgtaaacgggttaccgtaacgggtaacgttaaccggtaaccgtaaaaccggttaccggttacggttacgggtacccgttacccgg

SEQ ID NO: 242974 - DNA, 763 bp, Homo sapiens
  misc_feature: GYAE6OF02JJUN7.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcacgggccagtcaggagttgttagcagctaacttacgcctacggtaccagcaagtaaacgtcggccaggcctcccaaggtcctaccctctacttcgttttgggtcgttacgtacccgtaacgtaccggggccgtacgttcgggtccgttccccgaaggttccgtaacggtttcgaagggttcgggactacgggtacgtcgtacggtacggggaacctaggtacgtttaccacgttcccgtaccaaccgtacgtaccgacgacgtaaccggtccttaagggtaacttacgtaaggttaaacgttacgttttacggtacgtttaaacgttttacttaccgttagtaccgtaacgtaactaaaattaaccgttaaagtacgtaccggttaccggttaccccgttaaccggtacgtttacggaaccgttttaaccggttttcggggaacccggaaagggggttaacccctaaagggttcccggtaaggtaacggttaacctaaacggaaacccgttaacgggttacggtacgggtaccgtaccggtaacccg

SEQ ID NO: 242975 - DNA, 737 bp, Homo sapiens
  misc_feature: GYAE6OF02F6OA5.35.85.H08.1.454.CMB.1.raw
tcagtacagatcgtcacgaccggtgctcgatttagtatcactcagtcggcgggggaggaactgctcagttaggacccagacggaaccatggaagccccagcgcagcttctcttcctcctgctattctggcctccagatatcactggagaaatagtgatgacgcagtctaccaaccactctgtctgtgtctccgaggggacagacgccctaccctctcctggaccgacgggccaggtcaagtagttaggttagcgagactaacttacgccgttacggtaccacgtacaaggtaaaggttcggacccgtaggtccctacccgaaggtccctacccgtctacgttcggttttacggtcgtcgtaccgtaacggtacgggcccgtcgttgggtccgtaccgagtccgtaggttcgaggtcgagtaggtcgcgtcggtagggacaggttacgttccctacgttcctaacgaccgtagtaccgacgaaccgtacgtacccgttacggacgttacggttaacgtacgtaacgttttacgtttacggtaacgttttaacgtttttaactaaccggttcgttaaccgtaagtaaccgttaaaagttacttaaaacggtttacggcgtttaccgggtaccctacggttacgttacgttaccgttacgttcggaaccggtaacgggtaacctaaggtccgtaaggtacgaacgttaccggaaaaccgttgtcggtacgtacgtaccgg

SEQ ID NO: 242976 - DNA, 614 bp, Homo sapiens
  misc_feature: GYAE6OF02F0LAW.35.85.H08.1.454.CMB.1.raw
  modified_base (418)..(418): a, c, t, g, unknown or other
  misc_feature (418)..(418): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaagttggccaggcctcccgaggcctcctcattctttggtgtcgtccacgtagggccgcgttgggtcgtccccagtcacgggtttcaggttcggctaggtcggctcgtgggacagtacgttcactctcacctatcagcacgcctgcagtctagaagtnttttcgacttagtttacttacgtgtacgacgtacctaaattaataaagtacgtaccgttacgggtcccttaccggtagtttcgtaccgtttacgtttcgggaccggtaacggggaacccgtaaacgggtccgttagggaacgtaacgttaaccggaaaaccggttaaccggtagggttaccggtaccgtaacccgg

SEQ ID NO: 242977 - DNA, 812 bp, Homo sapiens
  misc_feature: GYAE6OF02G5ZGG.35.85.H08.1.454.CMB.1.raw
  modified_base (172)..(172): a, c, t, g, unknown or other
  misc_feature (172)..(172): n is a, c, g, or t
  modified_base (480)..(480): a, c, t, g, unknown or other
  misc_feature (480)..(480): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggaagaaatgtgatgacgcagtctccaacnctctgtctgtgtctcgaggggacagagcccaccctctcctgcgacgggccagtcagagtgtacgcagctaacgttcgccgttaggtaacccaggacgtaaaggtaaaggttcgggacccgaacgggtccctaccccgagggtcccctcccgttactaacgtttccgttttgggtcggttccggtaccctaaccgggtcgggggtcccctcggttacgggtcgttcccccgaggtttccggtagggtttcctagggtgggctacgggtcggtaccgtcggttacggggaaccaggttacggtttacccncgttaccctacgaaccctactaccgtaaccggcgtaacccggtacccgttcggaccttacgggttaaccgttaacggtaacggttttagtttttaccggaactttttaacgggttttactttacgtttacggtacttaacgggtaacttaaagtttaatttaacgtacggttacgttacccgttcccggttaaggttaccgtttacggtcgttttaacccgggtttcgggaaccccgggttaacgggttaaccggtaaggttaccggttaacgggtacctaacggttaaaccgtaacggttacccgggtacgggttaccggtaccgtaccgg

SEQ ID NO: 242978 - DNA, 706 bp, Homo sapiens
  misc_feature: GYAE6OF02HB52P.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtcctccaggggacagagcccaccctctcctgcagggccagtcagagtgttagcagcaacttagcctggtaccagcaagtaagttggccaaggcctcccaggcctcctcacttcgtttggtgtcggtccctagtacggggcccgtcgtcgggttcgtccccaaggttcgacgggtttcgaggttcgggactcgggttacgggtcctcggtcgggggaactacggggtacgtttccaccgttcctaccgaccctatcccgagacctacggccctacggacgtacggttaccgttacggtaaagtttacgttttagaccgtttaacgttttaacgttacgttctaccgtagtaccgttaaaacttaaagttaacgttaacggtcccgttaacgggttccccgttacggtacgtttcgtaccgttaccgttttcggggacccggtaacgggggtaacccgaagggttccggtacgtaaggtaccgttaaccgaaacggtaccgtttacggtcgggtacctaaccgg

SEQ ID NO: 242979 - DNA, 639 bp, Homo sapiens
  misc_feature: GYAE6OF02F78PR.35.85.H08.1.454.CMB.1.raw
  modified_base (401)..(401): a, c, t, g, unknown or other
  misc_feature (401)..(401): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtctccaaccactctgtctgtgtctccgaggggacaggacgcccaccctctcctgcgagggccagtcagtagtgttagcagacaacttagcctaggtaccagcgaagtaaagttcggaccaggcctcccagggccttcctctacttcgtttggtgtcgtaccacgtcgggcctcgttggtcgtcccagtccgaggttccaggtggcagtggctggagggacaggtcgtccacttccnctacatcgacgcacgcctgactagtcctaggacgtttagtttcgacgtttagttttaacttacgttgtacgtaacgtactaaagttaacgttagtacgtccggttacggtacccgttacggtagtttccgtacgtttccgttttacgggacccggtaacgggggaacctacgggtacgtacgggtaacgtaacggttaccgtaaaacggtaccgtacgggttaccggtacgttaccgg

SEQ ID NO: 242980 - DNA, 591 bp, Homo sapiens
  misc_feature: GYAE6OF02G5KTB.35.85.H08.1.454.CMB.1.raw
  modified_base (283)..(283): a, c, t, g, unknown or other
  misc_feature (283)..(283): n is a, c, g, or t
  modified_base (360)..(360): a, c, t, g, unknown or other
  misc_feature (360)..(360): n is a, c, g, or t
  modified_base (407)..(407): a, c, t, g, unknown or other
  misc_feature (407)..(407): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcagggccagtcagagtgttagcagcaacttagcctggtaccagcagaagttgccaggctccaggctcncatcgtttggtgtcgtccacgtcgggccgtcgtggtcgtcccctagtcaggttcagtggcaggtggctcgtgggacngtagttcacttcctcacctatcagtcacgcctgcagtctaggaattnttttgacttagtttacttacgttgtactagactaaagtattaagtacgtcgttacggtcccgttaccgtagtttaccgtacgttacggttttacgggacccggtaacgggggtaacctaacgggtccggttagggaacgtaaccgtaacggtaaacccggtaacggtcggttacgcgttaccgg

SEQ ID NO: 242981 - DNA, 666 bp, Homo sapiens
  misc_feature: GYAE6OF02HF4XW.35.85.H08.1.454.CMB.1.raw
  modified_base (239)..(239): a, c, t, g, unknown or other
  misc_feature (239)..(239): n is a, c, g, or t
  modified_base (375)..(375): a, c, t, g, unknown or other
  misc_feature (375)..(375): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaacctactctgtctgtgtctccgagggacagacgccctacctctcctgcgacgggccagtcacgagtgtacncacgctaacgtagccgtaggtacagacgaagtaacgtcggccgacggtccgtccgaggtcctcgtacacgtttcgttggtgtcgtccacggtacgggcctcgttcgggtacctcccggtagtaccgtggttaccgnggtcggacgtaggtcggtcgtacgtagggactaggtacgttacgtccttcacgacgtactcgacgtaccgacgtccgtgaccgtagttaccgtaggtaaacgttcgtttacgacgttttacgtttaacctttaacgttccggtaacgttaacgtaacctaaagttacgttaaacgtacgtacgttccggtacgtcgtacgttcgtacgttacgtttacggaccgggtaacggtaacgtacggtcggtaaggtacgtaacgttaacgtaacggtacggtacgtcgagtaccg

SEQ ID NO: 242982 - DNA, 739 bp, Homo sapiens
  misc_feature: GYAE6OF02G4GXS.35.85.H08.1.454.CMB.1.raw
  modified_base (228)..(228): a, c, t, g, unknown or other
  misc_feature (228)..(228): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagngtgttagcagcaacgttacgcctaggtaccgagcgtaagaaaggttcggacccaggcctacccgaaggtcctcccgtctacgttcgttttggtcgttcgtcccgtaacggtacggggtccccgtcggttcggttccgtacccgtacggttacgtaccggttcgaaggttcgggacgtacgggtcggtacgtccggtaggggacctaagggacttttccgaaccgttccgtaccaacctacgttcgaacgtccaacgtccctgtacgtacggttccgtagtaaacgttacgttttacgtactttaacgttttaacttagttacggtactaacggtactaaaattacggtttaaactacggttccgttaccgggtaccgttacggttacgttaccgttaccgtttaccggttttacgggacccgggtaacgggtaaaccgtaacggtcggtaacgggtaacggtaccgttaaccgtaaaacgggttacgtacgggttacgtaccgttaaccgg

SEQ ID NO: 242983 - DNA, 807 bp, Homo sapiens
  misc_feature: GYAE6OF02JAPOA.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctccagatatcactggagaaatagtgatgacgcagtctaccaacctactctaagtctgtcgtctccgaggggacaagacgacccacctctcctgcgaggccagtcagtagtgtagcagactaacttacgcctaggtaaccgagacgaaggtaaaggttcggacccaagggtcctaaccccgaacggtccttaccctacgtagtttccggtttaggtcggttacgtacccgaacggttacgggccgtacgttcgggtaccgtcccgagtacgtacggttacgaggttcggacgtaaggttcggaccttggacgggtaactaggttaccggttacctaacccgtacgtacccgtaaccgtacgtacccgtaacggaccaaccgtccgttacggtaccgtaacggttacggttaacggtaaacgtttaacgttttacggaacgttttacgttttaacgtttaccgtacgttaccggtaagttaacgtaaacttacgtttaaacgttccggtaccgttacggttacccgttaccggttacggttttaaccgtacgtttaaccgggtttaccgggaacccggtaaccgggggtaacccttaacggggttaaccgttaacggaaccggttaacgttaacccggttaaaaccggacgtttacggggtacgtacccgttaaccggg

SEQ ID NO: 242984 - DNA, 570 bp, Homo sapiens
  misc_feature: GYAE6OF02HKE6S.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctctcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaaagtggccaggctcccaggcctcctcatctttggtgtgtccactagggccgctggtgtccccagtcaggttcagtggcagtgctctgggacagagttcactctcaccatacagcagcctgcagtctgaagtatttggtcagtttattactgtacagacaaattagtaaatagtctacggtccgtaccgtagttacgtctaccgtttttacgggtccggtaacgggggtaaccggtaaaacgggtacccgttaggggtaaccggtaattaacccgaaaaccgtaaaacgtacggttacgggtacttacgg

SEQ ID NO: 242985 - DNA, 670 bp, Homo sapiens
  misc_feature: GYAE6OF02JP56C.35.85.H08.1.454.CMB.1.raw
  modified_base (145)..(145): a, c, t, g, unknown or other
  misc_feature (145)..(145): n is a, c, g, or t
  modified_base (190)..(190): a, c, t, g, unknown or other
  misc_feature (190)..(190): n is a, c, g, or t
  modified_base (333)..(333): a, c, t, g, unknown or other
  misc_feature (333)..(333): n is a, c, g, or t
  modified_base (399)..(399): a, c, t, g, unknown or other
  misc_feature (399)..(399): n is a, c, g, or t
  modified_base (443)..(443): a, c, t, g, unknown or other
  misc_feature (443)..(443): n is a, c, g, or t
tcagtacagatcgtcacgaccggtgctcgatttagtatcactcagtcgcgggaggaacgtgctcagttaggacccagacggaaccatggaagcccagcgcagctctcttcctcctgctattctggctcccagactatcactgganaaatagtgtactgaacgtcagtcctccaacctactctgtctggtntacctccaggggactagcgacccacctctctgacgacggccaggtcacgatggttacgacacgtcaacgttacgtccgtaggtaaccgagtaccgtaagaaaacggtttcggacgacggtccgaccgtacggccttcccgtanacttcgtttcggcttcggtaccacgtacgggtaccgcgttacggtcgtccgtaacggtctacggtntacggtacggctaggtgacctcggtacgggactaggtacgttcnccgtactccacgtacgtcaagcctaggtaccgtcgtactaggtccgtacgtaaattcggtttacgtacttaacgtttacttacgtacggttctacgtactaaacctagttacttaacgggtcttaccgtaccggttcacggttagtacccttaccgtttgaaccgggtacgggtactaagggtcaacgggtataacgtacgtaacggttaactgggtacgtcgtacg

SEQ ID NO: 242986 - DNA, 781 bp, Homo sapiens
  misc_feature: GYAE6OF02GLMB5.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcgacgggccagtcagagttgtagcagacctaacgttacgccgtaggtaaccagacgtaaggtaaaacggttcggacccgtacgggtcctcccgaaggtccctcccttacgtactttccggttttgggtacgttccgtaccgtaacggtcggggccctcggttcggttccgtccccgtaggtccgtacgggtttcgagggtcgggcgtagggttcggtaccgtcgggttaggggaactagggtacgtttaccaccttccgtaaccgaacctacgtaccgacgtccgaacgtccgttacggctaacggtcttaaggtagttttacgtttgacgtttagttttaacttaccgttggttaccgaagttaacctaaagtttaagttaacgttcggtaccgtttaccgggtccctttacgggttaacggtttccgtaacccgtttttaccggggtttaccgggaacccgggttaaaccgggtaaccgttaaacgggccggttaagggaaacccttaacggtaaacccggtaaaccggtacggtttaccgggttacggacccttaacccggg

SEQ ID NO: 242987 - DNA, 887 bp, Homo sapiens
  misc_feature: GYAE6OF02GWT83.35.85.H08.1.454.CMB.1.raw
tcagtacagatcgtcacgaccggtgctcgatttagtatcactcagtcggtcgggggaggaactgctcagttaggacccagacggaaccatggaagccccagcgcagcttctcttcctcctgctatctggctcccagatatcactggagaaatggtgatgacgcagtctccgaccacctctgtcttcgtggtctccgaggggaccacgacgccctacccgtcgtcccgtcgcgacgggcctaggtccgtaaggacgttacgttaacgcctaggtacctaaccgttaggcctagggtaacccgacgtcggaacgtaaaggttccggaccccgtaagggtccctcccccgtaagggtccctttccccgttaccggtacgtttaccccgtttttagggtaccgggttaccgtacccggtacggtaaccggggtccccgtaccggttccgggttacggttacccccgtagggtcccggtagggttacggtacggggttccgggtaccggtaacgggtttccgggtacccgttaccggttaccggggtaaccgaaccggttaacgttcccgtaaacccttacccgttacccgtaaccctaacgttaccccgtacgggtaacccgttaaccggtcccggttaccggaaccggttttaacgtttcccgttaagggttaaaccggtttgttttaccggtaacttttaacggttttaaacgttaccgttacggttaccgtaacggttaacctaagtttaacggtaacgggtaacggtaccgttacggggtcccgtttaacggacgttaacgtccgtttagggttccggaccggtacgggaacctaacggtcgtacggtagtacttaaccgaagttacccgttcggtagtcctaccgg

SEQ ID NO: 242988 - DNA, 720 bp, Homo sapiens
  misc_feature: GYAE6OF02H8SAD.35.85.H08.1.454.CMB.1.raw
  modified_base (188)..(188): a, c, t, g, unknown or other
  misc_feature (188)..(188): n is a, c, g, or t
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
tcagtacagatcgtcacgaccggtgctcgattttagtatcactcagtcgcggggaggaactgctcagttaggacccagacggaacatggaagcccccagcgcagcttctcttcctcctgctattctggctcccagatatcactggagaaatagtgatgacgcagtctacccaaccactctgtctggtntctccgagggacagacgccaccctctcctgccgacgggccagtacagagttgttacgcacgtctaacttcgcctaggtaccagctaagaagttcgaccaggcctcccgagtctcctactnttcgtttggagttcgtaccacgtcgggtccncgtcggtactccgagtcgtaggtcgaggtggcgaggtcggactcggtagggacgtagtacgttctacctcgtccacctataccgacgtaccgcgtccgtacggacgtaccgttaccgtagttaagttacgttttacgtacgttttaacgttttacttaccgtcgttaaaccgtagtaaaccgttaaaagttacttaaaaccgttcgtacccggtttccgtaacccggttacggttacgggtttaccgttcccggtttaacgggtttttacccgggaaccgggtaaccggggttaaccctaaagggttccggtaaacggttaacggtaaccgttaacggtaaaacccggttacggtttacgggtaccggtaccgtaaccggg

SEQ ID NO: 242989 - DNA, 679 bp, Homo sapiens
  misc_feature: GYAE6OF02JYO7A.35.85.H08.1.454.CMB.1.raw
  modified_base (185)..(185): a, c, t, g, unknown or other
  misc_feature (185)..(185): n is a, c, g, or t
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (405)..(405): a, c, t, g, unknown or other
  misc_feature (405)..(405): n is a, c, g, or t
  modified_base (443)..(443): a, c, t, g, unknown or other
  misc_feature (443)..(443): n is a, c, g, or t
  modified_base (586)..(586): a, c, t, g, unknown or other
  misc_feature (586)..(586): n is a, c, g, or t
tcagtacagatcgtcacgaccggtgctcgatttagtatcactcagtcgcgggggaggaacgtgctcagttaggacccagacggaaccatggaagcccagcgcagctctcttcctcctgctattctggctcccagatatcactggagaaatagtgatgacgcagtctccaaccacgtctgtctgtntactccgaggggaccnggagccctaccctctccgngacaacgggccaggtccaggaggttcggttacacgagaccaaacctttggccctaggtaccagccgaagtaaagttcggcctaggcctcccgaggcctacctacgacttccgtttggacgttccgtaccgacgtcgggccgtcgttgggttcgtacccctaggtgtaccggtcgtaggtacggtngggtttcgcgtagtacgggcagtacggtttcaaccgtntaccacgatacaggtcacgtctacgccgtagtaccgtagtaaaccgttgtttacgaccgttaggttttactacgttcttacgaccggtagttaaacttactaaagtacgtacgttacgggtcccttacggacgtttacccggnggtttccgtttacgggtccggtaagggttaaccgtctaacggttaacccggttgttaacggactaaccggtaacgaacgttccggttaggacg

SEQ ID NO: 242990 - DNA, 732 bp, Homo sapiens
  misc_feature: GYAE6OF02JAUN8.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaatagtgatgacgcagtctccaaccactctgtctgtgtctccgagggacagacgccaccctcgtcctcggacgacggacgacgtacgtacgtacgtacgtacgtacgtacgtacgtaacgttacgtaccgtacggtaccgaacgtacgtcgaaaggtaaacggttacggtacgaacggtaccgtacccgaacggtaccttaccgtacgtacgtttaccgtttacggttacggttaccgtacccgtaacggtacgggtccgtacggttacggttaccgtaccgtacgtacggtacggttacgtaggtacggtacgtacggtacggtacgtacggtacggtacgtaacgtacgtaccgtaacgtactacctaacgtactacgacgacgtacgtacgtacgtacgtacgtacgtacgtaacgttacgtttacgtacgttacgtttacgttacgtacgtaacgtaacgtaactaataacgtaacgtacgtacgtacgtaccgtacgtacgtacgtacgttacgttacgtacggtgaaccggtaacgtaacgtacgtacggtaacgtaacgtaacgtaacgtaacgtacgg

SEQ ID NO: 242991 - DNA, 612 bp, Homo sapiens
  misc_feature: GYAE6OF02GG6TP.35.85.H08.1.454.CMB.1.raw
  modified_base (139)..(139): a, c, t, g, unknown or other
  misc_feature (139)..(139): n is a, c, g, or t
  modified_base (253)..(253): a, c, t, g, unknown or other
  misc_feature (253)..(253): n is a, c, g, or t
  modified_base (283)..(283): a, c, t, g, unknown or other
  misc_feature (283)..(283): n is a, c, g, or t
  modified_base (322)..(322): a, c, t, g, unknown or other
  misc_feature (322)..(322): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
  modified_base (397)..(397): a, c, t, g, unknown or other
  misc_feature (397)..(397): n is a, c, g, or t
  modified_base (415)..(415): a, c, t, g, unknown or other
  misc_feature (415)..(415): n is a, c, g, or t
  modified_base (575)..(575): a, c, t, g, unknown or other
  misc_feature (575)..(575): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctacccgagntatcaagtggaataaatgtgatgacgccagtcctaccgaaccactcgtgttactgttcgtctaccgagggacagcgtccacctcgtctgcgaggcctagcaaggtcttggtacncgagtacctaactcggtccacggtaacganaaaggtaacggtcgcgaacggtcctcccggagtctaccnctcgttcgtttggactacgtccaggtccggcctctggtccgtacccngttacgngtcagggtcgataggcgtacncggtgactacgttgtacnccgttaactcgactactgtaacgcgaactcgtcgacgtcgtactacgtagttacgttaacgtgttaacttagttacgttcgtactagactagtaataagtacgtcgtacgtccgttcgaacggtttatcgttacgttgaccggtaggtaccgtacggtancggtagaacgtaggtaaaccgtgtacgtacgccgtag

SEQ ID NO: 242992 - DNA, 550 bp, Homo sapiens
  misc_feature: GYAE6OF02GHSKX.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtcctccgaggggacagagccaccctctcctgcgagggccagtcagagtgttagcagcaacttagcctggtaccagcagaaagttggccaggcctcccgaggctccctcaatctttggtgttgtccacgtacgggccgcgtggtcgtcccgagtcgtaggttcaggtggctaggtggtctcgtgggacagagttcactctcgaccagtcagcacgctgcagtctagaatattttcgacttagtttatacgttgtacagtactaattaataagtacgtcgtcggacctcggtacgtgtaccgttacgtttggaccgaacgggtacaacggccgtaggacgtacgtacgtaaaccgg

SEQ ID NO: 242993 - DNA, 733 bp, Homo sapiens
  misc_feature: GYAE6OF02G58AT.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccgagggacagacgccacctcgtcctgcgagggccagtcagagtgttagcaggcaacgttacgcctaggtaccagacaaggtaaagttcggacctaagggtcctacccgaagggtcctcccgtactacgttcgtttcggtacgtcggttaccgtacgtaacggggtccgtcgttggtccggttaccccagggttacctaggggtttccagggtcgggtactagggtcgggtactacggttggggaacctaggtacgtttccgaacgttccttaccgaactcgtacgtaacggtccgtaacgtccttacggaccgttaacggtacgttacggtaaagtttacgttttacggacgttttaaacgttttaccgttactttacggtacctacggtacttaaagttaccgttaagtaaccgggtcttccggggtaaccttaccgggttaagttccggtacgttaccgttttacggaaccggtacgggtaacccgtagtaccggtacggtaagaccgttaacgtaaaccgtaacggtcggtacggtactcgg

SEQ ID NO: 242994 - DNA, 826 bp, Homo sapiens
  misc_feature: GYAE6OF02H5FYZ.35.85.H08.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaaggcctgggactagggacgagggaccagagccagtccagggagaggacaggagccaaagtggacgtggggtntacgtgtaacngccctgcgtggcgaaggcggaccgagggcaccgtcctcgagggacgccatcgctgcaaggtccggcaggcgtcgcccctggaacctggaacggaccgaatcggaacaacccgaaaggaccgaacggtaccgaagggttcgggttagtcggaaccgtaccccggtaggacgggaacgccggtaccgggtccccgttacgggaccccgagggcgtacgggcccgtaccggttccgggccccttggccgttcggaccgtggtccgtacggggtcggcggtcccgtacggtccggtacggtccccgtcggtaccggtcccgtacggtcccgtcggtacccggtacccggttaaggtccggttccggacccgaacccgggtaaccgaaccggggaaccccggggtaaccccgaaccggggtacccgtaacggggtacccgtaacccggttcgaaccggggttacgaacccggaacggaaccgggttaccgaaccggttccccgaaccgggtccccggttaaacggggtcccgggaaccggtcccggggtttacgggaacgggggttccaccggggtaaccgacccccgggacggtaacccccgggaacccgttaaaccccccgg

SEQ ID NO: 242995 - DNA, 663 bp, Homo sapiens
  misc_feature: GYAE6OF02FP4Y0.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctccgtgccacgggccagtcagtagtgttagcagctaacgttgcctggtaccagacaagtaaagtcggccaggcctcccgaggcctaccctctacttcgtttgggtcgttcgtcccgtacgtacggggcccgtcgttacgggtccgtaccccgtagtccgtaggttccagggttcggctaggtcggtctcggtgggaactaggtacgtttccacgttcctccacctactacgacgcgacgtccctgaccgtaggttctaggtaacgttatttcgacgttagttttaacttacgtgtaccgtaagacgtaaacgttaagtaacgtagtccgtacggttccgtaccggttacgttacgtaccgttacgtttaccggaccggtaacggggaaccctaagggtccgttaagggaacgtaacgtaacccgtaaaggtaaccgtggtacgtcgtaccg

SEQ ID NO: 242996 - DNA, 692 bp, Homo sapiens
  misc_feature: GYAE6OF02HPNJU.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctaccaaccactctgtctgtgtctccgaggggacagcgccaccctctcctgcgacgggccacgtcaggagtggttagcagacaacttacgccgttaggtaaccagacgaaaggaaaggttcggacccgaggtcccgtacccgaacggtcctaccctacgtacttcggttttggtcgttcgtcccgtaacggtcggggcccgtcggttacgggtcggtacccctaggtccgtagggtttaccgagggtcggacggtacggttcgggtacgttcgtacggggaactaggtacgttccaccttctccaaccatacgtacgtacgctgcgtagtcgtaggtaagttactttgactttagtttacgtttactgtactacgataaacttataacgtacgtcgtacggtacccgttaccgtagttcgtacgtttacggtttcgggaaccggtaacggggaaccgtacggttacggtagggtaacgtaacggtaaaccgtaaacggtaacgttcgggtacggacgtaccgtaaccg

SEQ ID NO: 242997 - DNA, 621 bp, Homo sapiens
  misc_feature: GYAE6OF02JGUMP.35.85.H08.1.454.CMB.1.raw
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaacactctgtctgtgtctccgaggggacagacgccaccctctcctgcagggccagtcagagtgtagcagcaacttcgcctcgtaccagacaaggtaaacgttggccaggtcctacccgaggtctaccgtctagttccgtttggtcgtcgtaccgaacgtcggccgtctgggtcgtcccagtcgacggttcaggtcgcaggtcgcgttcgngggtacaggtnttccgacttctaccgactactacgacgtcgacgcgtcgacgagtccgtagtacgttagtttcgtaccttaagtttacgttacgttacgtacgtacgtactaacttaacgtaatacgtcgttacgtacccgtacgttacgttacgtacgttacgttttacggaccggtacgggtaacctacgggtcgtaggtacgtacgtaacgtaaccggtacggtacgtcgtacgtaccg

SEQ ID NO: 242998 - DNA, 632 bp, Homo sapiens
  misc_feature: GYAE6OF02GCUHE.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgtagcagctaacttacgcctaggtaccagcgaagtaaagttcggaccaggtcctacccgaggtcctccgtcattcgtttggtgtcgtccgacgtacgggccgtcgtggtcgtcccctaggttccgtagggttcaggtggactaggtcggtcgtcggtgggaacaggtcgttccacgttctaccacctactacgacgcgacgtccgtgcgtacgtcgtaggtaacttgttttacgacgtttagttttaacttcgttagtacagtacttaaattaataaacgtcggttcgtaccggtcccttacggtaacgttcgtacttaccgtttcgggaccggtaacgggacccgtaaggtccggtaggtacgtacgtaaccgaaacgttacgtcggtacgtcgtaccg

SEQ ID NO: 242999 - DNA, 737 bp, Homo sapiens
  misc_feature: GYAE6OF02IY1D5.35.85.H08.1.454.CMB.1.raw
  modified_base (184)..(184): a, c, t, g, unknown or other
  misc_feature (184)..(184): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaatagtgatgacgcagtctaccaaccactctgtctgtntctccgagggacagcgtccaccctctcctgcgaggccagtcagagtgtagcacgacaacgttcgcttacggaccagctaaggtaacgttcggaccacggacctccccggaggtccctccgtctacgtttcggtttgggtcgttccgtaccgtaacgtacggggtcctcggttacggtccgaccgtagtaccgggtaggtttcggaggttcggtacgtcgggtcggtacgttacggtacggggtactagggtaccgtttaccaccggttccctaacgacctacgtacacgtcgtaccgtccgttacgtcgtagttacgtaggtaagtttcgtttacggtactttaagttttcttaaccgtaagtaccgtaagtaccttaaattaaacgtagttaccggtaccggttccgggtaaccgttacgttaccgttaggttcccgttttaccggttacgggaaccgggtaacggaacccgtcggttaacggttaccggtaaactttaccggtaaaccggttaaacccgttaagggtcccggttacggtaaccgtacccgg

SEQ ID NO: 243000 - DNA, 785 bp, Homo sapiens
  misc_feature: GYAE6OF02G5P4E.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccaggggacagacgcccaccctctcctgccagggcccagtccagtacgtgttaagcagtacaacttagccgtacggtaccagacgaaggaaaacggtttcggacccagggcctccccgagggtccttcccgttcacgttctttcgggtcgtcggtaccctacggtacgggtcccgtacgtggttccggtccccgaggttccgtacggtttcgaagggttcgggactagggttcggtccgtacggttcggggacctaaggttacggtttccaaccttccgtaacccacccgtaactaccgtaacggacctaacggtccctacggtaccgtacgttacccgttaagggtaacggtttaagtttttacgggacgtttaaggttttaactttaaaccgtttagtacgtaacgtaacttaaaacgttaacgtttaaacgttacggtccgggttaggtaccccgttacggttacgggtttcgtaccgtttaccggttttacgggtaacccgggtacgggggtaaccctaacggggtcccgttagggaaccggttacgttaaaccggtaaacccgtacggttacggtaccggtaccgttaaccgg

SEQ ID NO: 243001 - DNA, 763 bp, Homo sapiens
  misc_feature: GYAE6OF02JED4B.35.85.H08.1.454.CMB.1.raw
  modified_base (187)..(187): a, c, t, g, unknown or other
  misc_feature (187)..(187): n is a, c, g, or t
tcagtacagatcgtcacgaccggtgctcgatttagtatcactcagtcgcgggggaggaactgctcagttaggacccagacggaaccagtggaagccccagcgcagcttctcttcctcctgctattctggctcccagatatcactggagaaatagtgatgacgcagtcctccaaccactctgtctgtntctccgaggggacagacgccctaccctctcctgccgagggtcccagtcagacgtgttagcagcaacttacgcctggtaccacgactaagaaaggttcggaccacgggtacctccccgaggtcctaccctacgtattccgttttgggtcgttcggtaccctacggtacggggccgtcgttcgggtcgttccccgaggttacctagggttaccaagggttcggaccgtaggttcgggtcgttcggtggggtaacctagggtaacgtttcccgaacgtttaccctaccgtaaccgtacgttaccgacgggtaccaaccgggtcccttacggtaccttacggttaccgtaaggttaaaccgggttttattttccggtaaccgtttaaagtttttccgtttaaaccgttgtaacccggtaagtaactaaagttaactttaaaggttacgtaccgttccggtaacccgtttccggtagtttaccggtcctttacggtttcgggaacccggtaacggggtaaccctagggtaccgttaggtaagacgttaaccgtaaacccgtggtacggttacgtctaccgg

SEQ ID NO: 243002 - DNA, 988 bp, Homo sapiens
  misc_feature: GYAE6OF02F1KNY.35.85.H08.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtcctaccaaccactctgtctgtgtctccgaggggacagacnccaccctcgtcctgcgacgggccagtcagngttagttagccagacctaacgttacgccgttacggtacccagaccgtaaggtaaacggttcggacccgaacggtccctaccccgacggtcccttcccttacgtacttttccggttttcgggtagttacccggtaccgtaaccggttaccggggtcccgtcggtttcgggtccgttaccccggtaacggttccggtaacgggtttaccgaagggttccggggtacgtaaggggttcccgggtccttacggggtacgggggtaaacctaacgggtttaccggttacccctaaccgtttaccccgtaaccctaacccgttacgttacccgaaacggttccccgacgggtacccccgttaggtacccgttaacgggtttacccggttaaagggtaaaccgtttttaccggtttttaccgggaaccggtttttttaaacggtttttaaaccgtttacccggttacggtttaacccggtaaacggtttaaactttaaaaacgggtttaactttaaacccgggtttaacggttcccgggttaacccgggtttcccccggttaaacgggttttaccggtttacccgttaccccggtttttaaccggggttttaccggggaaacccccggggtttaaacgggggtaaaccccttacgggggttaacccgggttaaacggtaacccgggttaaacccgttaaaaccgggttaaaacccggtttaaccgggtttccggggttacccggtacgttaacccccgg

SEQ ID NO: 243003 - DNA, 670 bp, Homo sapiens
  misc_feature: GYAE6OF02IAY8G.35.85.H08.1.454.CMB.1.raw
  modified_base (311)..(311): a, c, t, g, unknown or other
  misc_feature (311)..(311): n is a, c, g, or t
tcagtacagatcgtcacgaccggtgctcgatttagtatcactcagtcgcgggggagaactgctcagttaggacccagacggaaccatggaagccccagcgcagcttctcttcctcctgctattctggctcccagatatcactggagaaatagtgatgacgcagtctaccaaccactctgtctgcgtcctccgaggggacagacgccaccctctcctgcgacgggccagtcagagtgttagcagactaacttgaccgttaggtaaccagacgaagtaaacggttcggaccaggcctacccgaggcttccctntactttcgtttggcgttcgtaccagtcgggcctcgtggtctcccagtcgtaggtcgaggtgacgtaggtcggtctcggacgggatacgtagttccaccgtctaccacctagtccgacgacgtacgtccgtaggtcgtacgttacgtaggtaaagttagttttacgaccgtttaagttttacttacgttcgtaacctaacgttaactaaagttataacgttacgtaccgttacggtacccgttaggtacgtttacgtaacctttaccggtttaacggcccgggtaaacgggtaacccgtaggtacccggttaaggaacgttacgtaacggtaaaccgtacggtcggttacggctaaccgg

SEQ ID NO: 243004 - DNA, 752 bp, Homo sapiens
  misc_feature: GYAE6OF02JQ47P.35.85.H08.1.454.CMB.1.raw
  modified_base (115)..(115): a, c, t, g, unknown or other
  misc_feature (115)..(115): n is a, c, g, or t
  modified_base (227)..(227): a, c, t, g, unknown or other
  misc_feature (227)..(227): n is a, c, g, or t
  modified_base (444)..(444): a, c, t, g, unknown or other
  misc_feature (444)..(444): n is a, c, g, or t
  modified_base (455)..(455): a, c, t, g, unknown or other
  misc_feature (455)..(455): n is a, c, g, or t
  modified_base (747)..(747): a, c, t, g, unknown or other
  misc_feature (747)..(747): n is a, c, g, or t
tcagtacagatcgtcacgaccggtgctcgatttagtatcactcagtcgcgggggaggaactgctcagttaggacccagacggaaccatggaagccccagcgcagcttctcttccncctgctatctgcctccagatatcactggaagaaatagtgatgacgcagtcctaccaaaccgcttctgtccgtagttcgtcctccgaggggactagcgccctaccctctccgngccgacgggccagtccgtaggacggtttatacggacagtacctaaacgtttcgccgtacggtacccaagcctaagaaaacgggttccgcccgtaaggtcccgtacccgacggtcccttacccgtactcgttacggttttcggcgttcggtaccccctacgggttaacgggcccgtcggttcggtaccgtcccccggtaagtcgttagggttacccgngtcgtaacggngtccgggtaacgtcggtaaccgggtagaacgttcggttccgacttttaccacggtaacctacgtacggtacgaccggtcgttcccgtaaggttacgttacgtacgtaaacgttcgtttacggtaagttacgttttaaccgttacgttacgtacgtacggtacttaaagttacctaaggttactcgttacggaccttcgtagtcgttacgtccggttaccgaacgtacgggtaccgtacgtcgggatacggttaacctcgggtaacgttccgtacgggtcgtccggttaaccncccgg

SEQ ID NO: 243005 - DNA, 552 bp, Homo sapiens
  misc_feature: GYAE6OF02GZBSU.35.85.H08.1.454.CMB.1.raw
  modified_base (286)..(286): a, c, t, g, unknown or other
  misc_feature (286)..(286): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaactagcctggtaccagcagaaagttggccaggctccgaggctcctnatctttggtgtcgtccacgtaggggccgcgtcggtcgtccccagtcaggtttcaggtggcaggtggctcggtggactagagttcactctcacactcagtcagcctgcacgtcgtagaagttagttttgacttaagtttagttacttgtccgagtactaattaataatagtcttcggtccgtacgtacgttgtcttacgtttcggaccggtacgggaccgtacggacgtaggagtacgtacgaaaccgtagtacggtagtactacgg

SEQ ID NO: 243006 - DNA, 709 bp, Homo sapiens
  misc_feature: GYAE6OF02G8ZGE.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtcctccgaggggacagacgcccaccctctcctgcgagggccagtcaggagttgttagcagacaacttagcctggtaaccaggcaaggtaaagttcggaccgaggccctacccgaggtccctcccgtacactttcgttttacgggtcgttacggtaccccgtaaccggttacggggacccgtcgtttcggggtaccgttcccccgaggttccgaacggggttttcaaggggtcggtcgaggtttcgggccgttcggtgggaacgtaggtacgttacaccttcctaccgtaccactccgacgcgtacgtcgtcgcgtacgtcgttaggtaagttagttttacgacgtttagttttactttcgttcggtacgtacgacgttaaagtaagttaagtagtccgtagggtacccttaccggtagtttcgtaccgttacgttttaccgggaccggtaacggggtaacccgtaaggtccgtagggtaacttaccgtaacgtaaaccggtaccgtaggtacggtacgtaccgg

SEQ ID NO: 243007 - DNA, 584 bp, Homo sapiens
  misc_feature: GYAE6OF02GE4G9.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcgagggccagtcagagtgttagcagctaacttagcctggtaccagcaagtaaagtggccaggcctccgaggcctaccgtcattcgtttggtcgtcgtccagtcgggccgtcgtggtctccagtcaggttcagtcggcaggtgctcgtgggacagacgtcacttccacacatcacgcacgtccgtcgactagtacgtagtaagttagtttcgacttagtttattactgtacgtagactaaagttaataatacgtcgtcgtaccgtacggtattacggtaccttacggtttacggaccgggtacgggtaaccaacggttcgtagggtaacgtacgttaacggaaaaccgtacgtacgggtcgtactaaccgg

SEQ ID NO: 243008 - DNA, 597 bp, Homo sapiens
  misc_feature: GYAE6OF02G87WY.35.85.H08.1.454.CMB.1.raw
  modified_base (443)..(443): a, c, t, g, unknown or other
  misc_feature (443)..(443): n is a, c, g, or t
tcagtacagatcgtcacgaccggtgctcgatttagtatcactcagtcgcggggacggaactgctcagttagggacccagacggaaccagtggaagccccagcgcagcttctcttcctcctgctattctggctcccagatatcactggagaaatagtgatgacgcagtctccaaccactctgtctgtgtctccaggggacagacgccaccctcacctgcagggccagtcagagtgttagcagcaacttagcctggtaccagcagaaagttcggaccaggcctcccgagggtcctccgtcattccgtttagggtcgttcgtccacggtaggggcccgcgttgggtcgtccccagtccgtaggttcaggtcggcaggtcggctcggtagggacaggtagttccacgttctacaccgtatcagcacgtcctgcgagtctagaagttntttgtacttagtttattactgtactagtactaattataagtacgtcgtacgtcctaccgttatttcgtacttacgttttacgggaccgtacggggaacctaaggtcgtacggtaacacgttaaccgaaacgtacgttaggtacggtactaccgg

SEQ ID NO: 243009 - DNA, 690 bp, Homo sapiens
  misc_feature: GYAE6OF02GTRZ8.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcacgggccagtcagagtgttagcagctaacttacgcctggtaccagcgaagtaaagttggaccgaggcctcccgaggtcctaccctcgtacttcgtttggtcgtcgtccaggtacgggccgtcgtggtcgtcctagtcaggttcaggtggctaggtgtctcggtgggactagtacgttccactccgtcacctctacgacgccgagcccgtagcgtacggtacgttaacggtaaacgtttgtttacgtacgtttaacggttttactttaaccgtttcgtaccgtaagtaacttaaaacgttattaaacgtttaccggacgtttccggttaacccggtacggttacgttccgaacgtttttacccgggtttacgggaacccgggttaacggggaacccttaagggttccggtaagggtaaccgttaacggtaaccgtaaaaccggttaacggttagggtaccggtccgttaacccgg

SEQ ID NO: 243010 - DNA, 689 bp, Homo sapiens
  misc_feature: GYAE6OF02IW97V.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctctgctattctggctcccagatatcactggagaaatagtgatgacgcagtctccaaaccactctgtactgtcgtactccgaggggacagacgcccaccctctacctgcacgggccagtcagagttgttagcagcaacttagcctggtaccagcaagaaggtcgccaggcctcccgaggcctccgtactattccgtttaggtgtacgtacctacggttacggggcctacgttgggtccgttacccctaggttccgtaacgggtttcctaaggtcgggtacgaggttcgggaccttaccggtaggggactaaggtcggtttaccacttccgtacctaccgtactacgacgtaccgacgtccgtcgtaccgtaacgttgtacggtaaacgttagttttacgaccgttaagttttaacgttacgttcgttactaacggtaacttaaacgttaacgtaaattacgtacgttacggtaccgttaccgttagttacgtccgttaacgtttccgggaccgttaacggggacccgtaaggtaccgttagggtaacgtacggtactaaaccggg

SEQ ID NO: 243011 - DNA, 575 bp, Homo sapiens
  misc_feature: GYAE6OF02GTUN7.35.85.H08.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
  modified_base (347)..(347): a, c, t, g, unknown or other
  misc_feature (347)..(347): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
  modified_base (493)..(493): a, c, t, g, unknown or other
  misc_feature (493)..(493): n is a, c, g, or t
  modified_base (531)..(531): a, c, t, g, unknown or other
  misc_feature (531)..(531): n is a, c, g, or t
  modified_base (552)..(552): a, c, t, g, unknown or other
  misc_feature (552)..(552): n is a, c, g, or t
  modified_base (561)..(561): a, c, t, g, unknown or other
  misc_feature (561)..(561): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgaccgctagtctccaacctactcgtgtctgtgtctaccgagggganagacgcctacctctctgacgaggcctagcagtagttcgtaagcagactaaacgttgccttggaccagacaagtaaacgttcgggcaggtctacccgaggtccttcncggtaactttcgttggtgtaacgtccaaacgtcggggccngtggtcgtaaccgagtcctacgggttctaaggcgcgtaagtgggtcctnaaggggaactgtacgttcactctaccancacgngttacncggtctgaaacnggttccataaggttacctttggatttaattttacgcttgctacganaacggtattaagcgtctgaacgtcggtaatcacttgtncggaaccggtatagcgtaganacttacaanacgtgacggcaacg

SEQ ID NO: 243012 - DNA, 646 bp, Homo sapiens
  misc_feature: GYAE6OF02HMRAO.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccccccaacactctgtctgtcgtctccgaggggacagacgcccacccttctcccgtgcgacgggccagtcagagtgttagcagcaacttagccgtgtaccagcaagaaagttcggccaggtcctccccgaggtcctcctctattccgttttggtcgtcgttaccgaacgtaggggacctcgtggtacgtccccagttccgagggttcaggtggacgtaggtcggcttcgagggactagtacgttccacgtctccactactcagcacgtcctacgcgtacgtctaggtaagttacgtttcgtacttaagttttactttacgttgtaccgtagtactaaattaacgtaaacttagtaccgttacggtcccgttacgtacgttcgtacttaccggttttacggaccgggtaacgggtaacctaggtaccggtaggtaacgtaacgtaacgaaaccggtaaccgttacggtcggtacgtacgg

SEQ ID NO: 243013 - DNA, 796 bp, Homo sapiens
  misc_feature: GYAE6OF02GT7ST.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacaggacgcccaccctctccgtgcgacgggccagtacaggaggtgttagacacggacctaacgttacgccgtggtaccaggactaaggtaaacggttcggacccgagggtccgttaccccaaggggtccctccctacgttacgttcggttttcggtcggttaccgttcccgtaccggtaccggggtcccgtccgttggggttccgtcccccgaaggtccgtaacgggtttcgaggttgggacctagggttcgggtccgtcggttacggggaaccgtaacggggtactttacccgaccgtttccctacgtaaaccccgtagttacccgtaacggacgtaccggtacccgtacggtaccgttacggttacgtacgtaacggtttacggttttacggtaacgttttcggttttaaacgtttaccgttagttacccgtaacgtacgttaaaagtttacgttaaacgttcgtacgtttccggtaccggttaccgttgttcgtaccgttaccggttttcggaaccgggtaacgggtaccctaagggtccggtaacggagttaacggtaacccgtaaacggttacggtacggtacgtacgtacccgg

SEQ ID NO: 243014 - DNA, 550 bp, Homo sapiens
  misc_feature: GYAE6OF02JC6KT.35.85.H08.1.454.CMB.1.raw
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcatcgtttggngtgtccacgtagggcccgntgggtctcccagtcaggttcagtgcagtgctcgtgggacagtagttcactctcacatcagcagctgctagtctagaagtatttgacttagtttattactgtacgagtactaattagtaactacggtcctcggtaccctacgtagttcgtaccgttacgttttcggacccgtaagggggtaccctaaggtcgtaggtaactaacgtacgaaaaccgtagtcggtacggctaccgg

SEQ ID NO: 243015 - DNA, 616 bp, Homo sapiens
  misc_feature: GYAE6OF02GT8CJ.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcacgggccagtcagtagtgttagcagctaacttagcctggtaccagcaaggtaaagttggccgaggcctcccgaggcctccctcagttctttggtgtcgtccctacgtgggccgtcgtggttccgtacccgagttcgaggtttcaggttcggactaggtcggtctcggtggggaactaggtacgttccgtacttccgtacacctatcgagccacgtccgtgcgtagtcgtagtaagttgtttacgactttaagttttactacgttcgtacaagtactaaattagttaagtacgtcgtccggtcctaccggtagttcgtactttacggtttcggacccggtaacgggaccgtaagtccggtagagtaacgtaacgtaaacggtacgtcggtaggtcctacgg

SEQ ID NO: 243016 - DNA, 735 bp, Homo sapiens
  misc_feature: GYAE6OF02IY848.35.85.H08.1.454.CMB.1.raw
  modified_base (450)..(450): a, c, t, g, unknown or other
  misc_feature (450)..(450): n is a, c, g, or t
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
tcagtacagatcgtcacgaccggtgctcgatttagtatcactcagtcgcggggaggaactgctcagttaggacccagacggaaccatggaagccccagcgcagctttctcttcctcctgctattctggcctcccagatactcactggagaaattagtgatgacgcacgtctaccaaccactctgtactggtgtcctaccggagggtaccagacgccctacccttctccgtcgacgacgggcctacgtcgaggtacgttggttagaccaggaccttaaacgttacgaccgttacggtaaccgaaggacgaacggtaaagttacggacccgaacgtcccgtacccgaaggtcccttcgtacgtacgtttccgtttgggtaccgtccggttaccgtaccggtacgggtcccgtgtttcggtccgtaccccggtaagttacgtacggttccggnggttacgcggttacggcgtacgttggacggactagttacgtctaaccnccttaacncgactacgactacgcgcctagctacgttaacgaagttacttagtttacgtagtttacgtttaacgttcgtacttaacggtaccttaaagttaaacttaaacttacgtacggttccgtaccgttaccgtacgttacgttacttaccggttacggtttacggaccggtaacgtaacgtacggtacggaagttacgaacgtaaccggtaacgtacggtcgtcgtaccggaac

SEQ ID NO: 243017 - DNA, 638 bp, Homo sapiens
  misc_feature: GYAE6OF02FUVOP.35.85.H08.1.454.CMB.1.raw
  modified_base (255)..(255): a, c, t, g, unknown or other
  misc_feature (255)..(255): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccngcagtaaacgttggccaggcctccgaggcctctcatcgtttggtgtcgtccacgtaggggccgtcgttggtcgtccccagttccacgggttcaggtcggcgtagtcgggctcgtgggacaggtagttccactctaccacgtatccgacgctaacgtcctagccgtagttcctagtaacgttagttttgaccgtttaagttttacttaaccgttggtacctacgtaactaaattagtaaacgttacggtaccgttcgggacccttaccggttaggtttacgaccgtttacgtttcgggacccgtaacggggtaacccaaggtaccgtacgggtaacgtacgttaaccgtaaaacccggttagtacggtaccggtaccgtaccgg

SEQ ID NO: 243018 - DNA, 658 bp, Homo sapiens
  misc_feature: GYAE6OF02HOJUR.35.85.H08.1.454.CMB.1.raw
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaacttagcctggtaccagtcagaaagttgtcaggcctccgagcctcctnatctatggtncatccacgaggccacgtcggtactcccagccctaggttcaggtggacgtaggtgggtcgtgggactagtacgttcaactctacacactcgacgcgacgccgtacgactagttccgtagtacttaggtttacttttacgtaccgtttaagttttaactttacgtttacgttaccgtaacgtaccttaacgttttaagttacggttaacgttaaccggttacgggtacccgtttaccggtaggtttacgtaccgtttaaccggtttttaccgggacccggtaacgggggtaaccgtaacgggtaccggttagggaacgtaacgttaacccggtaaaacgggttacgttacgggtaaccggg

SEQ ID NO: 243019 - DNA, 857 bp, Homo sapiens
  misc_feature: GYAE6OF02FY7V4.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccatatatcactggagaaatagtgatgacgcagtctccaaccactctgtctgtgtctccgagggacagacgccaccctctccgtgccgagggcctagtcagtagtgttaggccagacaacttagccgtaggtaccagaccaagaaggttcgaccaggcctacccgaggtcctcctacattcgtttaggtcgttacggtccctaacggtacggggcccgtcgttacgggttcgtacccccgtaaggttccgtaacggggtttcaagggttcgggacctaagggtcggtcctcgggtaaggggaactaagggtacggttacctaccgtttccgtaccgtaacccgtaacgttaccgaaggtacccgtaacggtcccgtacggtaccgtaacggttaccgtaaggtaaacgtttaacggtttttacggaaccgttttaacggtttttaacgttaaccgtttacggttaccgtaaacgtaaccgttaaaagtttaacgttaaaacgttacggtaccgttaaccgggttaaccccggtttaccggttaaacggtttaccggttaaccgtttaacccggtttttaccggggaacccgggttaaaccggggggttaaaaccccgttaaaggggtaaccccggtttaagggaaaccgggtttaaccgttaaaccgggtaaaaacccgggttaaaccggtttacggggttaacccgggttacccggttaaacccgg

SEQ ID NO: 243020 - DNA, 587 bp, Homo sapiens
  misc_feature: GYAE6OF02JX064.35.85.H08.1.454.CMB.1.raw
  modified_base (291)..(291): a, c, t, g, unknown or other
  misc_feature (291)..(291): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttagcctggtaccagcagaaagttgccaggctacccgaggtcctccnctactcgtttggtgtcgtccgtaacgtacggggcccgtcgttcgggtccgtccccgagttccgtacggtttccaggtcggcagggttcggacttcggtgggacctaggtacgttcgaccttccgtacacctagtcagcacgccgtgctacgttctaggtaagttagttttcgaacgttagtttattaaccgtgtactaacgtactaagttataaacgtcgtcgtcgtacctcggtagttctcttacgttggaccggagggtacctagcgtagagacgtacgaagcgtaggctgtcg

SEQ ID NO: 243021 - DNA, 730 bp, Homo sapiens
  misc_feature: GYAE6OF02HHMBM.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctcccaacctactctgtctgtcgtctccgaggggacagacgcccaccctctcctgccgagggccagtcagtagtgttagcagactaacttacgccgtggtaaccaggacaaggtaaacgttcggacccgtaagggaccctcccgaagggtccctcccgttactacgtttcgttttcgggtcgttaccgttacccgacggttacgggggccccgtcgttcggggttccgtaccccgtaggtcgtacggggtttacagggtcgggacgtagggtcggtcctacggtaggggacctaagggttccgttacgaccttccgtacctaccgtaacgtccgacgtcgaaccgtcccggttacgtaccgtacggttacgtaaggttaacgttacgttttgtacgttaaggttttaaccttacgtaggttaccgagtaacttaagttaaattagtacgtcgtacgtacccgttacgtagttcgtacgttaccggtttacggaccggtacgggtaaccgtaggtcgtacggtagtaaccgttacgaaacccggttagtcccggtaggtacctcgg

SEQ ID NO: 243022 - DNA, 680 bp, Homo sapiens
  misc_feature: GYAE6OF02IQFQQ.35.85.H08.1.454.CMB.1.raw
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
tcagtacagatcgtcacgaccggtgctcgatttagtatcactcagtcgcgggggagagctctgggggaggaactgctcagttaggacccagacggaaccatggaagccccagcgcagcttctcttcctcctgctattctggctcccagatatcactggagaaatagtgatgacgctagtcctcccaaccactctgtctggtcgtctccgaggggacagacgcccaccctctcctgccgagggccagtcaggtagttgttagtagactaacttacgccgtcggtaaccagcgaaggtaaaggttcggacctacgggcctcccgacggcctcctctacttcgtttggtcgttcgtccacgtacgggccgtcgtcggttcgtccctagtcgtacggttcaggtcggcgaggtggtcctggtacgggactagggtcgttccacttcctacacctatcgancgactccngtctagttcgtagtacgttagtttcgtaacttcgttttaactacgttacgttacgtaacgtaactaaatttagttaaacgttagtccgttaccggtacccgttacggttaacggtttaccggtacgtttaccggttttaaccgggcccggtaaccggggtaacctaacgggtcggtaacggttaaccggtaactaaccggtaaacggttaaccggg

SEQ ID NO: 243023 - DNA, 719 bp, Homo sapiens
  misc_feature: GYAE6OF02JXQTH.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatccactggagaaatagtgatgacgcagtctccaaccactctgtctgtgtctccgaggggacagacgccaccctctcctacgcgacgggccagtcagagttgttacgcagactaactacgcctggtaccagcctagaaacggttcgccaggtcctacccgaggcctaccgtacacttccgtttggtcgtgtccgacgttacgggccgcgtcggtcgtccccgtaagtccgtaggttctaggtcggtctaggtcggtacgttcggtagggaccgtaggttaacgttccgtaacgttccgtacccgtaacccgtagtacctaccgtaccgtaacggtacccgttcggtacgtacggttcgttacggtaaacgttacgttttaggtccgttaacggttttacttaaccgttagtacccgtagtaaccgttaaatttaccgtaagtttaacgggccttacggttacccgtaccggttagttaccgtaccgttacgggtttacggtaccggtaacgggttaccaacggttaccgtagggtactaacggttaacccaaacggttaccgtggttacggcccttaaccgg

SEQ ID NO: 243024 - DNA, 583 bp, Homo sapiens
  misc_feature: GYAE6OF02GAM84.35.85.H08.1.454.CMB.1.raw
  modified_base (365)..(365): a, c, t, g, unknown or other
  misc_feature (365)..(365): n is a, c, g, or t
  modified_base (388)..(388): a, c, t, g, unknown or other
  misc_feature (388)..(388): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcgagggccagtcagagtgttagcagcaacttagcctggtaccagcaagaaagttggccaggctcccgaggcctcctcacttctttggtcgtcgtccacgtaggggcccgtcgtgggtcgtccccagtctaggttcagtggcaggtgctcgngggacagtagttcactctacacntacagcagcctagcgagtctagaagtattttgacttaagttttatacgttgtacctagaactaagttataaagttagcgttcggccctaccgttaggtttcgaccgtttacgtttcggacccggtaaggggtacccaaaggtccgtagggtaactaacgtaccgtaaaaccgtacggtcggttacggcttaacgg

SEQ ID NO: 243025 - DNA, 794 bp, Homo sapiens
  misc_feature: GYAE6OF02GDCJ2.35.85.H08.1.454.CMB.1.raw
  modified_base (231)..(231): a, c, t, g, unknown or other
  misc_feature (231)..(231): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtctctccgaggggacagacgcccacctctcctgccgagggccagtcagngtgttagcagccaaacttgccgttacggtaccaggacaaggtaaggttcggaccgaggtcctacccgaggtcctcctacgtacttcggtttgggtacgtccgtacctacggtacggggcccgtcgttcgggtcctcccgtagtcgtacggttccgaggtcggcgtaggtcggccgttacggtcgggaactaggtacgttctaccgtcccgtacctaccgtctacgacgtacctagtcccgtacggtacctaggttccgtaaggtaaacgtttcgtttacgtacgttttaacggttttaactttaccgtacgtttactaacggttacgttaaaacgtttaccgttaaagtttccggtaaccggtttccggttaccccgttaccggtttaagttacccgggtttacccgttttaacggggtttttcccgggaacccggggtttaaacgggggtaaacccgttaaccgggtttaccgggtaacccgggttaaaggttaacccggttaaaccggttaaaaccgggggtaacccgttttcgggtacccgggttccgttaaaccccggg

SEQ ID NO: 243026 - DNA, 660 bp, Homo sapiens
  misc_feature: GYAE6OF02FYOWF.35.85.H08.1.454.CMB.1.raw
  modified_base (147)..(147): a, c, t, g, unknown or other
  misc_feature (147)..(147): n is a, c, g, or t
  modified_base (185)..(185): a, c, t, g, unknown or other
  misc_feature (185)..(185): n is a, c, g, or t
  modified_base (215)..(215): a, c, t, g, unknown or other
  misc_feature (215)..(215): n is a, c, g, or t
  modified_base (285)..(285): a, c, t, g, unknown or other
  misc_feature (285)..(285): n is a, c, g, or t
  modified_base (311)..(311): a, c, t, g, unknown or other
  misc_feature (311)..(311): n is a, c, g, or t
  modified_base (377)..(377): a, c, t, g, unknown or other
  misc_feature (377)..(377): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactgganaaatagtgatgacgcagtctccaaccactctgtctgtntctccgagggacagagccaccctctccgtncgacgggccagtcagtagtgtagcagactaactgccgtgtaccagcaagtaaagttcggaccgaggtccncccgaggcctcctacattcgtttggngtcgtccaacggtacgggcctgttggtccgtccagtcgtacggttcgagtcgtgtgtcgtctaggnggtacaagtcgttccgactcctacacgtactcgacgacgacgtcgtacgtcgtacgtcgttaggtagttacgttttacgtactttaaggttttacttacgttagtccgttaagtaactattaacgttaagttacgaccggttaccggttaccgtcgttacgttaccgttaccgtttaccggtttggacccgggttaacgggtaaccgtaccgggtacggttagggtaaccgttaaccgaaccggttaaacggtaccgttacgggttaccggtacgttacccgg

SEQ ID NO: 243027 - DNA, 183 bp, Homo sapiens
  misc_feature: GYAE6OF02HKOO3.35.85.H08.1.454.CMB.1.raw
  modified_base (175)..(175): a, c, t, g, unknown or other
  misc_feature (175)..(175): n is a, c, g, or t
  modified_base (178)..(183): a, c, t, g, unknown or other
  misc_feature (178)..(183): n is a, c, g, or t
tcagtacagatcgtcacgaccggtgctcgatttagtatcactcagtcgcgggggagaactgctcagttaggacccagacggaaccatggaagccccagcgcagcttctcttcctcctgctattctggctcccagatatcactggagaaatagtgatgacgcagtctcaaccatcngtnnnnnn

SEQ ID NO: 243028 - DNA, 905 bp, Homo sapiens
  misc_feature: GYAE6OF02G5JI1.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctaccaaccactctgtctgtgtcctccgaggggacagacgcccaccctctcctgcgacgggccagtcagtagttggttacgacagacctaacttagccgtacggtaccgacgcgaacgtaaaggttcggaccgacggcccgtaccccgagggcccttcccgtactacgttcggttttcggtaggtcgttacccgtacggtaaccgggtcccgtcgttcgggttaccgttcccggtaacgttccggtaaggggtttccgtaaggggtccgggtacgtagggttcggtacccggttacgggttacggggaaaccgtagggtttaaccgttacccgtaccgtttaacccgtaacctaaccccgtaacttaccggaacctaaccggtacccggtacccgggttaaccgttcggttaaacccggttacggttaaacgggttaaacgttttaacgggtttttacggttacccgtttttaaacggtttttaaccgtttaaccggggtttacttaaacgtaaaccgggtaaacctttaaaaggttaaacgtttaaaacgtttccgggtaacccggtttacgggtttaccccccgttaggggtttaaccgttacccgggacttttttaccgggttccggggtaaacccgggtcgggggtaaaccctaacggggttacggtaacggggtaaccttaacggtaacccggtaaacccggttaacggtacgggttacggttaccgtacccggg

SEQ ID NO: 243029 - DNA, 754 bp, Homo sapiens
  misc_feature: GYAE6OF02FKKWG.35.85.H08.1.454.CMB.1.raw
  modified_base (197)..(197): a, c, t, g, unknown or other
  misc_feature (197)..(197): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgagggganaggacgccaccctctcctgcagggccagtcagagtgttagcagctaacttagccgtaggaccaggcaaggtaaaggttcggacccgtagggcctccccaaggcccttcccgtactatttcgttttgggtgttcgtacccgacggttacggggcccgtcgttcgggttccgtacccctaggttccgtagggtttccaagggttcggggccgtagggtttcggggttccgtacggggtaggaacgtacggttacgttcctacctcctactaccgtactacgagtccgacgtccgtactccggtacttacggttaaggtacgttttgttacgtacgttttttaaacggtttaccttagttccgtaagttacctaaaatttaacgttttaaagacgttaacggttacccggttcccggttaaaccggttacgttaggttttacccggtacgtttttacccggggtccgaacccgggggttaaccggtaaaccgtaagggttaccggaacgtttaacaaacccggtacgttaaggtacgggtaccgtacgttacccggaacc

SEQ ID NO: 243030 - DNA, 717 bp, Homo sapiens
  misc_feature: GYAE6OF02HBFWP.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggagaaatagtgatgacgcagtctccaaccactctgtctgtgtctccgaggggacagacgcccaccctctcctgcgagggccagtcagtagtgttagcagctaacttagccgtggtaccagcaagaagttgccagctccgaggcctcctcattcgtttggtcgttcgtcccgtacggtacggggcccgtcgttcgggttccgttccccgaggttaccgtagggttcgaggtcggggacgtacggtcgggtccttcggtcggggtaactacggtacgtttccaccgttcctaccgtaaccctacttccgaacgaccacggtccctacggtacgttaacggttaccgtaaggtaacgttacgttttcggtaccgtttaagttttaacgttactttcggtaccgtaacgtacgttaagtttagtttacgtacggttcccgttaccgggttaacccgttaccggtttacggtttaccgggaacccgggtaccggggtaacccggtaagtcgggtaacgtacgttaacgaaccggtaacgtacggttcgggtacggtcgtacgtacccgtaccgttacg

SEQ ID NO: 243031 - DNA, 725 bp, Homo sapiens
  misc_feature: GYAE6OF02FIKH5.35.85.H08.1.454.CMB.1.raw
  modified_base (146)..(146): a, c, t, g, unknown or other
  misc_feature (146)..(146): n is a, c, g, or t
tcagtacagatcgtcacgaccggtgctcgatttagtatcactcagtcgcggggagaactgctcagttaggacccagacggaaccatggaagccccagcgcagcttctcttcctcctgctattctggcctcccagatatcactgganaaatagtgatgacgcagtcctccaaccactctgtctgtgtcctccgaggggcagacgcccaccctctccgtgcgacgggcccaggtcagagttgttagcacgctaacttgcctggtaccagcaaggtaagttcggaccaggcctcccgagtccctcctcgtattcgtttaggtctcgtcctacgtacgggcctcgttcggtccgtacccgtagtcgtaggttccgaggttcggacgtaggtcgggaccttacgggtacgggaactaacggttaccgttccaacccgttccgtaccaaccgtaacttaccgacgtccgacgtccgtcgacgtacgtacgtaggtaacgttagtttacgtacgtttacgttttaactacgttacgtaaccgtacgttaacctaaatttaacgttaaacgttaacgtaccgttaccgggtacccttaccggttacggtttaccgtaccgtttaccggtttaccgggaccggtaaccggggtaaccgtaacggtaccggttaacggacgttaaccgtaaccgtaaacccggttaacggttaccggtacggtaccgttaaccgg

SEQ ID NO: 243032 - DNA, 728 bp, Homo sapiens
  misc_feature: GYAE6OF02FTRGX.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcacgggccagtcaggtagtgttagcgtagacctaacgtttagccgtaggtaccaagctaaggtaaaaggttcggaccgagggtcctaccccgaagggtccttccctctaacgttccgttttgggtcgttccggtaccgaaccggttacggggccccggtccggttacgggttccgtccccggtaggtcctaacggggttttccgagggtcgggtaccgtaggggttacggggttcggtaggggaaccgtacgttaccgtttccgaaccgtcctaacccaccgtactacgacgccgtaaccgtccgtacggacctagtcgtaaggtaagttcgttttacggacttacgttttacgttacgttaggtctagtaactaattaagttaaagtcgttacgtcggtaccgttccgttacgttaccgtcgttaccgtttcggtacccgggacgggtaacgtacggtacgtggacgttactacggaaacgttacgtacggttacggtccgtacgtacccg

SEQ ID NO: 243033 - DNA, 756 bp, Homo sapiens
  misc_feature: GYAE6OF02ILO5M.35.85.H08.1.454.CMB.1.raw
  modified_base (148)..(148): a, c, t, g, unknown or other
  misc_feature (148)..(148): n is a, c, g, or t
  modified_base (251)..(251): a, c, t, g, unknown or other
  misc_feature (251)..(251): n is a, c, g, or t
  modified_base (428)..(428): a, c, t, g, unknown or other
  misc_feature (428)..(428): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcacgtggaanaaatagtgatggacgcagtctaccaaccactctgtctgtgtcctccgaggggacaggacgacccaccctctcctgcgacgggccagtcgagaggttgtaacgnagactaacttacgccgtaggacccaggactaaaggtaacgttcggaccaggccgtaccccacgggtcctacccgtactacgttttccgtttagggtcgttcgtacccgtacggtacggggtccctcggtgggttaccgtacccgaggtttcgtacggttcgtaagggtccggtacgnggttccggtacgttaccgggtgggtaacgaacgttacgttacctaccgttacctaccgacctacgtcgaacgcgtacgtccgtaggctacgtactaaggtaagttaggtttacgttacgtttaagtttaacgttttcgtacgttacgtaacgtactaaattattaagtacggtaccgttccgtttaacccgtacggttaacgtttccgttacgttaccggttttaaccgggaccggtaaccgggttaacccggaggttaccggtacggtaaaccgtaacgttaaacccggtaaacggttaaccggttacggttaggtaccgtaacccg

SEQ ID NO: 243034 - DNA, 784 bp, Homo sapiens
  misc_feature: GYAE6OF02JB1KL.35.85.H08.1.454.CMB.1.raw
tcagtacagatcgtcacgaccggtgctcgatttagtatcactcagtcgcgggggaggaactgctcagttaggacccagacggaaccatggaacgcccagcgcagcttctcttcctcctgctattctggcctccagatatcactggagaaatagtgatgaccgcacgtctacccaacctactccgtcgttcgtgttcgtcgtaccgaggggacagacgcccaccctctccgtgcgacggccacgtcgacgtagtgtacgcacgtactaacgttacgccgtacgtaccacgacgaaggtaaaggttcggacccgaacgggtccctacccggacggtcccttacccgttactcgttttcggtttcgggttcgttcggtacccgtaccggttaccggggtcccggtcggttccgggttccggtacccctacggttaccgttacggtttcgtaagggtggacgtacgggtcggtccgtacggtcgggaacgtacgttaacggttaccctacttacctacccgtaccctacgtaccgacggtaccacggtccgtacgacgtacgttacgtaagtagtttgtttacgtagttttaacggtttcttaacgtcgtacgtacgttaacgttaacgttataaacgttcgtacgttccgggtaccttacgggttagttaccgttaccgtttacggttaccgggtaaccggtaacccgggtaacggtaccggtaggttacggtaaccgttaaccggttaacggtaaaccggttacggtcggttacggtaccgtccgg

SEQ ID NO: 243035 - DNA, 712 bp, Homo sapiens
  misc_feature: GYAE6OF02JKM9G.35.85.H08.1.454.CMB.1.raw
tcagtacagatcgtcacgaccggtgctcgatttagtatcactcagtcgcgggggaggaactgctcagttaggacccagacggaaccatggaagccccagcgcagctctcttcctcctgctattctggctcccagatatcactggagaaatagtgatgacgcagtctccaaccactctgtctgtcgtctccgaaggggacagagccctaccctctcctggccacgggccagtccagtagttgttagcagtctaaacttgccgtacggtaccaggcaaaggtaacgttggccgtaggaccctccgaacgggccttacccgactacttcggtttcggtagtcgttccgacggttacgggccggcttcgggttacgtccccaaggtcctagggttcacgggtcggtacgtagggttacggtccgtcggttaggggacctaggtacgttccgactttccggtacaccgtactacgtacgacgtaccgcgtacgtcgtacgttaccggagtaagttacgtttcgtacgtttagtttaagttacgttactcgtaagtactaaagtttaactaaagttagtacgttaccggtccgttaacggttccgttagttccgttacggttttacgggaccggtaacggggtaaccgaacggttcggttaacgggaacggtaacgttaaccggtaaccggtaacgtacgggttacggtacgtaccgg

SEQ ID NO: 243036 - DNA, 848 bp, Homo sapiens
  misc_feature: GYAE6OF02IUHGW.35.85.H08.1.454.CMB.1.raw
  modified_base (223)..(223): a, c, t, g, unknown or other
  misc_feature (223)..(223): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctgtgtctccaggggacagacgccacctctcctgcacggcagtnagagtgtagcagctaacttgcctggtacagcaagaaacgttcggcaggcctcccgagggtacctcccgtacgtacttcgtttagggtcgttcggttaccgtaccggttacggggcccggtcctttgggggttaccttccccgaacgggttccgtaacggggtttacctgggttacggggaccgtaacgggttcgggtaccgttcgggtacgggaccgtacggtacgttttccgaacctttcccgtactaaccccgtaagtcccgtaacggccgtaacgtcccgttacggacgtaccggttacgttacggtaaagttacgtttttacggaccgttttaagttttttaaccgttttaccgtaaccggttaacggtaacggtaaacttaacggtttaaaatttaaaccggtaacggttaccccgtaacgggttttacccccgtacccgggttaaaggtttccggttacccgttttaacccggggttttttaccgggaaccccgggtaaaccgggggggttaacccaaaaggggtttccccgggtaaagggtacccgttttaaaacgggtaaccgtaaaaaacccgggtttaaccggttacggggttccggtacccggtttaaacccgg

SEQ ID NO: 243037 - DNA, 590 bp, Homo sapiens
  misc_feature: GYAE6OF02FKXJG.35.85.H08.1.454.CMB.1.raw
  modified_base (406)..(406): a, c, t, g, unknown or other
  misc_feature (406)..(406): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagagtgttagcagcaacttagcctggtaccagcaagtaaagttggccaggcctcccgaggcctcctcattcgttttggtcgtcgtccacgtacggggcccgtcgttcggtcgtccccaggttccgaggttcaggtggctaggtggcgtcgtgggacagtacgttccgactctcaccactnacgcacgccgtgctagtctaggaagttagtttgacttagtttattacttgtactagactaattaataagttagtacgttcggccttacgtagttcgtaccgttacgtttcggaccggtaacggggaaccgtaacggacgttaggacgtactaccggaaacggtaacgtcggtacggtcgtacgg

SEQ ID NO: 243038 - DNA, 684 bp, Homo sapiens
  misc_feature: GYAE6OF02G1FF1.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctaccaaccactctgtctgtgtctccgaggggacagacgcccaccctctcctgcgacgggccagtcagagtgttagcagcaacttagcctggtaccagcagaagttggaccaggcctccgaggtctccctctacttcgtttggtgtcgtccgtacgtagggcccgtcgttggtccgtcctacggtacgtacgggtttacgaggtcggcctagggttcggtaccgttcgtacggggaccaggttacggtttacacccgttctaccgaaccctagttccgacgtccgaacgtccctcgacgtacgttccgttagtaagttagttttacggactttaaggttttacttaacgttcggtacgtaacgtacttaaacgttagttaaactacggtaccgtaccggtacccgttaccggtagtttcgggtaccttttaccgggtttacggacccgggtaacggggtaaccctagggtccgtttagggaacgttaccgtaaccggttaaacccggg

SEQ ID NO: 243039 - DNA, 806 bp, Homo sapiens
  misc_feature: GYAE6OF02ITHKA.35.85.H08.1.454.CMB.1.raw
tcagtacagatcgtcacgaccggtgctcgatttagtatcactcagtcgcgggggaggactgctcagttaggacccagacggaaccagtggaagccccagcgcagcttctcttcctcctgctattctggctccagatatcactggagaaatagtgatgacgcagtctccaaccactctgtctgtcgtctccgaggggacagcgccaccctcgtcctgccgagggccctagtcgagtagttcgttagcagacctaacgttacggccttaggtacccagaccgaaggtaaacgttcgggaccctaacgggcccttaccccgacggtccttccctacctaacgttttccgttttgggtcggttaccgttacccgacggttaccggggtcccgtcggttcgggtaccgttacccgagttccggtacggttacgtacgggttggaccgtaggtcggtctcggtagggactagtccgttacacctcgtacaccacgtcgaagcgacgtccgtcgacgtacgttcgtagtacgttacgttaacgtttttcgaacgttttacgtttaacgttacgttacggtcgtttaagtaccgtttaatttaacggtacgttaacgtttaaccggtccgggtttcccggttacgggttaccgggtttacccgggttaccgggttaaccgggtaaccggggtaaacccggttaacggggttaccgggttaaacccggttaacccgggtaaaaccggtttaccgggtttaaccggttaccccggggttacgtaacccgggttaccccgttaacccggtttacccg

SEQ ID NO: 243040 - DNA, 662 bp, Homo sapiens
  misc_feature: GYAE6OF02FMNJO.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcagggccagtcagagtgttagcagcaacttagcctggtaccagcaaggtaaagttggccaggcctcccgaggccttcctctattcgttttgggtgtcgtccaacgtacggggcccgtcgttcgggtcgttaccccaggttcctaacgggttcaggttcgggctagggtcggccttcggtggggaacaggtacgtttccgaccgttcctaccgaacctacgtacgacggcctaacggtccctaggcctaacggttccgttaaggtaacgtttacgttttcgaccgttttaagttttaacttacgttggtacaacgtataaattagttaaagtcggtcgttacggtcccgttacggtagttccgtccgtttacgtttcgggacccggtaagggtaacccaggtcgtaagggagtacgtaacgtaaacgtacgtcggtcggtcgtaccg

SEQ ID NO: 243041 - DNA, 789 bp, Homo sapiens
  misc_feature: GYAE6OF02GPX6R.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagctccaaccactctgtctgtgtctccaggggacagagccaccctctcctgcgagggccagtcagagtgttagcagctaacttagtcctcggtaaccagtcaagtaaagttcggaccctagggctaccccgaggcctacccgtctaacttcgttttcgggtgttcggtcctacgtacggggtccgacgttggtacgtccccaggttccaggtttccaaggtggacgtagtcgggtacctcgtaggggaacctaggtacgtttacccgaccttcgacctaccgagttacgacgccgtacgtccgttacggacgtaccgtagtaacggttaaacgtttcgtttaggtaccgttttaagtttttaaccgttaacgtttacgttaaccgtaacgggttaaaccttaaagtttaaacgttaaacggtttaacgggtccgtttaaacccgggttcccggttttaacccgggttaacggtttccgttaaccttttacccgggttttaacgggaccccgggttaaacgggggaaccccggtttaagggaacccgggtttacgggaaacgttaaaccggttaaaccggttaaaaccgggttaacgtttccggggttaacgggtaccgttaacccgg

SEQ ID NO: 243042 - DNA, 744 bp, Homo sapiens
  misc_feature: GYAE6OF02FGGKQ.35.85.H08.1.454.CMB.1.raw
tcagtacagatcgtcacgaccggtgctcgatttagtatcactcagtcgcgggggaggaactgctcagttaggacccagacggaaccatggaacgccccagcgcagcttctcttcctcctgctattctggcctccagatatcacgaggagaaatgtgatgacgcagtcctccaaccactctgtctgtgtctccgagggacagacgccaccctctcctgcgacgggcccaggtcagtagtagttacgaccagtacctaaacgtttacgccgtacggtaccacggacaaggtaaacggttcggacccgacggtcccgtccccgacgtccttacctcgtacttcgttttggtcgttccggtaccgtacggtacgggcccgtcgttacgggtccgtcccgagttcgtacggttcgaggttcggacgtaggttcggcgttacggtcgggaactagttacgttccacgttcctaccaacctatacgacggtcaacgtcccgtcgaccgtacgttaccgtagtaagttacgttttacgacgttttaagtttacttacgttacgtaacgtaacgtaacttaaagttaacgtaacgttacggtaccgttaccgggtacccttacgggtttacgttaccgttaccgttttaccggtttaccggggaaccgggtaaccgggacccgtaaaggtccggtaagggtaaccgtacgtaaaccggaaaccggttacgtacgggttacggtaccgttacgg

SEQ ID NO: 243043 - DNA, 677 bp, Homo sapiens
  misc_feature: GYAE6OF02HEFGY.35.85.H08.1.454.CMB.1.raw
  modified_base (249)..(249): a, c, t, g, unknown or other
  misc_feature (249)..(249): n is a, c, g, or t
  modified_base (432)..(432): a, c, t, g, unknown or other
  misc_feature (432)..(432): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaagtggacgtggggtgtactgtaacagccctgctggcgagagggaccagggccaccgtcctccgaggggacncccagtcgctgcgaacggtcgggaccaggacggtcgccccctaggaaaccctggaaacggcccaaagtcgacgaaccccaaagaccgagggacccaaaggtgggttagtggacgaccccgtgagggagcgtcgggccctgggtcccaggcaggcgcgtccggccctgctgctggcgtgggtcncggcctagtcggtccgcccagtccggcctgcgtcgccgaccctaagtcggttaccgcgacccgtacggaaacggtcccgggaacccgtacggaaccccgttagggacctcccgttaacggtacggttacgggaacgtacgaccggtaccgacttacccgacggtccggtcggccggaacggtccggtgggtacggggaccgtacggggacccaacgggacccccgtaagggtcccccaaaccccg

SEQ ID NO: 243044 - DNA, 687 bp, Homo sapiens
  misc_feature: GYAE6OF02F86ME.35.85.H08.1.454.CMB.1.raw
  modified_base (331)..(331): a, c, t, g, unknown or other
  misc_feature (331)..(331): n is a, c, g, or t
  modified_base (587)..(587): a, c, t, g, unknown or other
  misc_feature (587)..(587): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcagggccagtcagacgtgttagcagacaacttagcctggtaccagcacgtaaagttcgaccaggctcccaggcctccgtcagttcctttgggtcgtgtacctacgtaacgggccgngtcggtacgtccccgagttccaggggtttcaggttcggctaggcggtctcgtcggggacaggttacgttaccgaccttccgtacgaccctacgttacgacgtcgaacgtcccgttacgtaccgtacgttaccgtaggttaaaccgttaaggtttttacggacgtttaaacggttttaaccttttacgttacgtacctaggtaaccgtaagttaacgtttaaagtaccggtacgttaccgtacccgttacccggttnttacggttcctacgttttacgggacccggtaagggaacccgtaacggttccgttaagtcggtaacttaccggaaaccgtaaccgttgtaccggactacgg

SEQ ID NO: 243045 - DNA, 814 bp, Homo sapiens
  misc_feature: GYAE6OF02FY1RY.35.85.H08.1.454.CMB.1.raw
  modified_base (147)..(147): a, c, t, g, unknown or other
  misc_feature (147)..(147): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactgganaaatagtgatgacgcagtctccaaccactctgtctgtgtctcgacggggacacggacgccctacctccgtaccgtcgcgaacgggcctaagtccgagtaggttcgttagactacgtactaactttcggaccttacgggtaaccaggacaaggtaaacggttcgggaccctaacggtcctaccccgagggtcccttcccttacgtactttaccggtttggtcggtcggtaccgtaacgtccggggtccgtcgttacgggttccgtacccggtagtaccgtcggtttacgacggtgggtcctaagggtcggtccgtacggttagggaaccgaggtttacccggttagttaacccgtacctaccgaccgtaaccgtaacggccggaacccgtacgttcccggtacgtacccgttaaacgttcggttaacggtaacggtttgtttaacgaccgttttaaagttttccgtttaacgacgggttccgtaagttaacgttaaccgtaagttaaacggttaccgccggtttacgacccgtttaaacggtcggtttaccgtactttttaccggggttagaccccgggttaagggtaacctaacgggtccggttaacgggtaacgttaccgggaacgtttaaacccggtaagttccgggtaaacgtttcggtaccgg

SEQ ID NO: 243046 - DNA, 874 bp, Homo sapiens
  misc_feature: GYAE6OF02IJ1HP.35.85.H08.1.454.CMB.1.raw
  modified_base (172)..(172): a, c, t, g, unknown or other
  misc_feature (172)..(172): n is a, c, g, or t
  modified_base (199)..(199): a, c, t, g, unknown or other
  misc_feature (199)..(199): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctccaaccntctgtctgtgtctccgagggacagacnccacctctctagcaggccagtcagtgtgttagcagacaactttgccgtacggtaccagtaccgtaaggaaacgttcggacctaggcctaccccgaggtcccttacctctacgtttccgttttgggtcgttccgtaccgaaggttaccggggccgtacgtttacgggttaccgttaccccgaaggtttaccggtacggtttaccgtagggtacgggtaccgtaacggttcgggacctttacggggtaacggggaactaaggggtttaccgttaaccctaccgttaccttacccgaaaccttaacgtaccgaaacggtacctacggtacccgtacggtaaccgtaacggttaccgttaaggttaaacggtttacgttttttacggtaaccgttttaaacgtttttaaccgttttaacgttacgggttaacctaagggttaaacctaaacgtttaacgtttaaacggtaaccgttaccggttaaccgggttacccggttaaacccggttcggtttaccgttacggttttaacccggtttttccggggtaacccgggttaaacgggggttaaaccccgtaagggttaccggttaaccgggtaaacggtttaaccggttaaaaccccgggttaaagggttaacccggtttacggggtttaacccggtgggttaaccccgg

SEQ ID NO: 243047 - DNA, 777 bp, Homo sapiens
  misc_feature: GYAE6OF02H882Q.35.85.H08.1.454.CMB.1.raw
  modified_base (236)..(236): a, c, t, g, unknown or other
  misc_feature (236)..(236): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctaccaaccactctgtctgtcgtctccgaggggacagagcccacccttctcctggccagggcccagtcagngtagttacgcagctaacttcgcctacggtaccagcaagaagttcgaccgagggcctcccgaaggtcctaccttacctatttcgtttgggtgtcgtcccgtaacggtcggggtaccctcgtgggtcctccccgtaaggtccgtaaggtttccaacgggttcggcgtacggtggtaccgtcggtacggggactaaggacggttcctacgtcctactaaccgtatccgtaacgccgtaacggtccctacggaccttaggtaccttaggtaaagttttacgttttacggtaacccttttaagtttttaccggtttacttaccggtaacgttaccggttaaactaaagttaactaaccggttacgtacggttacccgggttacccgtaccgggtttaaacgtttcgggttaccgtttaccggtttttacccggggtaacccggtaacgggggtaaacccctaaggggttaacccgtaaggttaaccggtaacgttaaacccggtaaacccggtttaggtacccgggttaacggtacccgtaaccgg

SEQ ID NO: 243048 - DNA, 728 bp, Homo sapiens
  misc_feature: GYAE6OF02GM8PX.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgccgagggccagtcgagagttcgttagcagtctaacttagcctggtaccagctaaggtaaaggttcgaccgaggtcctacccgaggcctccgtactacgttcgtttggtcgttcggaccgtacgtacgggcccgtcgttacgggtccgtaccccgagttccgtaacggtttccgagggttcgggcgtacggtcgggccttcggtacgggaactagggtacttcccgacttccactaccgtactccgaacgcaacgtcccttaggccgtaacgttacgtaggttaaacgtttacgtttttacgccgtttaaagtttttaacttaccgttagttaccgtaacgtaataaacgttaagttaaacgttccggtaacgttacccggtaccgttacggttacggttcgttaccgtttacccgtttcgggaacccggaacggggtaaccctaacggtccggttaaggaaacgtacgtaacccgtaaaacggttaccgttacggtacggtcccgtaaccgg

SEQ ID NO: 243049 - DNA, 731 bp, Homo sapiens
  misc_feature: GYAE6OF02FRE05.35.85.H08.1.454.CMB.1.raw
  modified_base (134)..(134): a, c, t, g, unknown or other
  misc_feature (134)..(134): n is a, c, g, or t
  modified_base (207)..(207): a, c, t, g, unknown or other
  misc_feature (207)..(207): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagntatcactggagaaatagtgatgacgcagtctccaaccactctgtctgtgtctccgagggacagagccaccctncctgcgacgggccagtcagagtgttagcagcctaaacgttagtccgtcggtaaccagacaaggtaaacggttgggacccgacggacctccccgagggtcctcccgtcacttcgtttggtgtcgtccgacgtacggggccgcgttggtcgtcccgtaggtccgtaggttcgtaggtcggcgtagtcggtcgtcgtagggactaggtacgttcgacttccgtacctaacccgtactacgacgtaccggacctcccgtcgaccgttaacggttccgttaacggtaaaggtttacgtttttacggtactttaacggtttttacttacgtttacggtacacgtaaaccgttaaaattaacgtaaacgttacgtccgttaccgtcccggttacccggttaagtttaccggtacgtttaccggttttcgggaccgggtaacggggtaacccggtaacggttaccggttaggaaccggtaacgttaaccggaaaaaccggttaccgggtaggttacgggtaccgtaaccggg

SEQ ID NO: 243050 - DNA, 729 bp, Homo sapiens
  misc_feature: GYAE6OF02GMPRY.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagccaccctctcctgcgagggccagtcagagtgtagcagacaacttagcctggtaccagcaagaacgttggaccaggtcctcccgaggtccttcccgtactagttccgttttaggggtcgttcggttaccccgtaacggttacgggggccccggtacgttggggttccggtacccccgtaagggttccgtaacggggtttaccgtaagggttcgggctaacggggttcggtaccgttcggtaggggtaacctaggtaccgtttacgaacccttccgttaccaacccgtatacccgaggaccgtacggccctacggccttaacggtacgttaggtaaccgtttagttttacggaccgtttaagttttaacgttaccttcggtaccgtaagtaaccttaaattaaacgtaaacgtacgtccgttccggtacccgttccggtaaggttcctacccgttacggtttccggaccggtaccggggaaccgtaggtcgtagggaacgtacgtacccggtaaacgg

SEQ ID NO: 243051 - DNA, 944 bp, Homo sapiens
  misc_feature: GYAE6OF02H42OG.35.85.H08.1.454.CMB.1.raw
  modified_base (55)..(55): a, c, t, g, unknown or other
  misc_feature (55)..(55): n is a, c, g, or t
  modified_base (124)..(124): a, c, t, g, unknown or other
  misc_feature (124)..(124): n is a, c, g, or t
  modified_base (134)..(134): a, c, t, g, unknown or other
  misc_feature (134)..(134): n is a, c, g, or t
  modified_base (211)..(211): a, c, t, g, unknown or other
  misc_feature (211)..(211): n is a, c, g, or t
  modified_base (244)..(244): a, c, t, g, unknown or other
  misc_feature (244)..(244): n is a, c, g, or t
tcagtacagatcgtcacgaccggtgctcgatttagtatcactcagtcgcgggganagctctggggaggaactgctcagttaggacccagacggaaccatggaagccccagcgcagcttctctcnctgctattcnggcctcccagtatatcactaggagtaaatagtcgatacggacgctacggtcctaccgaacctctcgtcgtcctggtntccgtccgagggacctagacgtcccaacccttntccgtagcgacgggtccaagttacaggtaagttgttacggacgtaagactaaaccgtacggacgtacggtaaccagaccgtaaggtaacggttacggacaaccggtcctcccgtaagtcccgttacctacgtaacgttcggtttcggttggtcccgacccgttaacgggtccggggtaccgcgtttacggtaccgtaccccgtaagggttccgtacggggtttccaacgggtttacgggaaccgtttagggtaccgggttaccgttacggggtacccggggtaaagtaccgggttaacgttaccgtaaccgtttaccgtaaccccgttaaccgtaaccgtaaccgttacgggacccgtaaccggttcctacggtaccgaacggtttaccgttacggtaaacccggtttagtttttacggaacccgttttaagggtttttaactaacccggttttacggtaaacccttaaacgggttaaccgtttaaaacgtttaaacgtaaaacccggtttaaacggggtacccgtttacccggggtaccccgtttaacgggtttaaccgggtttccggtttaacccggttttaaccggggtttaaccccggggtaaccccgggttaaccggggttaaacccttaacccgggggtttcccgtttaaccgggggtaaaccttaaacccgggtaaccttaaaaccccggggg

SEQ ID NO: 243052 - DNA, 969 bp, Homo sapiens
  misc_feature: GYAE6OF02GIVNK.35.85.H08.1.454.CMB.1.raw
tcagtacagatcgtcacgaccggtgctcgatttagtatcactcagtcgcgggggaggaactgctcagttaggacccagacggaaccatggaacgccccagcgcagcttctcttcctcctgcttattctggcctcccagatatcactggataaatagtgatgacgcagtcctccaaccactctgtctgtgtcctccgaggggacaggacgccctacctctcctagcgacgggccagtcaggtgtgtagcagactaacttacgcctacggtaccagacgaacggtaagttcggaccgacggtccgtaccccggtaggtccctccttaccgtatttcggtttcgggtcgttccgtaccggtacggtacggggtcccgtacggtttcggtaccggtaccgtacggttcggttacgggttacgacgggtcggtacgttagggtcggtccgttcggtacggggtaacgtacgggttaccgtttaccgtaccgtttaaccgtacccgtaaacgtaacgttaccgtaaccggtaccgaacccggttcccgtacggtaccggttaaccggtttaccgttaaacgggtttaaacggttttaaccggttttaacggtttaaccggttttttaacgtttttaaacccgtttacccgtttacgggtttaaaccgttaaccgttaaaacggtttaaacgtttaaacggttttaaaaacggttcccgggtttaaccggttcccggggtttaacccggtttacccgggtttaacgggtttacccggtttaaccggtttttaccggggttttaaccccgggggttaaacccggggttacccggggggttaaaacccgtttaaccggggtttaacccgggttaaccgggttaaaccgggttaaacccggttaaaacccggggtttaaaaccggggtaacccgggttttaaccggggttaccgggttaacccggtttaacccccgggg

SEQ ID NO: 243053 - DNA, 834 bp, Homo sapiens
  misc_feature: GYAE6OF02G05NO.35.85.H08.1.454.CMB.1.raw
  modified_base (238)..(238): a, c, t, g, unknown or other
  misc_feature (238)..(238): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctaccaaccactctgtctgtgtcctcgaggggacagacgcccaccctctcctggcacggccagtcagtgtgtancagactaacgttacgccgtagtaccagcaagtaagtcgaccaaggtccctcccgaggtcccttcctacgtacgttccgtttaggtcggttacgtacccgtacggtacggggcccctcggtcggttaccgttccccgaggttaccgtaggtttccgtaagggttcgggtacgtacggggtcggtacgttccgggtaacggggtaacctaagggttcccgtttaccctaccggtcccctttaacgaacccgttacgtacccgaacggtacccgtaccggtccgttaccggacgttaaccgtttacggttaacggtaaacgttttacgttttaccggttacgttttaaacggttttaacttaccggtttacttacggtaaccgtaaatttaaacgtttaaacggtacgtttaacgggtacccgtttaccggggttacccctttacccggttaaggtttaccgtacccggtttttaccggttttaccgggacccgggttaaaccggggtaacccgttaacggtacggttaaccggggtaacgttaaccggttaacccgtaaacgggtttaccggtacgggttacccgtacgttaacccgg

SEQ ID NO: 243054 - DNA, 771 bp, Homo sapiens
  misc_feature: GYAE6OF02HW6ET.35.85.H08.1.454.CMB.1.raw
  modified_base (213)..(213): a, c, t, g, unknown or other
  misc_feature (213)..(213): n is a, c, g, or t
tcagtacagatcgtcacgaccggtgctcgatttagtatcactcagtcgcgggggactgcttcagggcagttggtagatgcccctcgtgggagagactccccgaggggtgacagccagtcggaccctggaagggccgtgggctagggacgagggaccagagccagtccgagggagaggacagagccaagtggacgtggggtgtacgtgtaaacncgccctgcgtggcggaggacggaccgagggcctacccgtccgtaccggaggggaccgccctagtcggcctggacctaacgggtccgggaccgaggacggtccgtacccgtacggaacccgtacggaacgtaccgaagtacggaaccgaacccgaagaaccgacggaccgtaaggttcggtacgtacgaccgtacccgtaggacggacgccggtccgggacccgtcggtaccgacgcgacggccgcgtccgcccgtcgctcggtcggtgtcggtcgggtccgtcggtaccgtcggtacggtccgaccgtcggtcggtacctcggcgttcgaccggtccgtagtcggttaccgcgtaaccggaccggtaacgggaccggacccgacggtacccggtacgaccgtaccgtcggtaacgtacggaccggtaccgaccggtaccgaaccgtccggtacggtaccggtcgggtaacccggtcggtaccggttggggtacccgggtacggtacccggtaccggtaaccccgggaccctaaaccccgggtacccgtaacccccggg

SEQ ID NO: 243055 - DNA, 735 bp, Homo sapiens
  misc_feature: GYAE6OF02FXWT4.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtctccaaccactctgtctgtgtctccaggggacagacgcccaccctctccctgcgagggccagtcagagttgttagcagacaacttagcctaggtaccagcgaagtaacgttggccaggcctcccgaggcctcctgtacgttcgtttggcgtcgtccgtacgtcgggccgtcgttgggtccgtcccgtagttaccgtacggttcgaagggttcggacgtaggtcggtccgttcggtacggggaactagggttacgtttacccgaacctttcctaacccgtaaccgtaacgttaccgaacgtccgaaccggtcccgttacggaccgtacgttaccgtaacgggttaaacgtttacgtttttacggaccgtttttaaaggttttaaccgtttacgttcggttaaccgtaacgttaacgttaaaactttacgtttaaaaccggtgttaccggttaccggtacccgtttacggttaacgttcgtaccgtttacgggttttaccggaccgggtaacgggtaaccgtaggtcgtaggtaacgtaacgtacgaaacgttacgtcggtacgtcgtacg

SEQ ID NO: 243056 - DNA, 755 bp, Homo sapiens
  misc_feature: GYAE6OF02HZV8G.35.85.H08.1.454.CMB.1.raw
  modified_base (242)..(242): a, c, t, g, unknown or other
  misc_feature (242)..(242): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
tcagtacagatcgtcacgaccggtgctcgatttagtatcactcagtcgcggggaggaactgctcagttaggacccagacggaaccatggaacgccccgagcgcagcttctcttcctcctgctattctggcctccagatatcacgtggaagaaatagtgatgacgcagtcctaccaaccactctgtctgtcgtctccgaggggacaggacgccctaccctctcctgccgacgggcagtcgagngtgtagcagacaatcgccgtggtaccagcaagaagttcggacaggtcctaccgngtctaccctntattcgtttggngttaccgtacctacggtacgggccgtacggttcgggttccgtacccgtaggtaccgttacggtacgtaggttcggacgtgggtggtcgttacggtacgggtaccgaaggttaccgttaccgtaccgttaccaaccgtaaccgtactaccgacggtaccgtacgtacccgtaggtccgaacggtttacgtagggtaaacgtttacgttttacgggtaccgttttaaggttttaacctttacgttacgtaccgttaacggtaaacctttaaaagttaacgttaaacgttacggtaccgttccggttacccgtacggttaacgtttcggtaccgtttacgttttaccgggacccgggttaacgggtaaccgtacgtacgggttacgggtaacaccggttaaaccgtaaaccgggttagtacgggtacgtaccgttaccgg

SEQ ID NO: 243057 - DNA, 608 bp, Homo sapiens
  misc_feature: GYAE6OF02GQ8R3.35.85.H08.1.454.CMB.1.raw
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (377)..(377): a, c, t, g, unknown or other
  misc_feature (377)..(377): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (456)..(456): a, c, t, g, unknown or other
  misc_feature (456)..(456): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtcctccgaggggacagacgcccaccctctcctgcgacgggccagtcaggngttgttagcanactaacttgcctggtaccagaccaagaagttggccaggcctcccgaggcctccgtctacgttcgtttggtcgtcgtccgacgtaggggccctcgtggtcgtcccagtcgagttcaggtggcaggtcggtcngtggacagtcgtctactcgtacacctntacgngcacgtcctagcgtagtactaggaattactttgcttagtttatactntacgatactaataagttactacgtcgttcgtacccgttacgtagtttcgacgtttacggtttcgggaccggtaacggggtaacctaacggttccggtaagggtacctaacgtaacccgtaaacggttacgtcggttacgggtacgtacccgg

SEQ ID NO: 243058 - DNA, 813 bp, Homo sapiens
  misc_feature: GYAE6OF02HDMIM.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcatggagaaatagtgatgacgcagtctaccaacctactctgtctgtgttctccgaggggacagacgccctaccctctcctgacgacgggccaggtcgagaggttcgttagacacgtactaaccgttacgccgtacggtaccagtacgaaggtaaacgtcgggaccacggtccgtacccgaggtcccttcccgtacagtttccgtttgggtccgtaccgttcccgtaaacggttccgggggaccccgtggttcggggtcccgttaccccgtacggttaccggtaagggtttcgtaagggtaccgggacggttagggtccgggttaaccgtccgggttaacgggggtaaactaacgggtttacttaacccggttaaccttccgtaaccgtaaccctagttacccgaacgtaccggtacccgtacgtaccgtaaccggtacgttacggttaacgggttaaacgttacgtttttcggtaaccggttttaacggttttaacgtttaccgtttaggtaccgttaaaggaaccttaaacgtaattaacggtcttaccggtacgtcccggtaacgttgggttaccgtacgtttaccggtttcgggaaccgggtaacgggttaaccgaaaggttcggaacggtaacgacgttaaccgaacgttaggtacggtcgtcgtaaccgg

SEQ ID NO: 243059 - DNA, 919 bp, Homo sapiens
  misc_feature: GYAE6OF02IG7BN.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctccagatatcactggagaaatagtgatgacgcagtctccaaccacttctttctgtgtctccgaggggacaggacgcccaccctcgtcctcgcgacggggtacccagttaccgaaggtaggttacggtttaacggcccgtaaaggtaccctaaaaccggtttttaacgggccccgttaacggggttaaccccgaaggtacgtaaacggggttaaaaacgggtttcgggaccccgtaacggggtacccctaacccccgggtaagggtcccctttacccttccgtaacgttttccgtttttcggggttcggttccgtcccgtaaccgggttacgggggtcccgtcggttcgggttccggtaccccgtagttccggtaacgggtttcgagggttacggcgtacgggtcgggtccttacgggtacggggtaaccgtaggtttaacgtaccctaactttccccgtaaccgaacccgttaacgtaccgtagacccgtacggtccccgtagaccgttaagttacgtacgttaagttacgtttttcgacgtttaacgttttacgtttacgttagtacggtatttaaactaaagttaaagttaaccgttagtaccggttcccggttcccgttaaccgggttactttccggtccgtttttacccggttaccggggtacccggtaaccggggttaaccccgtaaacgggtccggttaaacgggttaaacgtaaacccggttaaacccgtaaaaccgggtttcccgtttaacgggggtaccttccgggttaacccggaaccc

SEQ ID NO: 243060 - DNA, 754 bp, Homo sapiens
  misc_feature: GYAE6OF02FWUG3.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccacttctgtctgtgtctccgaggggacagacgcccacccctccgtcccgtcgccggacgggtcccacggtccgaaggtaggttgttacgacgtaacggtaccgtaacgtttacgcccgtacggtaacccagacgtaaaggtaaaacggttcggacccgacgggtccctaccccgacgggttccctcccgtccgtacgtttcggttttcgggtacgttacggtaccctaaccggtcgggggtacccgtcggtttcgggtaccgttcccgaacggtttaccgtacgggtttcgtaacgggttccggacgtaaggttcgggacgtttccggtagggactagggtaacttccgtaccgttccctaccgactaagtcccgtagaccgtacggtcctacggtcgtaaccggttcgtaacggtatttacggttacgttacgtttagttttaaacgttccgtagtaaccagttaacaattaagtaagttcgtcgtccgtactaccggtgtcgtactttccgtacggacggtaaccggacgtacggtccgtaggaacttacgtaaccggaacgttgtaacggttcggctcgg

SEQ ID NO: 243061 - DNA, 875 bp, Homo sapiens
  misc_feature: GYAE6OF02FZTD0.35.85.H08.1.454.CMB.1.raw
  modified_base (178)..(178): a, c, t, g, unknown or other
  misc_feature (178)..(178): n is a, c, g, or t
  modified_base (209)..(209): a, c, t, g, unknown or other
  misc_feature (209)..(209): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcacgtggaagaaatagtgatgacgctagtcctccaacnctctgtctgtgtctccgaggggtacagtacncccaccctctcctgcgacgggcctagtcaggtagtgttagcgaagtcctaacgttaccgaccggtacgtaacccaaggtacaaacggttaaaaggtttcggaacccgtacgggtaccccttacccggaaccggggttcccttaccccgttaccggttaacgttttccgtttttaccggggttacggttaccgttaaccccgtaaccgggttaaccggggtccgttccggtacgggtttccgtacccggttacgtacgggtaccggtttaacgacgggttacggggtccgtaacggggttcgggtcccggttacggtaccgggggtaatacggggtaactttaacccgtacgttcccgttaacgtaccgtacttaccggacggaccgaacggtcccgtagtaccggtaacgttcccgtaaggttaaggtttaacgtttaccgtaccgtttagttttaaaccgttcgttacgtaacgtagtaacttaaagttaaacgtaacgttacggttacccgttacgttacccgtaggttaccgttacggtaccgttcggtttaccggtacccggtaaccggggtaaaccgtaccggttaggttaacggtaaaccgttaacccggtaaacggaaaaccggtttacggtaccgggttaccggtacggttaacccgg

SEQ ID NO: 243062 - DNA, 849 bp, Homo sapiens
  misc_feature: GYAE6OF02FLV4D.35.85.H08.1.454.CMB.1.raw
  modified_base (173)..(173): a, c, t, g, unknown or other
  misc_feature (173)..(173): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctaccaacnctctgtctgtgtctccgaggggacagacgcccaccctctccgtgccgacgggacccgtacgtacgagtaggttaggttacgacgagactaacttacggccgtacggtaaccaggacgtaaggtaaacggttcggacccgtacggccttaccccgaggtacccttaccctacgtacgtttccggttttggtcggtaccgtaccgtaaccgggttaccggggcccgttcgtttcggggttaccgttaccccgtaggttaccggttacgggttccgagggttcgggacgtaggtttcgggtccgttcggaggggtaacgtaacggttacgtttaccacctttccgtaccgaccgtacttacgaccggtaccgtacggtacccgttacggtaaccgtaacccgttaaggtaaacggtttacgttttacgaaacccgttaaccgtttaacgttaaccgtacccgtaacctaacggttaaggtttaacggttcgggttacgttaacccggtttccgttacccgtttacccggtttaccccgggtaccgggttaaaccgggtaaaccgtaagggttacgtaaccgttaaaccgtaaacccggtaaacggttaacggttcggttacggtaacccgttacgaacccgttacccgtagtttaccctttacggttacccttaacccg

SEQ ID NO: 243063 - DNA, 740 bp, Homo sapiens
  misc_feature: GYAE6OF02I5PBF.35.85.H08.1.454.CMB.1.raw
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcacgtggagaaatgtgatgacgcagtcctaccaaccactctgtctgtcgtctcgagggacagacgccaccctctcctgcgaggccagtcagagtgtgcagactaacttgcctacggtaccagactaaggtaaacgttggacctaggacccgttacccgaggtcccttaccgaccgttagttccgttttaggggcgttaccgtacccgtacgggttacggggacccgttcgtaccgggttcttacccgagttaccgtacgggtttcacgggttcgacgtaaggtcggtcgacggttaggggaacctggtaccgttacctaccgttctaccgtaacctaacgtcgtaacgtccgtaacggtcctacggtaccgttaacgttcgtaaacggttaagttaccgttttacgtactttaacggttttattaaccgtgttaacgtacgttaaccgtaaacttaacgtaaacgttagtacccgttgtacccgttacgttaccggttaacgtaccgtttaaccggtttacggaacccggttaacggggtaaccctaacgggttaaccgtacgggtaacttacggtaacccgtaaaaggg

SEQ ID NO: 243064 - DNA, 733 bp, Homo sapiens
  misc_feature: GYAE6OF02HNO57.35.85.H08.1.454.CMB.1.raw
  modified_base (150)..(150): a, c, t, g, unknown or other
  misc_feature (150)..(150): n is a, c, g, or t
  modified_base (190)..(190): a, c, t, g, unknown or other
  misc_feature (190)..(190): n is a, c, g, or t
  modified_base (596)..(596): a, c, t, g, unknown or other
  misc_feature (596)..(596): n is a, c, g, or t
  modified_base (604)..(604): a, c, t, g, unknown or other
  misc_feature (604)..(604): n is a, c, g, or t
tcagtacagatcgtcacgaccggtgctcgatttagtatcactcagtcgcgggggaggaactgctcagttaggacccagacggaaccatggaagccccagcgcagccttctcttcctcctgctattctggcctcccagatatcactggaanaaatagtgatgacgcacgtctaccaaccactctgtctgtntctcgaggggacagacgcccaccctctccgtgaccggacgggccctagtaccgtaaggacggttcggttaacgctaagtaacctaaacgttcgaccccggtaggtaacccaggtactaaagggtaaacggttccggacccgtaaggtccccctacccggaacggtccctccctacgtcgtttcgggtttacggcggttccgaaccgtacggttcggggcccgtacggttgggtcctacccggaggttaccggtaggttccgtaggtccggggaccgttaggttccggtacggttacggacggggtacgtacggttacttccgtaacctccgtaccacgtactacgacgacctacgtccgtagtaccgtagtccgtaagtacgttgttacgtattaagttctacgtntaccgtanacgtaattagtaactcggtactcgggtaccttcgtacgttctccgttaccggtttacggacccggtaacggaaccgtacggtcgtaagaacggttacgtaaacaccgggttatacgggctacggtaccg

SEQ ID NO: 243065 - DNA, 772 bp, Homo sapiens
  misc_feature: GYAE6OF02GCJBE.35.85.H08.1.454.CMB.1.raw
  modified_base (146)..(146): a, c, t, g, unknown or other
  misc_feature (146)..(146): n is a, c, g, or t
  modified_base (197)..(197): a, c, t, g, unknown or other
  misc_feature (197)..(197): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgcttattctggctcccngatatcactggagaaatagtgatgacgcagtctaccaccactctgtctgtntctcgagggacagacgccacctctcctgcgacggccagtcagtgtagttacgcagactaactttacgaccttacgggtaaccaggcctaaagggtaaacgttcgggaccacggtacccgttacccgagggtaccttcccgtacacgttttacgtttcggtgttaccggttaccctacggtaccgggccggtaccttggggttccgtaccccgtaggttaccgacgggttttaccacgggttcggtacccgtagggttcccgggtccgttacggttacgggggtaacaacgggtttaccgttaccggtaaccctttccgtaccgtaacccgttaacttaccggaaccgtaccgaccggttacccgttacggtaccacggtttacgtttacggtaaagtttaaccgttttggttaccggttaagtttttaccgtaaacccgtttggtaactaacggttaacttaaattaggtaaacctagtcgtcgtacccgtcgttaacgttcgaacccggtttagttaccgggacgtaaccggtaccggagtaccgttagggaacgttacaacccggttaaaccg

SEQ ID NO: 243066 - DNA, 647 bp, Homo sapiens
  misc_feature: GYAE6OF02GYJOM.35.85.H08.1.454.CMB.1.raw
  modified_base (294)..(294): a, c, t, g, unknown or other
  misc_feature (294)..(294): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaatagtgatgacgcagtctccaaccactctcgtctgtgtctccaggggacagagcctaccctctcctgcagggccagtccagagtgttacgcaggcaacttagcctggtacccagctagaaacgttggaccaggctcccgagctccgnatcttggagtgtaccacgtgggccgtctaggtcgtacccagtcaggttcacggttggcctaggtgtcctacggtgggaacctggtagttcctacgtcctacactactacgacgacgactacgtcgtacgtacgtcgtacgtagttacgtttcgtacgttaaggtttaacttaacgttaccgtacgttacgtaccgtaaacgttaacgtaaacgttacggttacgtaccggttacccgtaccggtacgttacggtacctacggtttttaccggaccggtaacggggtaacctaacggtcgtacgggtaaccgtagtaccgtaaaccgtaaccggtcgtaccggtagttacccgg

SEQ ID NO: 243067 - DNA, 724 bp, Homo sapiens
  misc_feature: GYAE6OF02HJRML.35.85.H08.1.454.CMB.1.raw
  modified_base (125)..(125): a, c, t, g, unknown or other
  misc_feature (125)..(125): n is a, c, g, or t
  modified_base (151)..(151): a, c, t, g, unknown or other
  misc_feature (151)..(151): n is a, c, g, or t
tcagtacagatcgtcacgaccggtgctcgatttagtatcactcagtcgcgggggaggaactgctcagttaggacccagacggaaccatggaagccccgagccgcagcttctcttcctcctgcttnttctggcctccagtatatcactgganaaatagtgatgacgcagtctaccaaccactctgtctgtgtcctcgacgggacagcgccctacccttcctccgtcgccgacgggtcccagtaccaaggtacgttcggttacgcacggacctaacgttacgtccggtacggtaccgacgacgtaaggtaagttcggacgtacggtccgtaccgcgtcctccctcgtacgttcgttgtcggtcgtacgtacgtccgccgtcggtccgtccgtcgtacgtccgtacgtacgtacggtcgtacgtcggtcggtcggtcggtacggacggacgttacgtacgtacctcctcgtaccgactacgtcgacgccgtccgtcgtacgtacgtacgtaacgtacgttacgttacgtacgtttacgttacgttacgtcgtactacgtaacttacgtacgttacgtacgttacgtaccggttaccgtaccgttacgttccgttcccgtttcggttaaccgggtacccggggtaaccgggaaccggtacggtaacgggtaaccgtaacgtaacggttaaccggtaaccggttacgggtaccgttacggaccgtaccg

SEQ ID NO: 243068 - DNA, 1013 bp, Homo sapiens
  misc_feature: GYAE6OF02H1O9F.35.85.H08.1.454.CMB.1.raw
  modified_base (145)..(145): a, c, t, g, unknown or other
  misc_feature (145)..(145): n is a, c, g, or t
  modified_base (201)..(201): a, c, t, g, unknown or other
  misc_feature (201)..(201): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctccagatatcactgganaaatagtgatgacgcagtctaccaaccactctgtctgtgtctcgagggacaggacnccctaccctctcgtgcgacgggccagtcgaggtagttgtagcagacctaacgttagcccgttacggtaacccgagaccgtaaggtaaacggttcggacccgaggtcccctacccgaacggtcccttacccttacctacgtttaccggttttcgggtcggttccgttaccccgtaccggttaaccgggggtccccgtacggtttccggggttaccgttccccgtagggttaccgttaggggttttcccgaaggggttccggggtacgtacggggttcgggttacccggtttaccgggtacgggggtaaaccgtacgggtttaccggttttaacccgtaccgttttccccgaaccccgttaaaccgtacgtaacccgtacgggtaccccggttaacggccccgtttaccgggaaccgttaaccgggttccgttaaacgggttaaaacgtttttaaggtttttcccggtaaaccggtttttaaacggttttttaaaccgtttttaacggtacggtttaaccggttaacggttaaaccttaaaacgtttaaagttttaaaaccggttaaccggggttaacccggttttacccggggttaacccccggtttaacccgggtttacggttttaacccgggtttaacccgttttttaacccgggggttttttacccggggaaccccggggttaaaaccgggggttaaccccggtaaacgggtttaccggttaaccgggtaaacgttaacccgggttaaaaccggttaaaacccgggttaaacgggtttaccgggtttccggggtaaccttaacccccggg

SEQ ID NO: 243069 - DNA, 803 bp, Homo sapiens
  misc_feature: GYAE6OF02GENEJ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtcctaccaaccactctgtctgtgtcctcgaggggacagacgccaccctctcctgcgacgggccagcagacgtgttagcgagacctaacttacgccgtacggtaccagacgaaaggtaaacggttcggaccacgggtcctcccgaggtcctcctactactttcggtttggtcgttacgtaccgtacggttacggggccctcggttcggttccgtaccccgtagttccgtacggttaccgaggttcggcgtaggtcgggtccttacggtacggggaactggttaacctttcccgtaacctttcccgtaacctaacccgtagtttaccgacggtaacccgtccggtcccgttcggtacgtaccggtttagtaacggttaaacgtttcgtttttaacggacttttaacggttttaaccttacggttaccgtagttaaacgtagttaacttaacgttaaagtcccggtaccgttaccgggttcccgttaacggtttaccgggttacttacccgtttagggtttacccgggaacccggggtaaccggggtaaccgttaacgggtaccgggtaacgggtaacgttaaccggttaaaacccgggtaaaggttaaccgggtcgggttaacccggccggttaaacccg

SEQ ID NO: 243070 - DNA, 768 bp, Homo sapiens
  misc_feature: GYAE6OF02F0RS6.35.85.H08.1.454.CMB.1.raw
  modified_base (133)..(133): a, c, t, g, unknown or other
  misc_feature (133)..(133): n is a, c, g, or t
  modified_base (205)..(205): a, c, t, g, unknown or other
  misc_feature (205)..(205): n is a, c, g, or t
  modified_base (376)..(376): a, c, t, g, unknown or other
  misc_feature (376)..(376): n is a, c, g, or t
  modified_base (401)..(401): a, c, t, g, unknown or other
  misc_feature (401)..(401): n is a, c, g, or t
  modified_base (464)..(464): a, c, t, g, unknown or other
  misc_feature (464)..(464): n is a, c, g, or t
tcagtacagatcgtcacgaccggtgctcgatttagtatcactcagtcgcgggggaggaacgtgctcagttaggacccgagacggaaccatggaagcccagcgcagctcgtctctcctgctatctgtctccagntatcactggagtaaatacgtgatgacgtcagtcctaccgaactactcgtgtctgtagtcctccgagggtacncgaacgccctacctccgtccgtggacccgtacgggcccacggtacacggtagttacgtttacgccgtaagtccgaaacgtttacgaccgttcggtaacgacgtaccgaagtaaacgttcggacctagggtaccctaccgacgtccgttcgacctagtccgtttagggttcnccggtaccttacggacggtcccgtnttacgggttcgtcccctaaggaccggtagttaccgtaacggtcggtaacctaggaccgggttntacccggttagacgattacggtccaacgtcgttcacccggtaactgaccgagtaccgtacgttcgaccgtacgttacgtacggtaaacgttactttaggaacgttacgtttaacgtacgtttcgtaacgttacggaactaattaaaccggtaatacgttaccggtacgtacccgtttaaaggccgtttacggacctttaccggtttaccgggtaacccgttaacgggtccggttaacccgtaacgttaacggggtaactaccggtaccgttaaaccggaaccgttgggttaccgtaggtacccg

SEQ ID NO: 243071 - DNA, 769 bp, Homo sapiens
  misc_feature: GYAE6OF02FFNB5.35.85.H08.1.454.CMB.1.raw
  modified_base (117)..(117): a, c, t, g, unknown or other
  misc_feature (117)..(117): n is a, c, g, or t
  modified_base (126)..(126): a, c, t, g, unknown or other
  misc_feature (126)..(126): n is a, c, g, or t
tcagtacagatcgtcacgaccggtgctcgatttagtatcactcagtcggcggggagaactgctcagttaggacccagacggaaccatcggaacgcccagcgcagtcttctctcctcngtctatcgngcctaccagatactacacgtaggaactaatgtagatcgacgcagttccacccaaccgtcttctgtacctggtacgtacctccgaacgggactagccgtacctacccgtctcccgtagccgtacgggaccctagtaccaggtacgttagttcgacctaaggtacctaacgttaccgccgtacggtaccaacggtctaacggttaaacggttccggaccgacgggtaccctcccggaagtccccttactcgtagttcgtttggctaccgtccgtaacggtccgggcctaggtcgggtacctaccgagttacgtaggttcgacggttcgactacgggttcggtacccttaggcggaaacttcggtaccttcgaacctaccgtcacctacgtcgtacgtcgacgtaccgtagtacccgtattacggtaaacgtacgtttacgttaccgtagttttacgttaacctcgttacgtactaacgtacttaaatacggtttacgacccgtaggttaccctcgttaaccggttcgttaccggtaacctttcgggtaaccgaaccgggttaaccgtaacggtaaccgtaccggttaagtaaccggttacgaaacccggttaaacggtcgttaaccggtagtaccgttaaccccg

SEQ ID NO: 243072 - DNA, 904 bp, Homo sapiens
  misc_feature: GYAE6OF02HGFIW.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctagtctgtgtctccgaggggacagacgccacccttcgtcctgaccgacgggaccctaggtaccagtacggttacggttaacgcgaacggtacctaaaaccgtttaaggaccccgttacggggttaaacccctaagggtaaccgaaacgggtaaaacgggtttaccgggacccggaaacgggtcccgttaccccgaagggtaccttacccggtaccgttaacgtttcgttttacgggttacgttccggtaacccgtaacgggttcgggacccggttcgttcgggttaccgtacccgtacggttaccgttaaggggtttcacgggttcggcgtaacgggttcgggtaccgttcgggtacggggtaaacgtaccggtaacgttttccggaaaccttcccgttaaccgttaacccgagttaacccgtaccggtaacgtaccgtacccggttacggaaccgttaccgttaacgtaaaccgggttaagtttaaccggttttacggtaaccttttaacggtttttaaccttaacggttcgtaaccgttaaccggtaattaaaccgttagttaaacgttacgtacgttacggttacccgttacgtaaccgttcgtaacccttttacgggtttacgaacccggggtaccggtaaccgaacgggttacgtaacgggtaaacgttaccgtaaacccggttaaagggtacccgtttacgggtacgttaccgggtaacccg

SEQ ID NO: 243073 - DNA, 575 bp, Homo sapiens
  misc_feature: GYAE6OF02FK024.35.85.H08.1.454.CMB.1.raw
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctccctgcngggccaggtcagagtgttagcagcaacttancctggtaccagcaaggtaaagttggccaggctccccgaggctcctcatcgtttggtgtcgtccacgtacgggccgcgtggtcgtcccagtcaggttcaggtcgcagtgctcgtggactagtgttcactctacactctacacgcacgcctgactacgtctagaagttagttttacgacttagtttacttactgtacagtacaattaagtaacttagcttcggtacctcgtaacgttgtacgttacgttttcggaccggtaacggggtaccctaaggtccgttaggaacgtacgtacggtaaacgtacggtacggttacggtcgtacg

SEQ ID NO: 243074 - DNA, 646 bp, Homo sapiens
  misc_feature: GYAE6OF02J0G4L.35.85.H08.1.454.CMB.1.raw
  modified_base (177)..(177): a, c, t, g, unknown or other
  misc_feature (177)..(177): n is a, c, g, or t
  modified_base (227)..(227): a, c, t, g, unknown or other
  misc_feature (227)..(227): n is a, c, g, or t
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
tcagtacagatcgtcacgaccggtgctcgatttagtatcactcagtcgcgggggaggaactgctcagttaggacccagacggaaccatggaagccccagcgcagcttctcttcctcctgcttattctggctcccagatatcactggagaaatagtgatgacgcacgtctacccaacnctctgtctggtatctccgagggaccagagccctaccctcctccgtgccgngggtccctagtacgagtgttgtagcctagactaacgttacgcctcggtacncgacgaagtaacgttcggaccaggtccnccgcggttccctccaattccgttttggttcgtgtcccgtaacttcggggccccggttcggtcggtcgtccctagtccgtacggggtttnacggtgccgnggttcggctccgtgggacngattcacgttccntacccngtccngctatcctcgcncgtcgtagtatgtttgtcgttatttcttacgttgtcgtacgtactaagtacttaaagtacgtcgtaccgcgtcccgttacggtgtccgttaccggtttcgaccgttaccggggtcctaaaccgcggttaaccgggtagtaaccgttacgtaaaccgtacggttacgttccgggtcgtacgtacccg

SEQ ID NO: 243075 - DNA, 544 bp, Homo sapiens
  misc_feature: GYAE6OF02IRD4T.35.85.H08.1.454.CMB.1.raw
  modified_base (410)..(410): a, c, t, g, unknown or other
  misc_feature (410)..(410): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccacctctctgcaggccagtcagagtgttagcagaccaattagcctggtacagcagaagtgccaggctccagctcctcatcgttggtgtgtccacgtagggccgcgtggtctcccgagtcgagttcgagtggcagtggctgtggactagtcgtcacgtctacacatcagcagctgcgtagtcgtagaagtatttgcttagttatatncgaagtactaagtaataagtagacgtcgtaccgtcgtacgttacgacgttactttcggacccggtaacggggaacctaaggaccgttaacggaagtacgtaacgtaaaccggtaacgtacggtacgacgtaccg

SEQ ID NO: 243076 - DNA, 866 bp, Homo sapiens
  misc_feature: GYAE6OF02FNVYS.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatagacgctacgtcctaacccaacctacttcgttcgttcgttggttcgttccgtaccgggaacggggtacgaacggaccgtaccccctaccccttccttacccgtacggaccggaacggggaccctaacggtaccgtaaggtacggtttacggttacggaccgtaacgtaaccgttaaaccgtttaccggtcccggttaaccgggttaaacccgacgggtaaacggtaaaacgggtttaaaccgggttccgggaacccgtaccggggtacccccttacccggtaccgggttcccttaccgttaccgttacggtttttcgggtttcgggttacgttccggtacccggtaacggttccggggccgttcggttacgggttcccgtaccgtaggtcggtacggttacgagggtccgagcggtacggtcgtcggtaggtactaggttacgttccacgttaccacccgtatcgtacgcgacgtccggtacctcgacgttacggtagtaacggttacgtttagtttcaacggttttattttacgtaccgttggtacaacgttaagtaaactttagtacgttcgggtaccgttccgggtaccttaacggtgttaccgttaccgttttacggtaccgggaaccgggtaaccggtataaccggtggtaacggaaccgttaacgtaaccggtaacggttacggtacgggtcctaggtacccg

SEQ ID NO: 243077 - DNA, 755 bp, Homo sapiens
  misc_feature: GYAE6OF02FX36T.35.85.H08.1.454.CMB.1.raw
  modified_base (253)..(253): a, c, t, g, unknown or other
  misc_feature (253)..(253): n is a, c, g, or t
tcagtacagatcgtcacgaccggtgctcgatttagtatcactcagtcgcgggggagaactgctcagttaggacccagacggaaccatggaagccccagcgcagcttctcttcctcctgcttatctggctccagatatcactggaagaaatagtgatgacgcagtctaccaaccactctcgtctgtcgtctaccgagggacagacgcccaccctctccgtgcgacggcaggtcagtgtgtagcgatacattacnccgtaggtaccagacaagtaagtcgaccaggcctccgagcctacctctacgttcgttaggtcgttcgtacccgtaacggtcgggacccgtcggttcgggtacccgttaccccgtaggttaccggtaacgggtttacgaacgggtttccggaccggttaacggtcgggtacttcgggttacggggaaacctacgggggttacttaccccgacgtttaccctccgaaacccgttacgtaccgtaccgggaacaccggttacctacggccttaacggttccgtaaacgggtaactttaccggttttcgaacgttttacgtttactacgttacgtaccgtaagtaacctaagttaacgttaactacggttaaccgtccgggttccccttaaggttccgtaccgttacgtttaccggttaccggacccgggtaacggtaacctacgggtacgtacgtaagtacccgttaaacggtaacccgtagtttacggtaccggtataacccgg

SEQ ID NO: 243078 - DNA, 827 bp, Homo sapiens
  misc_feature: GYAE6OF02HQDWS.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtctccaaccactctgtctgtgtctccgaggggacaggagccctaccctctcctagccgtacgggcctagtcagtagttagttacgcacgaccgtaacttacggccgtggtaacccagacgaaagtaaacgttcggaccacggcctcccgacggtcctccgtactacttcggtttaggtcggttctccgaccgtacggggcctcggttacggtccgttacccggacgttacggtacggttacgtacggtcgggtacaggttcgggtaccttacgggtacgggtaactaggtaccgtttaccgacccgttacgtacccgaacccttagtacccaacgggtaccctaacggcccgttacgacgtttaccggttacggtaacgggttaaagtttaccgtttaacggtacgtttaaacggtttttaacgttaccggttagtttacccggtaaagtaaaccgttaaaacgttttacgtaaaaccgttcggttacccggggtttaaccgggtacccccgtttagggtaacgttttaacccgttccggtttaccggttttaaccgggaacccggggtaaccgggtaacccgtacggggttacttacgggggaacttaaacgggttaacccgtaaaacgttaccgggtttagggaccggttacccgtaagg

SEQ ID NO: 243079 - DNA, 698 bp, Homo sapiens
  misc_feature: GYAE6OF02FGPTE.35.85.H08.1.454.CMB.1.raw
  modified_base (145)..(145): a, c, t, g, unknown or other
  misc_feature (145)..(145): n is a, c, g, or t
tcagtacagatcgtcacgaccggtgctcgatttagtatcactcagtcgcggggaggaactgctcagttaggacccagacggaaccatggaagccccagcgcagcttctcttcctctgctattctggctcccagatatcactgganaaatagtgatgacgcagtcctaccaaccactctgtctgtgtctccgaggggacagacgcccacccgttctcccgtgccgacggggaccctaggtccaggtacggtttacgttaacggccaacggtacctaaaccggtttaacgccgttacggtaacccgacggtacaaacggtaaaacggttccgggacccgtacgggacccgtccccgacggtccttcctactacttccgtttggtcgtcgtccgacgtacgggccgtgttcgtcgtcccgtagtccgtaggttcgaggtcgcgtaggtcggcgtcggtacggactacgtacgtccacctctaccaccgctcgacgcacggtcctacgacgtacggtctaagtaacgttgttttacgactttagtttacttacgttgtactagtaactaagttactagtacgtccgttcgtaccgttacgtgttcgtaccgtttacggttcggaccgggtaacgggtacctacggtacgttaacgggaacttaacgaaccgtaaacggtacggtcgggttacgagttaccgg

SEQ ID NO: 243080 - DNA, 871 bp, Homo sapiens
  misc_feature: GYAE6OF02IRGMN.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtcgtctccgaggggacaggacgacccacccttctccgtacgccgacgggaccagttcacggtaggttggttacgcgagacctaacgttacgtccgttacgggtaacccaggaccgtaaggtaaaacggtttcgggacccgtaacgggcccttaccccggtacgggtaccctcccttacgactttccggttttgggttactccggttacccgaaccggttcggggcccgtcggttcgggttccggttaccccgtaaggtccgttaacggttccgtagggttcgggtaccgtagggttccggtccgttacggggttcggggaaacgtaggttacggtttacctacccgttaccgtacccgtaacgaccgttcgtaaccggactaacccggtcctacggtccgtacggttaccgttacggtaaacggttacgttttagtacccgtttaagttttaacgtttaccgtacggtttaacgtaacgggttaaccttaaagttaacgttaaacgttaggttacccgtacgggttacccgttaccgggtttaacggttccgtttacccggttaccggtttttaccgggacccggggtaacgggttaacccgtaacgggttccgttaacgggaacgtttaaccgtaaaccgggtaaaaccgtacgggtttaacgggtacgggttacgttaaccccggg

SEQ ID NO: 243081 - DNA, 620 bp, Homo sapiens
  misc_feature: GYAE6OF02HR7ZU.35.85.H08.1.454.CMB.1.raw
  modified_base (393)..(393): a, c, t, g, unknown or other
  misc_feature (393)..(393): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
  modified_base (481)..(481): a, c, t, g, unknown or other
  misc_feature (481)..(481): n is a, c, g, or t
  modified_base (591)..(591): a, c, t, g, unknown or other
  misc_feature (591)..(591): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctcggctcccagatatcactggagaaatagtgatgacgcagtctcccaaccagtctgtctgtgtcctccaggggacaggtacgccctaccctctccctagccgagggcctagtcgaaggtcgttggttacacgagaccgtaaacttagcccgttaggtacccagcctaaaggtaaacggttcggacccgaggtcctcccgaggtccctcccgtctagttccgtttggtcgtcgttcccgtacggtacgggtccgtcgtcggtcgtccgngtcagtcgagtggcaggtggctcgtgggangtacgttcactctccacnctcacgtcacgcctgtcgatctacgtattcgtttacggtnttagttttactgtcgtactagactaaagttctaaagtccgtataccgttcccgtagtaacgttccttagttaccgttcggtaccgggaacggtaacgcggtacgaggtanaccgttagaaaccgtcgtcgtccgctacg

SEQ ID NO: 243082 - DNA, 685 bp, Homo sapiens
  misc_feature: GYAE6OF02GLLIY.35.85.H08.1.454.CMB.1.raw
  modified_base (147)..(147): a, c, t, g, unknown or other
  misc_feature (147)..(147): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (250)..(250): a, c, t, g, unknown or other
  misc_feature (250)..(250): n is a, c, g, or t
  modified_base (359)..(359): a, c, t, g, unknown or other
  misc_feature (359)..(359): n is a, c, g, or t
  modified_base (643)..(643): a, c, t, g, unknown or other
  misc_feature (643)..(643): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactgganaaatgtgatgacgacgagtctccaaccactctgtctgtgtctcgagggacagacgccacctctcngcncggcagtcagagttgtagcagcaattcgcctagcncgagaagtaagtcgcgacggctaccggacgccttcactcgtttcgtttaggctcgtaccgaggtaccgggccgttcgtcggtccgtcccgtacgtacgttacggttacnggggttacgcgttaggtcggtaccgttcgggtagggaacgtacggttaacgttcccgtaacctttccgtaactaacccggtctaaccgtacggaacctcggttaccgtcggtaaccgtcgtaccgttaaggtaacgtttgttttacgacgttttaacgttttacttacggtcgtaaccgtattaagtaactttaagtaccgttacggtacctttacggcccggttataacggttccgttacgtttaccggttaccgggaccggttaccggggaacctacgggtntaacgggaactagtaaccggtagtacggtgtaccgtccgtac

SEQ ID NO: 243083 - DNA, 699 bp, Homo sapiens
  misc_feature: GYAE6OF02HE0MR.35.85.H08.1.454.CMB.1.raw
  modified_base (554)..(554): a, c, t, g, unknown or other
  misc_feature (554)..(554): n is a, c, g, or t
  modified_base (577)..(577): a, c, t, g, unknown or other
  misc_feature (577)..(577): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggaagaaatgtgatgacgcagtctcccaaccactctgtctgttagtcctccgaggggacagacgcccaccctctccgtgccgacggtaccagtacagtagtgttagcacgtactaaccgttacgccgtcggtaacccgagacaaaggtaaacggttcggacccgtacggtcccgttacccgaacggtccttaccctacgtacttttccggttttagggtcgtttacggtaccgtaccggtacggggtcccgtcggtttagggtcccgttaccccgtaggttacgtaaccggggttcgacgggtgggacgttcggttacggtcgtaccgggtggggactaagggttacgttcccaacgttcctacgtacctacgttcgaacgtcgaccgtctcgtactacgtcgtaatagttnttacgtacgtttattactacgtntacagtactaatacgtatacgtctcgtaccgtcgttgttacgtcgttacgttcgggaccgtaacgggtacgtaagtcgaacggtagaaccttaacggaaacttacgggtgtaccggctaacg

SEQ ID NO: 243084 - DNA, 777 bp, Homo sapiens
  misc_feature: GYAE6OF02GKSEK.35.85.H08.1.454.CMB.1.raw
  modified_base (378)..(378): a, c, t, g, unknown or other
  misc_feature (378)..(378): n is a, c, g, or t
tcagtacagatcgtcacgaccggtgctcgatttagtatcactcagtcggcgggggaggaactgctcagttaggacccagacggaaccatggaagcccagcgcagcttctctcctcctgctattctggcctccagatatcactggagaatagtgatgacgcagtcctaccaaccacgtctgtctcgtagttcgccgaaggggacaggacgtcccacccgttctccgacgcggaacgggccctagtaccgaggtacgtcggttaacgccgtaagtaccgtaaacgttcggtaccgttacggaacacggacgaaacgttaaaggttccgggacgacggttcccgaccgaacggtcctaccgtctagttcgtttggtcgtcnccggtaacgttcgggcccgttggtccgggtactaccggtacgtaccggtacggttcgaagggttcgtcttacggttcgggtcctacgggttacggacgttagggtaacctttccggaactttacccactaaccggtactacgaccacgtaccgtaccgtaccggtatacggttacgtcggtaaacgtttccgtttaggtatttaaccggttttactaccggttggtaacgaactacgttaaaacttacgtaacgttacgacggttaccgttaccgtaacggttaccggtattaccgggtttacgtacggggttacccggaaacgggttaccgtaaagccgggtttaagggaacgttaacgtacggtaaacccggtggtacggttacggcgtaaccccgg

SEQ ID NO: 243085 - DNA, 709 bp, Homo sapiens
  misc_feature: GYAE6OF02G4A7O.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggagaaatagtgatgacgcagtctccaaccactctgtctgtgtctccaggggacagacgccaccctctctgcgacggccagtcagagtgttagcagactaacgtagccgtaggtacccagacaagaaagttggcctaggcctacccgaggcctcctacagttacgtttggtgttacgtccgacgtacgggtacccgcgttgggtccgtcccagttcgtaggttcctaggtcggctaggtgtcgttcgtaggggtaacaggtacttccgaacttccgtacctaacccgtactacgaacggtaccgtaaccgtcccgtaggtacccgtagttaccgtaacgtaaaagtttacgttttacggtaccgtttaagttttaaacgtttaacgttacgtttacgtaaacgtaacttaaaacgtttaagtaaacgtttaacgaccggttaaccggtcccgtttaacgttacggtttcgtaccgtttaccggttttacggcccggttaacggggaaccttaacggacgttagggaactaacgtaccgtaaaggtaccgtaggtccggacgtaccg

SEQ ID NO: 243086 - DNA, 723 bp, Homo sapiens
  misc_feature: GYAE6OF02GIYQH.35.85.H08.1.454.CMB.1.raw
  modified_base (379)..(379): a, c, t, g, unknown or other
  misc_feature (379)..(379): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtcctaccaaccactcgtcgtctgttgtcctccgaggggacagacgcccaccctctccgtcgcgacggccagtcaggagttgtagcagacctaacgttacgccgtacggtacagacgaaggtaaacgttcggaccgacggccgtacccgacgggtccttccgtacgtacttcgtttcggtgttccggtaccaccggtacgggccgtcgtggttccncccgtagtcgtaggttccagtcggtagacggtcggtctggtacgggacttacggtacgttccaccttcctaaccggaccttagaccgtaacgtccgtaacgtcccgtagtacccgtacggtacgttaacggtaacgtttagtttcccgtaaagtttttacttacgttacgttacgtaccgtaagtacttaaagttactaagtaccgtacgttaccggtaccgttaacggtgttaccgtaccgtttacggtttcccggacggtaaccgggtaacgccgggttaacgacgggttaaactaccgggtaacgtaaaccggtacgttacgggttaccgcggttaacccg

SEQ ID NO: 243087 - DNA, 726 bp, Homo sapiens
  misc_feature: GYAE6OF02HGCQ7.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcgagggccagtcagagtgttagcagctaacttgcctaggtaccagcaagtaaagtcggaccaggcctaccccgaggtcctaccccgtcgtacgtttccgttttgggtcgttccggtacccctaacggttaccggggccgtaccgttgggttccgacccctaggtccgtagggttccaagggttcggacgtagggtcggtccgttacggtcggggtaacctaggtacgtttacccaccgttcctaccgaaccctacgtaccgagaccgtacgacccgttgaccgtaccgtacgttaggtaaacgttagttttcggacttttaaacgttttactttacgttcgttacgtacgacgttaaattaagttaaagtacgttacgtaccggttccttacccggtagtttccgaccgtttacgtttccggaaccggtaacggggtaaccctaaggtccggttaaggaacgttaactaacccggtaaaacggttacggttacggtacggtacctaaccgg

SEQ ID NO: 243088 - DNA, 658 bp, Homo sapiens
  misc_feature: GYAE6OF02FSE20.35.85.H08.1.454.CMB.1.raw
  modified_base (217)..(217): a, c, t, g, unknown or other
  misc_feature (217)..(217): n is a, c, g, or t
  modified_base (507)..(507): a, c, t, g, unknown or other
  misc_feature (507)..(507): n is a, c, g, or t
  modified_base (651)..(651): a, c, t, g, unknown or other
  misc_feature (651)..(651): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggaagaaatagtgatgacgcagtcctccaaccactctgtctgtcgtctccgaggggacagacgcccaccctcncctgccgacgggccagtcagagtgttagcagactaacttcgccgtcggtaacagtcaaggtaaacgttcggaccgtaggtccctaccccgaggtcctccgtactagttcgtttggtcgtcgtacccgtaggtacgggcccgtcgttcgggttccgtacccgtagtaccgtacggtttacgacggtggacgtacggtcggtcctcggtcgggaactaggtcttaccaccgttactaccgacctacgtcaacggcgaactcgtgacctacggtacgtagtaacgttgtttanacgtttacgtttatctcgtacgagtaactagttaataacgtgtccgtacgtccgtacgttgtcttaccgttcgtttaccggacggtaacgggtaccacggtcgtacgtaagtaccgtaacggtaaacgtacgtcggtaccggtntaaccgg

SEQ ID NO: 243089 - DNA, 878 bp, Homo sapiens
  misc_feature: GYAE6OF02FM7MD.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctaccaaccactctgtctgtgtctccgagggacagacgcctacctctcctgcgagggccagtaccagagttcgttagcgaagactaacgttcgtaccgtacgggtaacctaaggacctaaaggtaaacggttcggacccgaacgggtacccttaccccggaagggtccttaccccgtagtacgtttcggttttacgggttacgtacgtaccgtaaccgggtttacgggggcccgttcggtttcgggtccgtaccccggttaagccggttacggtttccgaagggttccgggtctaacggggttcggaccgttttaacgggccgggtaaaacgaaggtttaacccggtttaccgtaccgttaccgttaacccgtaaccgtaaccttaccgaacggtacccgtaacggtacccgttacggaaccgggttaaccttacggtaacggtaacgttttaacgttttaccggaaacccgtttttaagggtttttaacctttaacccggttggtttaacccgtaaacgggttaaaccttaaaagttaacgtttaaacgttacggtacccgggttacgttacccgtaccggtttacgttaccgtttacggtttaccgttttacggggaccggtaaaccggggttaaccgtaaggttcggtaagttaaccggtaacgtaacggttaaaacccgttaggttaccgggtaacgtccgttaaccgg

SEQ ID NO: 243090 - DNA, 810 bp, Homo sapiens
  misc_feature: GYAE6OF02F773A.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagcccaccctctcctgcacgggccagtcagagtgttagcagcaacttagccgtagtaccagacgaagaaagttcggaccaggcctcccgaggccttccctcattcgttttggtcgttcgtccgtaacgtggggcccgtcgttcggttccggtcccctaggttccgtacggtttacgaggttcgggcgtaggtcgggtctcggttaggggaactaggtacgtttcccaacgtttccaaccgtaccctattaccgacgccgtaccggtaccttcggaccgtaggttacgttacgaaacgttttacggtttttaagaccgttttaagttttaaccgttttacgttaccgttaccgtaaacgttaaccgttaaaatttaacgtaaaaccggttagggtaccgttttacccgggaaacccgttttcccgggttaaagggttttacccgttacccggttttaaccggtttttacccggggaacccgggttaaaacccgggggttaaaccctaaaaacccgggttttgggtaaaacccggtttaaggttaaaccccggttaaaaccggttaaaccggggtttaacggtaccgggtttaacccgttaccggtaaccccgg

SEQ ID NO: 243091 - DNA, 649 bp, Homo sapiens
  misc_feature: GYAE6OF02FMNCX.35.85.H08.1.454.CMB.1.raw
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcaggccagtcagagtgttagcagcaacttacgcctggtaccagctaagaaagttggaccaggctccaggctcctcatcgttgtcgtntcacgtagggccnctggtcncccgagtcagttcagtgcagtcggtctcggtgggactaggtacgttccgacttctaccgtaccagttaccacgtacacgcctggacgacgtcctacggtaagttgttttacgccgtttaagtttaacctttaacgttcgtacctacggtacctaaattacgttaaacttacggtcgttacgggtcccttaaccgggtagttacggtcccttaacggttttcgggacccggtaaaggggtacccgtaaggttccggtaacgggtaacgtaaccggtaaccctaaaaccgggtaaccggttaacgggttacgggtacccgttaaccgg

SEQ ID NO: 243092 - DNA, 735 bp, Homo sapiens
  misc_feature: GYAE6OF02JOOAW.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgaagtggaccgcagtcctaccaaccacttctggtctgtcgtcctccgtaggggacaggacgcccacccctcttcccgtcgccgacggggccacgttacgaggtaggttgttagacaggacaacttacggccgttcgtaccgaggtaccaagaacgtttcggacctacggtcctcccgaggtcccttccgtctacttcgtttggtacgttcgtaccccaggtacgggccgtcggttagtccgacccgtagtccgtacggttcgagtcggacgacgtggtccgtcggttaggacgtaacggtgtactaccgttctaccacctagtacgcgtaccgtcggacccttaggaccgtaccggtcgtagtaaacgtttcggtttcgtaacgtttacgtttaaagttcccgtagtacccgtagttaaccgtaaagttatttaaaccgtcggtacgttacggttcccgttaaccggtacgtttagtacccgttaggtttccggaaccggttaacggggtaacctgttaccggttaacggtaaccgtattaaccgggaaaccgttacgtttacggaccgggttctaaaccg

SEQ ID NO: 243093 - DNA, 720 bp, Homo sapiens
  misc_feature: GYAE6OF02FLGA7.35.85.H08.1.454.CMB.1.raw
  modified_base (147)..(147): a, c, t, g, unknown or other
  misc_feature (147)..(147): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatactcactgganaaatagtgatgacgcagtctaccaaccactctgtctgtcgtctccgagggacagacgcccaccctctcctgcgaggccagtacagagtgtagcagactaactagcctacggacagacaagtaagttcggactacggcctccgaggcctcctatacttcgtttcggtgtccgtaccgtacgtacgggccgtacgtcgggtctaccccgtagtcgtaggttcgaggtcggcgtacggttcggacttcggtacgggactacgtaggttccacgttacctacccgactactcggaacgtaccggtacgtaccctaggtacctaggttaccgttaacggtaagtttacgttttacgtaacggttttattttaacgttacgttctaacggacgttaaactaaagttaacgttaaacggtattcccggttaacggtcccgttacggttaacgtttcgggttaccttttacgggtttcgggaacccgggtaaacgggtaacgttaacgggtaccggttaaggaacgtaaccggtaaacgtaaaccggtttacggtaacgggtttacggaccgttaacccgg

SEQ ID NO: 243094 - DNA, 678 bp, Homo sapiens
  misc_feature: GYAE6OF02HDVB0.35.85.H08.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (617)..(617): a, c, t, g, unknown or other
  misc_feature (617)..(617): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactgagaaatagtgatgacgcagtctaccaaccactctgtctgtgtctcgagggacagacnccacctctccngcgacggccagtcgacgtagtcgttagcagactaacgttacgaccgtaggacacgacaacggtaaacggttacggaccgtacggcctaccgacggtccttccgtacgtacttcgtttggtcgtacgtcctaacggtccgggtccgtccgttcgggttaccgtaccccggtagttacgtacggttacgtaaccggtcgggtacgtacggtcggtcccggttacggtacgggtaccgagttacgttaccgtaccgtccgtaccaacgtacgtacacgaccgtactaccgtcgacgtagttacaaggtagttatttcgtactttaacgttattacgtgtacctgaaccgttaataagtacgttacgtcgtaccgtcctacggtgtctacgttcgttacggaacccggnggtaaccacggtacgtcggaaactacgtaacgaaaccgttacggtaggtacgtaccgtacg

SEQ ID NO: 243095 - DNA, 675 bp, Homo sapiens
  misc_feature: GYAE6OF02JNH7T.35.85.H08.1.454.CMB.1.raw
  modified_base (188)..(188): a, c, t, g, unknown or other
  misc_feature (188)..(188): n is a, c, g, or t
  modified_base (275)..(275): a, c, t, g, unknown or other
  misc_feature (275)..(275): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggcctcccagatatcacgtggaagaatagtgatgacgcagtctaccaaccnctctgtctgtgtctccgagggacagacgcccaccctctcctgcgcggccagtcagtgtgttagcagacaacgttgccgtacggtacngacgaagtaagtcggcaggtcctaccgaggcctcctactacgtttccgttggtacgtccgtaccgtacggtaccggggtccgtcgttcggtccgtacccgaggttaccgtaggttcgtaggtcggtcgtaggtcgtcgtcgtacggtacgaggttacgttccgactttacgaccgaacgtactaccgagtaccgacgtaccctaggtaccgtagttacgtacgttaaacgtttcgtttaccgacgtttagtttaaacgttcgttaccgtacgaatttaccaaattacgtaacgtacggcgtttaccggtacccttagggtacgttcgttaacgttccggttaaccggaccggtaccgggtactacgggtccgttaaggacgttaaccctacggtaaaccg

SEQ ID NO: 243096 - DNA, 688 bp, Homo sapiens
  misc_feature: GYAE6OF02F6W3B.35.85.H08.1.454.CMB.1.raw
  modified_base (128)..(128): a, c, t, g, unknown or other
  misc_feature (128)..(128): n is a, c, g, or t
  modified_base (184)..(184): a, c, t, g, unknown or other
  misc_feature (184)..(184): n is a, c, g, or t
  modified_base (449)..(449): a, c, t, g, unknown or other
  misc_feature (449)..(449): n is a, c, g, or t
  modified_base (576)..(576): a, c, t, g, unknown or other
  misc_feature (576)..(576): n is a, c, g, or t
  modified_base (596)..(596): a, c, t, g, unknown or other
  misc_feature (596)..(596): n is a, c, g, or t
  modified_base (629)..(629): a, c, t, g, unknown or other
  misc_feature (629)..(629): n is a, c, g, or t
tcagtacagatcgtcacgaccggtgctcgatttagtatcactcagtcgcgggggaggaacgtgcgtcagttaggacccagacggaaccagtggaagcccgagcgcagctctcttcctcctgctattcngctccgagatatcgatggaagaaatgtagatgacgcagtcctcaacatctgtctgntcctcgaggcagacgccacctctaccgtgaccagggccctagtaccaaggtagtcgttaacggcctagggaccctaaacttacggtaccgtacgttaaccgacgacgaaacggtaaaacggttcggacccgaaggttacccaccggtaacggtactcccggtactcgttacggtttccggtacggttcgtacctaacgtaccgggtcccgggtagtcgggtaccgtcccgtagtcgtacgttcgaggtcggacctgtggccgttngggaacggtacttcagtccactctacgataccgagtacgcgtacgacgacgtacgtacgagtttacgttacgtgttacgtttactaacgttcggtaacctagtattacgtaataacgtaacgttacncggttccaacggtacgtttnacgtttacgtttcggtaacgtacgggtaaccgngttaacccggtggttaacgtacggtaaccgtaacgtaaggttcccgtaggttaccgacg

SEQ ID NO: 243097 - DNA, 895 bp, Homo sapiens
  misc_feature: GYAE6OF02JERLP.35.85.H08.1.454.CMB.1.raw
  modified_base (158)..(158): a, c, t, g, unknown or other
  misc_feature (158)..(158): n is a, c, g, or t
  modified_base (163)..(163): a, c, t, g, unknown or other
  misc_feature (163)..(163): n is a, c, g, or t
  modified_base (210)..(210): a, c, t, g, unknown or other
  misc_feature (210)..(210): n is a, c, g, or t
tcagtacagatcgtcacgaccggtgctcgatttagtatcactcagtcgcggggagagctctggggaggaactgctcagttaggacccagacggaaccatggaagccccagcgcagcttctcttcctcctgctattctggctcccagatatcactgganaaacngtgatgacgcagtcctccagcctatcctgtctgtctcctcgaggganacgacgccctaccctcgtcctggcgacgggtccagtccagtaccttattacgtaacctacttacgtaccgttgggtactacgtaggacctaaaccggtaaaaccgttcggttaccgacgggtaccctacccgacgggtcttacccgactactccgttacgtcgggtataccaccgttacccgaccggaaccgggtccctaacggttaccggttaacccgtacccgtaacggttaccggttaacgggtttcggtacggttacggggtacccggttaaacgggtttccgggtaccgttaccgggttaacgggggtaccgttaaacgggtttcccgttttaacccgtaaccggttttaccccgaaccttaacccgtacgttaacccgttaccgggaccccgtaaaccggtcccggttaccggtaaccgttaaccgggtttaccgttaaacggtttaacgttttacgggttttaccgtttaacccgtttttaaaggtttttaccctttacgtttaaccggttaacttaacccgggttaaattaaccgtttaaacggttaacgtttaccggtaccgttacccggttacccggttacgggttaaccggtttaccgtaccggtttaccggttacccggtaccggggtaaaccgggtaccggtaacggtacgggttaggaaccgttaacccgg

SEQ ID NO: 243098 - DNA, 749 bp, Homo sapiens
  misc_feature: GYAE6OF02HNZCI.35.85.H08.1.454.CMB.1.raw
  modified_base (177)..(177): a, c, t, g, unknown or other
  misc_feature (177)..(177): n is a, c, g, or t
tcagtacagatcgtcacgaccggtgctcgatttagtatcactcagtcgcgggggaggaactgctcagttaggacccagacggaaccatggaagccccagcgcagcttctccttcctcctgctattctggctcccagatatcacgtggagaaatgtgatggacgcagtctacccaacnctctgtctgtctctccgagggacaggcgcccacctctacctgaccggagggccctagtaccaggtacggttgtacgtaccgacgtacctaaacgtttacgccgtacgtaacccaggtacgtaaaggtaaacggttcggaccgacggtccgtaccccgaaggtcccttacctccgtacgtttcggtttacggtcggttaccgtccgtaaccgggttaccgggtccggtcgttacgggtccgttacccgtagttccggtagtttacggagtacggcgtggtacggtctcggtacggactacggtacgttccacgtcctaccgactacgtacgtaccgcgtaccgtcgtacgactacgttaccgtaagtaagtttcttacggtattacgttttaacgtacgttagtacctaagtaccgtaattaacgtaaacgttacggtaccgttacggtaccctttaggtacgttccgttagttaccggtttaccgggaccggtaaacgggttcccgtaaggtacccggtacggttaacaccgttaaaccggtaaccgtgggtaccgttacggccgtaaccgg

SEQ ID NO: 243099 - DNA, 748 bp, Homo sapiens
  misc_feature: GYAE6OF02IUT5Q.35.85.H08.1.454.CMB.1.raw
  modified_base (221)..(221): a, c, t, g, unknown or other
  misc_feature (221)..(221): n is a, c, g, or t
tcagtacagatcgtcacgaccggtgctcgatttagtatcactcagtcgcgggggaggaactgctcagttaggacccagacggaaccatggaagccccagcgcagcttctcttcctcctgcttattctggcctccagatatcactggataaatgtagatggacgctagtcctaccaacctactctggtctgtcgtctccgagggacagacgccacctctcgngacgacgggccagtcagtagttacgtagacagacctaactcgtccgtacggtaaccagacaacggtaaagttcggccgacgcctaccgtagtcctcctacgttctttcggtttggtacggtccgtaccgtaggttacggccgttcgtcggtaccgtaccgtacggttccggtacggttccgtaggttacggtccggtaggttcggacgttcggacgggtacgtaacggttacgttaccgtccttaccgtaaccgtaccttaacgccgtaaccgacgtacgtacccgtatccgtaagttacccgttagtaaacgtttcggtttacgtacccgtttagtttaccgttacgttacgtacgtaacgtacgtttaattaaacgttagtccggttacgacccgttaccgttaacgggttacttacggtacccgtttaggtttacccggaaccgggtaaggtaacccggttaagggtcccgttaagggtaaccaacgttaacggtaaaccggttcggacgttcgggctaaccgg

SEQ ID NO: 243100 - DNA, 814 bp, Homo sapiens
  misc_feature: GYAE6OF02FY7UR.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggctccagatatcactggagaaatagtgatgacgcagtctaccaaccactctgtctgtgtctccgaggggacagacgccaccctcgtccctggccgacgggccagtcacggtagttgttagccagtacctaacttagccgttagggaccaggacgaaggtaaacggttcggccgacgggtccctaccccgagggtccctacccgttcgtaacgtttcgttttacggggtcgttccggtaaccccgtacggttacgggggtccccgtgtttccggggtccgttaccccgtagggtacccttaggggtttccgtaagggttcggggtaccgtacgggtttcggggtacctttccggggtacgggggtaaacctacgggtttacggtttcccgacccgttttacccggtaaccctaacccgtaccgttaacggtacggaccggtaccgtaccgttaccggtcgtaacgttacgtacggttaaacggttacgtttttacgacgttttaggttttaaccttacgttcgtacgtaacgtacgtaaacttacgttaaacgtcggtacgttaccggttccctacggttaacgttacggtaccgtttacgggttttacggacccgggttaacgggaaccgttaacgggtcgtaacgtaacgtacgtaaacgtacggtcgtacggtacgtcggtaaccg

SEQ ID NO: 243101 - DNA, 626 bp, Homo sapiens
  misc_feature: GYAE6OF02JGZ6K.35.85.H08.1.454.CMB.1.raw
  modified_base (316)..(316): a, c, t, g, unknown or other
  misc_feature (316)..(316): n is a, c, g, or t
  modified_base (611)..(611): a, c, t, g, unknown or other
  misc_feature (611)..(611): n is a, c, g, or t
tcagtacagatcgtcacgaccggtgctcgatttagtatcactcagtcggcggggaggaactgctcagttaggacccagacggaaccatggaagcccagcgcagcttctcttcctcctgctattctggcctccagatatcactggagaaatagtgatgacgcagtcctaccaacctactctgtctgtcgttctccgagggacagacgccacccgtctcctgcgacgggcagtacgagacgttgtacgcgagtactacttacgcctaggtaccagacgaaggaaacgttcggcctacggcctccgacggtctcctacncgttacgttggattcgtcctacggtcggtaccgtcgtacggtctccgtagtcgtacggtcgaggtcggcgtacggtcggacgtggtcggaactagttacgtccacttaccgtacacgtacacgtacggactcgtcctagctagtacgtacgtagttgttacgtacttacgtttactagttacgactagtaacgtaagttataacgcgttaacgtccttacgtcgtaacgttcgtaccgttcgttcgggaacggcggtaacaggggtctacggtacgtacgaaccgagttaaccgngtacgttacctaacg

SEQ ID NO: 243102 - DNA, 224 bp, Homo sapiens
  misc_feature: GYAE6OF02HA5R7.35.85.H08.1.454.CMB.1.raw
  modified_base (208)..(208): a, c, t, g, unknown or other
  misc_feature (208)..(208): n is a, c, g, or t
  modified_base (214)..(224): a, c, t, g, unknown or other
  misc_feature (214)..(224): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccaggaactgtggctgcaccatctgtcttcatcttcccgccatctgaacgatctgtactgagcgggctggcaaggcncatagnnnnnnnnnnn

SEQ ID NO: 243103 - DNA, 793 bp, Homo sapiens
  misc_feature: GYAE6OF02H82S0.35.85.H08.1.454.CMB.1.raw
  modified_base (175)..(175): a, c, t, g, unknown or other
  misc_feature (175)..(175): n is a, c, g, or t
  modified_base (180)..(180): a, c, t, g, unknown or other
  misc_feature (180)..(180): n is a, c, g, or t
  modified_base (214)..(214): a, c, t, g, unknown or other
  misc_feature (214)..(214): n is a, c, g, or t
  modified_base (283)..(283): a, c, t, g, unknown or other
  misc_feature (283)..(283): n is a, c, g, or t
  modified_base (310)..(310): a, c, t, g, unknown or other
  misc_feature (310)..(310): n is a, c, g, or t
  modified_base (770)..(770): a, c, t, g, unknown or other
  misc_feature (770)..(770): n is a, c, g, or t
tcagtacagatcgtcacgaccggtgctcgatttagtatcactcagtcggcgggggagaactgctcagttaggacccagacggaaccatggagccccagcgcagcttctcttcctcctgctattctggcctaccagatatcactaggagaaatgtgactgacgcagtctaccaacnctcgntctgtctcctcgagggacagacgccctaccgtcncgtacgcgacgggccaaggtccgaggtacgttgtacacgtacgacttaacgtcgtaccgtacggtaacngaccgtaagggttaacgtacggacccncgggtacctacccggtaacgtcctacccgttacgtaccgttttccggttttagggcgtaccggttaccgaacgggttaaccgggtccggttcggtaccggtttcgacccgttaggtacgttaacggggtttacgacgggttcggtacgacgggttcggtaccgtttacggacggttacgtaaggttaccgtcctaaccggttcctaacccgaactaccgtaaccgacggtaccgtaacgtccggtaccgtggtaacgtaaccgtaaggttaaaccgttagtttaccggttaacgtttaacgtttaacgttacgtctaaacgtacgttaaacggttaaacttaaagttcgtaacggtaccggttaccgttaccggtacgtaacgttcgtacctttagggtaccgtaacgggtacggtaacctaacggtccgtaaggtacgaacgttaaacgtaaccggttnttaccgggtaccgacggttaccg

SEQ ID NO: 243104 - DNA, 760 bp, Homo sapiens
  misc_feature: GYAE6OF02FIKCX.35.85.H08.1.454.CMB.1.raw
  modified_base (112)..(112): a, c, t, g, unknown or other
  misc_feature (112)..(112): n is a, c, g, or t
  modified_base (206)..(206): a, c, t, g, unknown or other
  misc_feature (206)..(206): n is a, c, g, or t
tcagtacagatcgtcacgaccggtgctcgatttagtatcactcagtcgcgggagaactgctcagttaggacccagacggaaccatggaagccccagcgcagcttctcttccncctgctatctggctccagatatcactggagaaatgtgatgacgcagtctcaaccatctgtctgtgtcctccgaggggtacagacgcctaccctntacctgccagggccctagtcaggtacgttgttacgcgacgtctaacttacgccgtaggtaccagtcgtaacggtaacggttcggaccgaaggtcccttacccgaggtcccttccgtacgtaactttcggtttacggtacgttcggtacccgtaacggttaccgggccgttacgttcgggtcctacccgtagttaccgttaggttccgaggttacgacggtagttcggtaccttcggtaggtaactacgggttacttacccgaccgttccgtaccgaaccgttacgtaccgtaacgtccggtaaacgtcccgttacggtaccggtacgttacccggtaaggtaaacttcggttttacgacccgtttaaggttttacctaccgtagttaaccggacggttaccttaaagtacgttaacgttagcccggtttacggacccttacgggtaagtttccgtaccgtttacggttacgggacccggtaagggtaccctacggttacggtaggtaaccgtacgttaaccggtaaaccgtcgggttgtacccgtgtaacccgg

SEQ ID NO: 243105 - DNA, 665 bp, Homo sapiens
  misc_feature: GYAE6OF02G3I4T.35.85.H08.1.454.CMB.1.raw
  modified_base (185)..(185): a, c, t, g, unknown or other
  misc_feature (185)..(185): n is a, c, g, or t
tcagtacagatcgtcacgaccggtgctcgatttagtatcactcagtcgcggggaggaactgctcagttaggacccagacggaacccatggaagccccagcgcagcttctcttcctcctgctattctggctcccagatatcactggagaaatagtgatgacgcagtctccaaccactctgtctgtntctccgagggacagacgccaccctctcctgcgacgggccagtcagagttgttagcagactaacgttcgccgtggtaccagtacgaaggtaaacggttggacccgtaaggtcccttaccccgaggtcccttccctccgtacgtttcgttttggtcgtcggtaccgtaccggtacgggcccgtacgtcggtccgtaccccgaggttcacggttcaggttcgaccgtaggtccggtctcggtagggactacggtacgttccaccgttcctaccaccgtagtccgtacgacgtaccgtccgtagccgtagtacgtacggtaagtttctttggactttaagtttcttaacgttctacgaacgtattaagtattacgtaacgtcgtacgtccgtcgttaagttccgtacgtttacgttcggacccggtaacgggaacctacggtacgtaggaccgtacgtacgaacgttacggtggtacgctaccg

SEQ ID NO: 243106 - DNA, 640 bp, Homo sapiens
  misc_feature: GYAE6OF02FSQSZ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagcaacttgcctggtaccagcagtaaagttggccaggtcctcccgaggcctccctactacttcgtttggtcgtcgtaccacgtagggcccgtcgttgggtctcccgagtccgtaggttcagtgggctaggtcggcttcgtggggactaggtacgttacacgttcctacacctatcgacgacgagcccgtagcctacggttcctaggtaacgttagttttcgaccgtttaagttttacttacgttgtacctaagtacttaaagttaataaacgttacgtacgttaccgggtcccttaccgggtaagtttcggtacctttacgttttacgggacccgtaaagggggtaccccaaggtccgttaggacgtaacgtaccgtaaacgtacgtcggtacggtctaccg

SEQ ID NO: 243107 - DNA, 727 bp, Homo sapiens
  misc_feature: GYAE6OF02I5OTO.35.85.H08.1.454.CMB.1.raw
  modified_base (330)..(330): a, c, t, g, unknown or other
  misc_feature (330)..(330): n is a, c, g, or t
  modified_base (368)..(368): a, c, t, g, unknown or other
  misc_feature (368)..(368): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
tcagtacagatcgtcacgaccggtgctcgatttagtatcactcagtcgcggggaggaacgtgctcagttaggacccagacggaaccagtggaagcccagcgcagcttctcttcctcctgctattctggcctccagtatatcacgtggaagaaattagtgaattggaacgcgtaagttcctaccctaaaacccaccttcgttcggtaccttggttcgtccgtccgtaagggggacacggaccgccctaccctctccgtggcgaacggggtcccaagtccgaaaggtgttcggttaacgcgtaagacgtaactttcgacccgttaggaaccnggactaacggaaaaggttcggacaacggtcctaccggnggtacctcgtcattcgttggtcgtcacgtacgtacgggctacgtggtactcccnggtactggttcngggtacggcttcgggcgtcctgggtacggacacgggttacttcacgttacctcgaacgtacgtcgtacgacgttacgcgtacgacgtaagtctaacggtaacgtttacgttacgttacgttaacgtttacgttaccttacggtacttaacggtaacttaacgttaaacgtaagttaccggttacgtcggttaccgtacccggttagtacgtttaccttcgtttaccgggacgtaacgggtacccgtaaggtcgtaggacgttacgtacgtaaacgcgtacgttggaccttagg

SEQ ID NO: 243108 - DNA, 832 bp, Homo sapiens
  misc_feature: GYAE6OF02I837W.35.85.H08.1.454.CMB.1.raw
  modified_base (389)..(389): a, c, t, g, unknown or other
  misc_feature (389)..(389): n is a, c, g, or t
tcagtacagatcgtcacgaccggtgctcgatttagtatcactcagtcgcgggggactgcttcagggcagttggtagatgcccctctgggagagatccccgaggggtgacagccatggaccctggaagggcctgggctagggacagggaccagacgccagtccgagggagaggacagacgccaatggacgtggggtgtacgtgtaacagccctgctggcgaggacggaccagggccaccgtccctaccgagggacgcccagtcgctgcgaacggtccgggacgtaggacggtccgccccgtacgaacctaggaacggaccctaatacggaacgaaccccgaagaccgacggtaaccgtaagggtgggttacgtacggaaccgtaccccgngggtaacgggcgtaccggtaccggggtccccgtcgggtaccccgagggtacccgacgggccgtcccggtccggccccgtggccgtcggccgttcggtaccggttcgggtaccggtaccgggtccgtacggtccggttcccggtacccgtaccggtccggcccgttcggtccgtaccggtccgtacccgtacggttcggttaccggtaccggaaccccggtaccgggaaacccggggacccggggaacccgtaacccgggtaccccggtacgggtacccgccgtaaaaaccgggtcggtaaccgggacggtaccggtaccggaccgtaccgtacccggtacggtacccggtaccggtaccgggtccggtccgggtacggggtccggggtacggtaccgggtacccggtaacccgggacccgaacccggtaccccgtaaccccgg

SEQ ID NO: 243109 - DNA, 728 bp, Homo sapiens
  misc_feature: GYAE6OF02IMAPJ.35.85.H08.1.454.CMB.1.raw
  modified_base (481)..(481): a, c, t, g, unknown or other
  misc_feature (481)..(481): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggaagaaatagtgatgacgcagtctaccaaccactctgtctgtgtctccgagggacagacgcccaccctctcgtgcgacgggccagtcagtagttgtagcacgtactaattacggccgttacggtaccctagaccgtaaaggtaaacggtcggacccgtaacggtcccgtacccccggaggtcccttcccgtacgtaacgttttccggtttgggtccggtttaccgtacccgtacgggttaccggggtcccgttacggtttcgggttaccgtacccccgttaggttccggtaaggtttaccgcggggttacggtcgacggggtttcggcgtttacgggngggtaacgtagttaccggtttccaccgttacctcccgtaactagtacgtaccggctaccgtccgtagtcttacgtacgtagtaagttttctttgaacgtttagttttactcgtacgtacgtaacgtattaaattactaagtcctcgtaacgtcccgttagacgttctacgttcggttacggaccgggtaaggaccctagtcggtacgaacgttaccgaacgtaacggtcgttggccgttagaacccg

SEQ ID NO: 243110 - DNA, 655 bp, Homo sapiens
  misc_feature: GYAE6OF02GTL8P.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctcctgcgagggccagtcagagttgttagcagctaacttagcctaggtaccagcaaggaaagttggccaaggcctcccgaggcctacctcacttcgtttggtcgtcgtaccgtaacgtacggggccacgttgggtacgtcccgaaggttccgtaggtttccaggtcggacgtaggtcggtccttcggtaggggtaacaggttacgttccacttcctacgaacccatacacgtacgtacgccgtagtacagttacgtaggtaagttagttttacgacgttagttttaacttacgttacgtactaagtacgtaattaacttaactagtaccgttacgtcccgttacgtagtttacgtacgttacgttttacggaccggtaacgggtaaccgtaacggtcggtaggtagtaacgtaaccgtaaacgtacggtacggtcggtactacgg

SEQ ID NO: 243111 - DNA, 759 bp, Homo sapiens
  misc_feature: GYAE6OF02FS5Q1.35.85.H08.1.454.CMB.1.raw
  modified_base (135)..(135): a, c, t, g, unknown or other
  misc_feature (135)..(135): n is a, c, g, or t
  modified_base (138)..(138): a, c, t, g, unknown or other
  misc_feature (138)..(138): n is a, c, g, or t
  modified_base (146)..(146): a, c, t, g, unknown or other
  misc_feature (146)..(146): n is a, c, g, or t
  modified_base (175)..(175): a, c, t, g, unknown or other
  misc_feature (175)..(175): n is a, c, g, or t
  modified_base (180)..(180): a, c, t, g, unknown or other
  misc_feature (180)..(180): n is a, c, g, or t
  modified_base (209)..(209): a, c, t, g, unknown or other
  misc_feature (209)..(209): n is a, c, g, or t
tcagtacagatcgtcacgaccggtgctcgatttagtatcactcagtcggcgggggaggaactgctcagttaggacccagacggaaccatggaacgccccagcgcagcttctctcctcctgctatctggctccagntancactgganaatagtgatgacgctagtcctaccaaccnctctntctgtctctccgagggacaggcgtacccncctctccgtgcgacgggcccagtccaggtaagttcgttagcgagacctaacttacgcctaggtaccctaggcaaggttaaacggtcggtacgaacgggtcctaccccgaggtcccgttcctctacgttcgtttcggtcgtccgtacctacggtacgggggccctacggttcggtacccggttccgtacgttccggtggttacggagtcggagtcggtcggaagttccggtagggtacacgggtacttacgtacccgtttacgacccgtaacctacggtaccgtccgtaacggcggtccgtcgtaccgtagtttaccggtaagggtagttaaccggttttcggtcttaaggttttaccttagggttaccgtacgtaaccttaagttaaacctttacggtaacgttaaggtcccggttaaccggttcccgttacgttacggttaccggttcctttacggtttaccgggtacggtaaccgggggttaacacgggttaacgtacggtaccgtacgtaaccggtacgttaacggtcggttacgtccgtaacccgg

SEQ ID NO: 243112 - DNA, 737 bp, Homo sapiens
  misc_feature: GYAE6OF02F9CTG.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagagcccaccctctcctgcagggccagtcagagtgttagcagctaacttagcctcggtaccagacaagaaagttcggccaggctaccccgaggcctcccgtacactttcgttttggtcgttcggtcccgtaacgtacggggcccgtacgttgggttccgtaccccgagttccgtacgggtttaccgacgggtcggacgtacggtcggtccgttacggtacgggtaacgaggttagtttaccgaacctttccgtaccgtaccctacgtaccgacggtaccacggtcccgtggaccgtacgttacgtaggtaaacgttagtttttaccgactttaacggtttttaacgttaccgtttgtaaccgttacgtaactaaatttaaacgtaagttaacgtacgttacgggtaccccgttaccggttagttacgtccgtttacggttttacggacccgggtaaacggggtaccctaacggttcgtaacgggtaggtaaccgttaaccgtaaaccgtaacggttacgggttacggttacctaaccgg

SEQ ID NO: 243113 - DNA, 705 bp, Homo sapiens
  misc_feature: GYAE6OF02GFQLF.35.85.H08.1.454.CMB.1.raw
  modified_base (201)..(201): a, c, t, g, unknown or other
  misc_feature (201)..(201): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtcctccaaccactctgtctgtgtcctccgagggacngacgcccacctctcctgacgacgggtaccagtacagagttgtagcagacaacttcgcgtaggtacagcaagtaagtcgaccgaggcctcccgagtctactcgtacgtttcgttggtcgttcgtaccgacggtcggggcccgtcgtcggtccgtaccctgtaccgtagggttccagggttcggacgtaggttcggcttacggtgggaacagttacgttccgacttcctaccaccgactacgacgtacgacgtcctggactacgttagtacggtaatttaacgtttcgtacgtttacgtttttaacgttaccgttcgttaccgtaagtaacttaaagttaagttaaacgtacggtaccgtttccggtaacccgtccgggttaaccttacggtccgtttacggtttccgggaaccgggtaaccgggtaaccgtaacgggtccggttaacggtaaaccgtacgtaaccggtaaaccgtaaccggttacgggttaccgtacggtaccgg

SEQ ID NO: 243114 - DNA, 730 bp, Homo sapiens
  misc_feature: GYAE6OF02IGOLA.35.85.H08.1.454.CMB.1.raw
  modified_base (492)..(492): a, c, t, g, unknown or other
  misc_feature (492)..(492): n is a, c, g, or t
  modified_base (559)..(559): a, c, t, g, unknown or other
  misc_feature (559)..(559): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtctaccaaccactctgtctgtcgtctccgagggacagcgccacctctctgacgacgggcagtacaggtagttagtacgcacgtacaacttacgcctaggtaccgaacgacaagaaaggttacggccacggcgtacccgacggtacctccctactacgtttcggttttggtcgttcggtacccgtacggtacgggtccgtcggtacgggttcgtcccccggtaggttccggtaacgttacggtaggtgggtccgtagggtcgtccgttacggtacgggtactacggggtactccgttactacctctaacctagtccggaactcgtacncccgttgaccgtataccgttaaggtaagtttacgtttacggtattaagtttttaaccgttacggttntaacgcttaaacttaattaaattaaacgtcggtccgtaccgtccgtttacggtacgttacgtccggttttacggtttaccgggtaacgggtaaacgggtaccgtaacgggtagtaacgggtaagtaccgttaaacgtaaaaccggacggtttcggtacggtctaacccggg

SEQ ID NO: 243115 - DNA, 823 bp, Homo sapiens
  misc_feature: GYAE6OF02FR2GQ.35.85.H08.1.454.CMB.1.raw
tcagtacagatcgtcacgaccggtgctcgatttagtatcactcagtcgcggggaggaactgctcagttaggacccagacggaaccatggaacgccccagcgcagcttctcttcctcctgctatctggctcccagatatcactggagaaatgtgactgaccgcagtcctccaaccactctgtctgtgtctccgaggggacagtcgcccaccctctcccgtgcgacgggccacgtcaggtagttgttaacgccgaagtacctaacgtttacggcccgttacgggttaacccgaacggtaccgtaaaaggtaaacggtttccggggaacccctaagggtaccccttaccccggaacgggtccccttacccgtactacgttttccggttttgggttacgttccggtaccccgtacggtaccgggggccttccggtttacgggtccgttaccccggtaaggtccggttacggttacgtaaggggttcggcgttagggtccgggtccgttacgggtagggtaacctagggtaccttacggtaccttacccgtcgaaccctacgtaccgacgtacgaccgacgtacgcgtacgtagtaacgtagttacgttttacgaccttttagttacttacgtacgtagccgtaaactaaagttacgttaactagggttaccgttaccgtacccgttacgggttaacggtttcctaccggtttaccgtttacggggaccgggttaaccggggaacgttaacggaaccgggttttaggaacccgttacggtaaacccgttaaaccgggtagttaccgggtacggtacccgttaacccgg

SEQ ID NO: 243116 - DNA, 720 bp, Homo sapiens
  misc_feature: GYAE6OF02HC7GF.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcactggagaaatagtgatgacgcagtctccaaccactctgtctgtgtctccgacggggacagagaccacccctctcctgcacgggccagtcaggagtgttgacagactaacttagccttaggtaaccagtacaagtaaaagttcggaccgacggtcctacccgaggtcctaccctctacgttcgtttggtgtcgttccgtaaccgtacggggtcccgacgttcgggttctccccgtaggtccgtaggggtttccaacgggttcgggacgtacgggtcggtaccgttcggtaacggggacgtaacgggtacgtttccgtaacttcctaccctaccgacgtaccaaggacccacggtccgtcgacgtacgttacgaagttaagttacgtttttcggaacgtttaacgtttaatttcgttacgttccgaataccgtaaattacgtttaaacgtacgttgtacccggtaccttaccggttagttacgtaccgttacgtttacgggacccggtaacgggaacccgtacggtacgttacgggaacgttacaaacggttaaccggtacttcggggacgttaccacgg

SEQ ID NO: 243117 - DNA, 827 bp, Homo sapiens
  misc_feature: GYAE6OF02F6P5L.35.85.H08.1.454.CMB.1.raw
  modified_base (200)..(200): a, c, t, g, unknown or other
  misc_feature (200)..(200): n is a, c, g, or t
  modified_base (246)..(246): a, c, t, g, unknown or other
  misc_feature (246)..(246): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtcctaccaaccactctcgtctgtgtctccgagggganaggacgcccaccctctcctgcgacgggccagtcagtagttgttacncagactaacttacgcctacggtaccagacgaaggtaacggttcggaccgacggtcctacccggacggtaccttacccgtaccgttatttcggtttcggtacggttaccggtaccgtacgggtaaccgggtcccggtcggttcggggttaccgtaccccggtaaggttaccggttacgggtttaccggtagggttacgggtaccgttaagggtcgggtttacccggtcgggtacgggtaaccgtaggttaccgttaacggttaccttacgttacccgaaaccgttactaccgacgggacccttaacggtcccgtacgtaaccgttacgggttcttaaacgggttaaaccgttttggttttaaccgtcgtttttaaaacgttttacccgtttataccggtaaggactttaaacgtaagtttaaacgttacggtacgttccggttacgttacccttagggttacgttcctacgggttttaccgttccgggaaccgggttaacgggtaacctacgggttaacgaccgtaaaccggttacgaaacccgggttaaaggtcccgttagggtacccgtccgtaaccggg

SEQ ID NO: 243118 - DNA, 803 bp, Homo sapiens
  misc_feature: GYAE6OF02JDFDK.35.85.H08.1.454.CMB.1.raw
tcagtacagatcgtcacgaccggtgctcgatttagtatcactcagtcggcgggggaggaactgctcagttaggacccagacggaccatcggaagccccagtcgcgagcttctcttcctccgtcgcctattcctggcgtcccgagtatatcgactcggagaactagttcgaatgacggccagtactccaacctacgtctgttctggttcgttcgtcccgaggggtaccacgtagcccacccgtctccgtcggccgacgggaccagtccgagtaggttggttacgcgtagcctaagttacgccgttacggtaccaggtacgaacgtaaacggtcggacccgaggtaccttaccgaacggtccctacggttaccgacgtttccgttaggtccgtcgttccgacgtcggtaccgcgtacggtcgcccctaaggtcctaaggttcctaggtcggcgtaacggtcgtccgtcgtacgggactacgggaacgttttcgaacccgttcgtaaccacccgtacgtcgtacgtacgtacccgtccggtaccgtaccgtaccgttaccgttaggaaacggttcgtttaacgtcgtttaacgggtttacttaaccgttacggtaccgacggttaccgaaacgtttaacgtaacgttaacggtaccgttaccggtaccgttacccggttaacgttaccgttaccggttccgttttaaccgggacccggttaaccggggtaacgtaaccggtaacgggttacgggtaacgtaccgggttaacgaaaccggttacggtacggttacggtaccgtacgg

SEQ ID NO: 243119 - DNA, 685 bp, Homo sapiens
  misc_feature: GYAE6OF02IZ55D.35.85.H08.1.454.CMB.1.raw
  modified_base (100)..(100): a, c, t, g, unknown or other
  misc_feature (100)..(100): n is a, c, g, or t
  modified_base (108)..(108): a, c, t, g, unknown or other
  misc_feature (108)..(108): n is a, c, g, or t
  modified_base (114)..(114): a, c, t, g, unknown or other
  misc_feature (114)..(114): n is a, c, g, or t
  modified_base (153)..(153): a, c, t, g, unknown or other
  misc_feature (153)..(153): n is a, c, g, or t
tcagtacagatcgtcacgaccggtgctcgatttagtatcactcagtcgcgggggagaactgctcagttaggacccagacggaaccatggaagccccagcncagcttcncttccncctgctatctggctcccagatatcactggagaaatagtnatgacgcagtctccaacacttctgtctgtcgtctccgagggtacacggagcccaccctctccctgccgaaggccagtccgagtagtgttacgcagaccgtaacttacgccttacggtaaccagacctaaggaaagtttcggaaccgagtacctcccgaggtccttccctatacgttccgtttcggtgtaccgtaccgaccggttaagggcccgtgtagggtccttcccgagtccgtaacggtcgtacggtgtaccgtagtccgtagttcgaggtacagtacggttaccaccggttctccgaacctactaccgacgtaccgtacgtacctcgtaccgtaggtacgttacggtacgttaacgttttaccgtagttaaccggtttactttaacggtctaaccgtacgtaattaacgtaacgtaacgtacgtacgtcgtacccgtaacgtcgtacgtactcggttacgacggtaacgggtaccagacggttaggaacgtacttaaccgaacgtaaacggtcgttacgtcgtaaccg

SEQ ID NO: 243120 - DNA, 655 bp, Homo sapiens
  misc_feature: GYAE6OF02I23M9.35.85.H08.1.454.CMB.1.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (340)..(340): a, c, t, g, unknown or other
  misc_feature (340)..(340): n is a, c, g, or t
  modified_base (438)..(438): a, c, t, g, unknown or other
  misc_feature (438)..(438): n is a, c, g, or t
  modified_base (504)..(504): a, c, t, g, unknown or other
  misc_feature (504)..(504): n is a, c, g, or t
  modified_base (556)..(556): a, c, t, g, unknown or other
  misc_feature (556)..(556): n is a, c, g, or t
tcagtacagatcgtcacgaccggtgctcgatttagtatcactcagtcgcgggggagaactgctcagttaggacccagacggaaccatggaacgccccagcgcagcttctcttcctcctgctattctggcctccacgatactcaacgtggaataaatagtgactgacgcagtcctaccaaccncttcgtgtctgtntctcgagggcagcnccactctcgngacgcggccagcaggtgtgtacntgtaacctacgtacgccgtacggtaccacgacgtaacgtaaggtccggaccgtacggcctacccggcgtacctcctcgttattcggttggtctcgtcnccggtacggcctcgttggtaccgtctcgtacgtaggttcgagtggtacgtagtcggtcgtcgtacgggatcggttactccgaccttcgaccaccgtcncgtacgactcgcctagtcgacgtacgtactaggtttccttgttaacttttacgttacccttagttntacgtactagtaacttacgtcgtaacgtcgttccgggttacacggtttccgngtttacttaccgggtttacggaaccgggtaggaacccggttacggaacgacgggtaacttaacggtaaccgtaggttacctaggggtcctacgtaacgg

SEQ ID NO: 243121 - DNA, 853 bp, Homo sapiens
  misc_feature: GYAE6OF02F67OQ.35.85.H08.1.454.CMB.1.raw
  modified_base (216)..(216): a, c, t, g, unknown or other
  misc_feature (216)..(216): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctcgaggggacagagccaccctctcctgcngggccagtcagagtgttagcagactaacttacgccgttacggtaccaggaccaaggtaaaaggtttcgggaccccgaacggggtccctacccccggagggtacccttacccttacgtaacgtttccggttttgggtacggttccgttaccccgtaacggttcggggcccgtcgttacgggttccggttaccccgtaggttccgtaacgggtttaccagggttcggggacgtaagggttcgggtaccttccgggttaggggaaccgtagggttacgtttcccgtaaccttcccgtaaccaacccgtacgttaccgacgtccgtaaccggtcccttcggtaccgtaacgttccgtaaggtaacgttagtttttacggacttttaacggttttaacgtttaacgttacgttaccgtaacgtaaccttaaagtttaacgttaaacgttacggtaccgttaccgggtaccccgttaccggttaaggtttaccgttaccgtttaacccgggtttttccggggaaccccgggtaaaccgggggtaacccgttaaacgggtaccgggttaacgggtaaaccggttaaccgtaaaccggttaaaacccggttacggtaccggggtttacgtaacccggttaaccgg

SEQ ID NO: 243122 - DNA, 883 bp, Homo sapiens
  misc_feature: GYAE6OF02JCODL.35.85.H08.1.454.CMB.1.raw
  modified_base (104)..(104): a, c, t, g, unknown or other
  misc_feature (104)..(104): n is a, c, g, or t
  modified_base (189)..(189): a, c, t, g, unknown or other
  misc_feature (189)..(189): n is a, c, g, or t
  modified_base (247)..(247): a, c, t, g, unknown or other
  misc_feature (247)..(247): n is a, c, g, or t
tcagtacagatcgtcacgaccggtgctcgatttagtatcactcagtcgcgggggactgcttcagggcagttggtagatgccctctgggagagatcccaggggtnacagccatggaccctggaagggcctgggctagggacagggaccagagccagtccagggagaggacagagccaatggactggggtntactgtaacagccctgctggcgagacgggaccagggccaccgtcctccgaaggggacncccataggctacgcaaggtccgggaccaggacgggtgaccccttaggaaccctgaacggcccaagttcggaacgtaccccaaaggacctacgggaccctaaaggttggggtttacggtacggacgtaacccccggttggaacgggacgtccgttacggggccccttcggggtaccccaggggccgtacgcccggtccgtaccggggccccgtttgaccgtttcggctttcgggaccgtttcggggtacctcggggaccctagggttaccgggttacccgccccggtagtttccggggacccgtttggtcccggttcccggtacccggtacccgtaaacgggtttccggggttaccgtacccggaaacccgggttaaccggaaacgggggttaaccccgggggaacccctaacgggtaccccggttacggggaaccggtacccggtttaaccgttaacggggtttaccggaaaacggtccccgttaaagggaccccggttacccggtaccgtaccgggtacccggttaagggacccccggggttaagtcccgggttaggggtttaccggggggaaccgttaccgggtacccgaacccggggtaaccccggttaccgggacccccgtaaaccccccgg

SEQ ID NO: 243123 - DNA, 797 bp, Homo sapiens
  misc_feature: GYAE6OF02HMG1J.35.85.H08.1.454.CMB.1.raw
  modified_base (388)..(388): a, c, t, g, unknown or other
  misc_feature (388)..(388): n is a, c, g, or t
tcagtacagatcgtcacgaccggtgctcgatttagtatcactcagtcgcgggggaggaactgctcagttaggacccagacggaaccatgaagccccagcgcagcttctcttcctcctgctattctgctcccagatatcactggagaaatagtgatgacgcagtctaccaacactctgtctgtcgtctccgaagggcaggacgcccaccttctcctgcacgggccagtcagtagtgttagcacgactaacgttacgcctaggtaacccagactaaggtaaaggttcggaccgtaacggtccctacccggaggtcccttacccgtagtaccgtttcgttttgggtccgttcgtacccgtacggtacggtccgtaggttggtccgtaccgnggttacgtcggtacgtagtcggctaggtcggtacttcggtagggaactacggtacggtttacctaccgttactacgtaacctacgtaccgtacggtaccgtacgtaaccgttcggtacctacgttaccgtaaggtaacgtttaatttccggttaacgttttaaggtttttaccgttaaccgtttacgtaaaccgtacggttaaaccttaaaggtttaaacttaaacgttacgttacgggttaccgggttaacccgtttacggttaacccggtttaacgttccggtttacccgtttttaccgggaacccgggttaaccgggtacccgttaaaggtccgggttaacggtaacggttaacgtaacccggtaaaaccggttacgggttaacggtccggttaacgttaccccgg

SEQ ID NO: 243124 - DNA, 644 bp, Homo sapiens
  misc_feature: GYAE6OF02FWO02.35.85.H08.1.454.CMB.1.raw
  modified_base (192)..(192): a, c, t, g, unknown or other
  misc_feature (192)..(192): n is a, c, g, or t
  modified_base (246)..(246): a, c, t, g, unknown or other
  misc_feature (246)..(246): n is a, c, g, or t
  modified_base (434)..(434): a, c, t, g, unknown or other
  misc_feature (434)..(434): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactgggggtntactgtaacagccctgctggcgagagggaccagggcaccgtcctccaggggacncccatcgctgcaaggtccggccagacggtcgccccctagaacccgtggaacggccaaagtggaacgaacccaagaccgagggccaaaggttgggttgtcggacgacccctggaggagcgtagggcccctcggtcccgaggccaggccgcgtccggcccctggcctcgctggcgtcgggtcgtcggccngtcggtcgccgagtcggccgtgtccgtcgccgaccgtaagttcggttacgcccgtaaccggacgaacgggcccgggaacccgacgacccggtggaccgtccgtacgtacggttcggaacgtccgacgcccgactccgacgccgtcggccggaccggtccgtggcgggtacgaccggtccgaccggaccccgaaccggcccctaaccccgg

SEQ ID NO: 243125 - DNA, 740 bp, Homo sapiens
  misc_feature: GYAE6OF02FU2ZI.35.85.H08.1.454.CMB.1.raw
  modified_base (489)..(489): a, c, t, g, unknown or other
  misc_feature (489)..(489): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtcctaccaaccactctgtctgtcgtctccgaggggacagacgcccaccctctcctggcgacgggccagtcagagtgttagcagactaacgttacgccgtcggtaaccaggacaaggtaaacggttcggacccgagggtccttaccccgaagggtcccttacccttacgtacgtttccggtttgggttcgttcgtacccgtaacggtacggggtccgtacgttcgggtccttcccgaggtacgtacggttcgaggttcggcgtacggtcggtacgtcggtacggggaactaacggttacgttacctacgttccaaccgtaccgtacncgaacgtccgtacgaccgttagccttagtaccgttaagtaacgtttacgtttacggtactttaacgttttaacttacgttacgtaactaacgttaaactaagttaaccgttaaagttacggtcgtttaccggtaccttacggttcgttaacggtaccgtttacgttaccgggaaccggtaaacgggtaacctaaggtcgtaacggaagtaaccgttaacggaaaccgttaggtcgttaccggcgttaacgg

SEQ ID NO: 243126 - DNA, 837 bp, Homo sapiens
  misc_feature: GYAE6OF02JMXZ8.35.85.H08.1.454.CMB.1.raw
  modified_base (748)..(748): a, c, t, g, unknown or other
  misc_feature (748)..(748): n is a, c, g, or t
  modified_base (831)..(831): a, c, t, g, unknown or other
  misc_feature (831)..(831): n is a, c, g, or t
tcagtacagatcgtcacgaccggtgctcgatttagtatcactcagtcgcggggagagctcgtggggaggaactgctcagttaggacccagacggaaccatggaagccccagcgcagcttctcttcctcctgctattctggccttacccgagatactcactggaagaaatagtgatcgacgcagtcctaccaacctagttctgtacctggtacgtcctaccgaggggacacggacgccccgtaccctccgttcccaggcccgtaacggggtcccaaggttaccgaaggtacggtttcggttaacggctaacggacctaacgttacggtccctacgggtaaccaggaccgtaaaggtaaggtttcggacgacggtcctacccggtaggcccttaccgtactaacggtttctttacgggttcggttacccgtaccctaagggtccggggggtcccctcggttcggggttccctacccggtacgggtttaccggttacggtttacccggaggtttcgggaccgtagggttccggttccgttccgggttaagggggaaaccttacgggttaacgttacccgtaaactttccccgtacggtaccccgttaacgttaccgaacggtccgttaaccgtccccgggttacaccgggtttaaccgtagggttaaactaaggtttcgttttacgaccgtttttagttttaaacctgacgtttacggaactaacggttacttaaaagtttccgtacccgngttaccgtcccgtaggttcgttcttaccggtttacgttccgggaccgttaacgggacttacgtcggaacggtataccggtaanaacggg

SEQ ID NO: 243127 - DNA, 759 bp, Homo sapiens
  misc_feature: GYAE6OF02GHBRK.35.85.H08.1.454.CMB.1.raw
tcagtacagatcgtcacgaccggtgctcgatttagtatcactcagttgcgggggaggaactgctcagttaggacccagacggaaccatggaagccccagcgcagcttctcttcctcctgctattctggctcccagatatcactggagaaatagtgatgacgcagtctaccaaccactctgtctgtgtctccgaggggacagacgcccaccctctcctgcgacgggccagtcgagagttgttacgacgagacctaacgttacgccgtacggtaccgagcgaagtaaaggttcggaccaggtccctcccgaggtcccttcctactacttcgtttacgggtgttccgtccctaacggtcggggcccgtcgttcggggttcctaccccgtaggttccgtacggtttacgtagggttcgggcctagggtcgggtccttacgggtacgggaactaagggtaccgtttaccacccgttccgtacccaacccgtacgttaccgaacggtccgaacggttcccgcggtaaccttacggttccgtaaggttaaacggtttcgttttacggtaccgttttaaggtttttaacttacgtttaccgttacgtaagttaactaaacgttaagtaaacgttacgtcggtttaccggtacccgttcggttaagttcgttaaccgttttacggttaccggtaccgggaacggggttaaccgtacggtccggtacggagttaacgtaacggtaacggacggttcgacggtactacgg

SEQ ID NO: 243128 - DNA, 826 bp, Homo sapiens
  misc_feature: GYAE6OF02IVUGQ.35.85.H08.1.454.CMB.1.raw
  modified_base (149)..(149): a, c, t, g, unknown or other
  misc_feature (149)..(149): n is a, c, g, or t
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (817)..(817): a, c, t, g, unknown or other
  misc_feature (817)..(817): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcacgtgganaaatagtgatagacgcagtcctaccaaccactctgtctgtcgtcncgagggacagacgtccacctctccgngcgacggcctagtcagtcgtagtacgacagtctaaacgtgtcctaggaacctagacgaaacgttaaaggtccgaccgacggacccttccggaacggttcccttccgtacgttacgtttccggtttggtaccttcggtaacccgtaacgtccgggggtcccttcggttccgggttaccgtaccgtaggtttaccggtaacgggtttccgaaggggttcgtaccggtacgggttccggtaaccgtacggggtaccggtaaacgtcggtttaaccggttacctaccggttcccgtaaccctaccgaaacgtttcgaacggaccccgttagggtccctacggtaacgttaccggtttaacaggttaaacgttttaacgttgggtaacccttttaaacgggtttagttaccgttaaaccgtacggtaactaacgttaaaacgttaacgttaacggtcggtaccgtacggttaccccgtaaggttacggttaccgtttacccgttacggttaggaaacccggggttaaaccggtaagttaccggacgggtttaacggaaccgtaacttaaaacccggacggttaaccggtcggttaaccggtnaaaccccgg

SEQ ID NO: 243129 - DNA, 820 bp, Homo sapiens
  misc_feature: GYAE6OF02JHRK3.35.85.H08.1.454.CMB.1.raw
  modified_base (93)..(93): a, c, t, g, unknown or other
  misc_feature (93)..(93): n is a, c, g, or t
  modified_base (101)..(101): a, c, t, g, unknown or other
  misc_feature (101)..(101): n is a, c, g, or t
  modified_base (149)..(149): a, c, t, g, unknown or other
  misc_feature (149)..(149): n is a, c, g, or t
  modified_base (158)..(158): a, c, t, g, unknown or other
  misc_feature (158)..(158): n is a, c, g, or t
  modified_base (267)..(267): a, c, t, g, unknown or other
  misc_feature (267)..(267): n is a, c, g, or t
  modified_base (394)..(394): a, c, t, g, unknown or other
  misc_feature (394)..(394): n is a, c, g, or t
tcagtacagatcgtcacgaccggtgctcgatttagtatcactcagtcgcggggaggaactgctcagttaggacccagacggaaccatggaaanccccagcncagcttctcttcctcctgctattctggcctccagactatcgactgganaaataggtnattcgaacgccgtagtcctaccgaaccattcgtcgtcttgtcgttcctaccgagggggtaccaaggcgaccctcccttacgtcctcggacgtaccgggtctaccggtanacggtaggttccgttacggccaaggtaaccgtaaaccgttcgaccggttcggtaaaccacgggtaacgtaacggtaaaaggttcggacccgtaaggtcccgtaccccgtaaggtccctccgttaacncgtttcgtttcggtacgtcgtacctaacggttaccgggccgttcgtacgggtcgtacccctaagttccgttaaagggtctacggtaggtccgtaacgggtttcggccctttacgggggaacggtaccgtagggttaaaccgttaccgtacgttaccgtaacggtaccctacgtacccggtaaacgtcgtaaccggtccggtacggtaaccttcgggttaaaccgtacggtaaacgttttacgtttcgggtaacccttttaagttaacccttcgtttaacctacgggtactaagtaacgtaaagtaaacgttcgtccggtacgtaccgttacgttacgttcggtaccttacggtttcggaacggttaacggacctacgtccggtaaaggacttaaccgtaccaaggttacttaggtcctggtaaccg

SEQ ID NO: 243130 - DNA, 763 bp, Homo sapiens
  misc_feature: GYAE6OF02GQQET.35.85.H08.1.454.CMB.1.raw
  modified_base (184)..(184): a, c, t, g, unknown or other
  misc_feature (184)..(184): n is a, c, g, or t
  modified_base (351)..(351): a, c, t, g, unknown or other
  misc_feature (351)..(351): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctgtctgtntctccgaggggacagacgccaccctctcctgcacgggccagtccagtagttcgttagcagctaacttacgcctggtaccagctaaggtaaagttcggaccgtacgggcctccccgaggtcctcctacgtctttccgtttgggtcgttctaccgtaacgtcgggcccncggttcggtccgtaccgaggtaccgtacggttacgtagggtcgacgtacgtggccttggtcgggaacgtaggtacggttcctaccgttcctaccgtaaccgtactaccgacgtaccgtacggtccctacggaccgtaacggttacttacggtaaaggtttagttttacgaaccgtttacgtttttaaccttaacggtttaccgtaacgtaacgttaacgttaatttaaacgttaaacggttaccgtaccggttaccgttacccggttacggtttaaaccggttcgttaccgtttacccgggttttacggaccccgggtaaacgggtaacccggtaacgggtacggtaacgggttaaccggaaccttaaccggaaaggttaaccggttacgggtttacggcccgtttaaccgg

SEQ ID NO: 243131 - DNA, 758 bp, Homo sapiens
  misc_feature: GYAE6OF02GX0XD.35.85.H08.1.454.CMB.1.raw
tcagtacagatcgtcacgaccggtgctcgatttagtatcactcagtcggcgggggaggaactgctcagttaggacccagacggaaccatggaagccccagcgcagcttctcttcctcctgctattctggcctcccagatatcactggagaaatagtgatgacgcagtcctccaaccactctgtctgtgtcctccgaggggacagcgcccaccctctcctgcacgggccagtcagtgtgtagcagactaacttagcctagggtaccagacgaagtaaacggttcggacccgtaggcccttaccccggaacggtccctttacccctaccgtaagttttcccggttttaggggttcgttaccggttaccccgtaacggttaccgggggtccccgttccggttacgggttaccgtcccccggtaaggttccggttaaggttcccgtagggtccggagtacgggtcggtcgttccggtacgggtacgtagttacgttccaccgttacctaccgaccctactaccgagtaccgtcgccgtgaccgtacggttacgtagtaacgtttagttttcgtactttaaagttttactaccgttgtacctagtaaccgtaaattaagttaaatccggttacttccgggttacccgtacggttcgttacgttaccgttacgggtttcggacccggtaaggggtacccttaacgggtcgtacgggtactaaccggtaacgtaaccggttcggtaacggtcgtaacgttcccgg

SEQ ID NO: 243132 - DNA, 851 bp, Homo sapiens
  misc_feature: GYAE6OF02GYMPT.35.85.H08.1.454.CMB.1.raw
  modified_base (176)..(176): a, c, t, g, unknown or other
  misc_feature (176)..(176): n is a, c, g, or t
  modified_base (343)..(343): a, c, t, g, unknown or other
  misc_feature (343)..(343): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcacgtggagaaatagtgatgacgcagtctccaaccnctctgtctgtgtctccgaggggacagacgccctaccctctcctgccgacgggccagtcagagttgtagcagacaacttgccgtgaccagcgaagtaagttcggccacggcctcccgaggccttcctctacttcgtttggtgttccgtaccgacggtacggggtcccncgttcggtccgtacccgtaggttccgtacggttacgagggtcggtacgtacgggtcggtacgtcggttaggggaacctcggttaaccggtttccaacctttccgtaacctaaccgtagttacccgaacggtaccgtaaccggtcccggttacgtaacggttacgggttaccttaaacgggttaacggtttaacgttttttacggaaccggtttttaacggttttaaccgtttccggtaacgttaacggtaacgtttaaccgttaaaacggtttaacgttaaaccggttacgtacccggtttacgggttaccccgtttaacggttaaccggtttccgttaaccggttttacccgggttttaacccgggggaacccggttaaaccggggttaaacccggttaaacggggttccccggtttaaacggggaaccccgtttaaaggtttaaacccccggtaaaagggtttaccccgggttaacgggttacccggttcccggttaaaacccggg

SEQ ID NO: 243133 - DNA, 786 bp, Homo sapiens
  misc_feature: GYAE6OF02FNSNW.35.85.H08.1.454.CMB.1.raw
  modified_base (185)..(185): a, c, t, g, unknown or other
  misc_feature (185)..(185): n is a, c, g, or t
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctccaaccactctgtctggtntctccgaggggacagacnccctaccctctcctgccgagggccagtcagcgtgttacncagtcaacgttacgcctacggtaccagacgaagtaaggttcggacccgtaggccctacccgagggtccctacctaccgtagttcgtttacgggtgtcgttaccgtacggttaccggggcccgtggttccgggttccgttaccccgtacggtccgttaacggtttccgagggttccggcgtacgggtcggtccgttcggtgggtaaccagggttacctttcccgaacttccgtaccgaccgtacttaccgacgtaccgtacggtcccgacgtacgtacggttaaccgtaaggtaacgttttacggtttaccgtacggttttacggttttaacgttaccgttaggttccctaaacggttaaacctaacgttttaaagtaaccggttaacgttaccccgttacggtacccgttaccggttaacggtttccggaccttttacccgggtttacgggtaccgggtaaaccgggtaccgtaacggttacggtaacggtaaccgtacgttaacccgtaaaggaccgggttttacgaccgggtccttaaccgg

SEQ ID NO: 243134 - DNA, 738 bp, Homo sapiens
  misc_feature: GYAE6OF02JCL9C.35.85.H08.1.454.CMB.1.raw
  modified_base (150)..(150): a, c, t, g, unknown or other
  misc_feature (150)..(150): n is a, c, g, or t
tcagtacagatcgtcacgaccggtgctcgatttagtatcactcagtcggcgggggaggaactgctcagttaggacccagacggaaccatggaacgccccagcgcagcttctcttcctcctgctattctggcctcccagatatcactgganaaatagtagatgacgcacgtctccaaccactctgtctgtctcgtaccaggggcagacgccctacctctctgcgtaggtcagtcagtagtgtacgacagctaacgttcgccgttacggaaccagacgaacggtaaacggttcggaccgtacggtaccctaccggacggtcccttaccgtaactaggtttccgtttgggtcgttaccggtacccgtaacgggtccgggtccgtacgtttgggtacccggtacccgtacgtaccgtacgggtttacgaacggttcgggaacttcgggtacggtccgtacggttacggggaactaacggttccgtaccgtacccgttaccgtaccaaccgagttaccgaagtccgacgtaccgtgtacctacggttagttaccgaagtttcggtttatacgtttaacgtttaacgttacgtcggtacaacgttaacgttaattaaacggtaagtcgtaccgtaccgtttccgtaaccggttagttcctacgggttactttccgggaaccgttagggaaacccttgtccgtaacgtataccggtaacaaccgtacggtgttaacgcgtaaccg

SEQ ID NO: 243135 - DNA, 820 bp, Homo sapiens
  misc_feature: GYAE6OF02FPBLK.35.85.H08.1.454.CMB.1.raw
  modified_base (126)..(126): a, c, t, g, unknown or other
  misc_feature (126)..(126): n is a, c, g, or t
  modified_base (148)..(148): a, c, t, g, unknown or other
  misc_feature (148)..(148): n is a, c, g, or t
  modified_base (430)..(430): a, c, t, g, unknown or other
  misc_feature (430)..(430): n is a, c, g, or t
tcagtacagatcgtcacgaccggtgctcgatttagtatcactcagtcgcggggaggaactgctcagttaggacccagacggaaccatggaacgccccagcgcagcttctcttcctcctgctattcnggctcccagatatcactggaanaaatagtgatgacgcagtctccaaccactctgtctgtgtcctcgagggacagacgccaccctctcctgcgacgggacctagtcgaggagttagtagactagacctaacttacgcctacggtaaccagctaaaggtaaacgttcggaccgtacggtcctccccggtacgggtccttccgtacttagttaccggttttgggttactcggtaccgtacgtacggggccgtacttcgggttccgtacccgtaggtcgtaagggttcaggtcggatacggtggtccncggtaggactagtaacgttctaaccgtcctaccgaactagtacccgaggtccacggtaccgtgaacgttacgggttaacctaagggtaaacggttttctttaccggtaacgttttaaacggttttaacgttacgtttaacgtacgttaaaccgttaaagttaaatttaaacggttaactaccgggtaaacccgtttaccgggaaccccttttacggtaacgggtttaccggttacccgttttaaccgggttaccccgggggttaacccgggaaaacggggggttaacccgtaaaaccggggttttcccgggtaaaagggaaacgttaacccgttaaaccggtaaaaacggggtttaacccgggcgggttttaacgggaccggttaacccg

SEQ ID NO: 243136 - DNA, 797 bp, Homo sapiens
  misc_feature: GYAE6OF02IBSOP.35.85.H08.1.454.CMB.1.raw
tcagtacagatcgtcacgaccggtgctcgatttagtatcactcagtcgcgggggaggaactgctcagttaggacccagacggaacatggaagccccagcgcagcttctcttcctcctgctattctggctccagatatcactggagaaatagtgatgacgcagtcctaccaaccactctgtctgtgtctccgagggcaagaccgcctacctcctcgtcgacggaccggtacacgtagagtaaggttagtacgagactaaccgttagttaccgtacggtacgtaaccgcgtaacggtaaacggttacggtaccggtaacgacccggcccgtacccggtaccgtcccgtacctaacgttttaccgtttgggttacgtacgggttaacgcccgttaaccggggtcccgtccgtcgggtccggttaccaccgttaccgtacgggttacgtaacggtggttacgacgggttcggtacgtccggttggggtaacggacgtacggttttacgcttacctcccgtaccaacgtctacgaccgtaccgactccggtactagtacgttaagtaacggtttaacgtttagttaccggttaagtttttacgtttaactttccgtaactaacggtacttaaagtaaattaacgtaccggttaacgttccggttacccgttaccgtaccggtacgtttacgttaccggttttaacccgggttcggtaaccggggtaaccggtaaccgtcgggtaaggtaacgacgttaacgaaaaccgtaccggtaacgggtcggttacccgtagtaacccg

SEQ ID NO: 243137 - DNA, 786 bp, Homo sapiens
  misc_feature: GYAE6OF02I2YRL.35.85.H08.1.454.CMB.1.raw
  modified_base (205)..(205): a, c, t, g, unknown or other
  misc_feature (205)..(205): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggaagaaatagtgatgacgcagtctccaaccactctgtctgtctcctccgagggaccagacncccacctctccgagcgacgggccacgtcgagtagtgttacgcgaagtcctaacgttagccgtaggtaaccaggtaccaaagggtaaacggttccgggacctaccggggtacctacccccggtaaggtcccctcccggttactaaccgttttccggttttcgggtacgttaccgtaccccgtacggttacccgggggccccgttggtttccgggttaccgtccccgtaggttccggtaacggtttcgaacgggttcggacctaggtcggttccttacgggtacgggtaactacgggtcttacccgactttcccgaacgtaccgtactccgaaccgcgtaccgtccgttacggtcttaacggttccgtaagtaaacgtttcgtttacgttaacgtttaagttttaccgttacgttcgttaaccggtactaacttaaacgttaacttaacgttaaccgtcgttaccggttacctacggtacgttcgtacgttacgtttacgggacccggtaacgggtaaccgttacggtaacggttacgggaagtaccgttaacggaaaccgttcggtacggtcgtacgtaccg

SEQ ID NO: 243138 - DNA, 719 bp, Homo sapiens
  misc_feature: GYAE6OF02GR4W8.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctaccaaccactctgtctgtgtctcgaggggacagacgccaccctctcctgcagggccagtcagagtgtagcagcaacttagcctaggtaccagcaagtaaagttggaccacggcctcccaggcctcctacattcgtttggtcgtcgtcctacggtacgggccgtcgttgggttccgtccccgtaggtcgtcggtttacgacgggtgaccgtaggtcggtcccttggtacgggaactagggtacgttccgaccttcctacacctagtccgacgctacggtccgtgtaccgtacggttacgttacgggtaaacgtttgttttacggaccgtttttaagttttaacttacgttcggtactaacggttaacttaaacgtttaataaacggtttacgaccgtttaccggggtcccttaccggttagtttacgtacccgttttacgggttttccgggaacccgggtaacggggtaaccctaacgggttacggttacgggaaacgttaacctaacgggtaaaacccggttacttgggggttacccgacgttaaccccggg

SEQ ID NO: 243139 - DNA, 729 bp, Homo sapiens
  misc_feature: GYAE6OF02G2SR5.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcaactggagaaatagtgatgacgcagtctccaacactctgtctgtgtctcgagggacagacgccacctctcctgcagggcagtcagagtgtagcagacaacttcgcgtaggtaccagacgaagaaacgtcggacgagccgtaccaggacctcctctattccgtttggtcgtcgtacctacgtacgggcctacgttcggttacctcccgtagtccgtaacgggtttacgacgggtacggcgtaacggttcgggtaccttacggtacggggtactaacgggttacgtttaccgtaaccttcgtaacccgtaacccgtaactacgacgtacctaaccggtccgtacgaccgtaacgttcgtaacgtaaacgtttaacgttttacgtaaccgtttaagttttaacgttaacttacggtaacgtaacgtaactaaacgttaaagtaaacttaacggtacgttacggacccgttacggttaacgttacgtacgttacgttttacggacccgggtaacgggtaaccgtaacggtacggttacggtaagtaaccgtaacggtaaaaccgtaacggttaggttacggaccgttaaccgg

SEQ ID NO: 243140 - DNA, 715 bp, Homo sapiens
  misc_feature: GYAE6OF02G8BGX.35.85.H08.1.454.CMB.1.raw
  modified_base (147)..(147): a, c, t, g, unknown or other
  misc_feature (147)..(147): n is a, c, g, or t
  modified_base (657)..(657): a, c, t, g, unknown or other
  misc_feature (657)..(657): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctccagtatatcactgganaaagtagtgatcgacgtcagtctaccaaacctctctacgtctgtcgtccgtaccgaggggacagacgacctaccctctctcgacgacggcctaggtcacgagttacgtagagacactaacgtacgtccgtacggtacagacgaaacgtaggttccggaccgtaggacccgtccgacggtcctccgtactacgttcgttacggtcgtccgaccgtacggtacgggtcccgtgtcggtaccgtcccgtagtcggtacggtacgtaggtcggtacgacggtggtacccgtggtacgggaactacggttaccgttactacccgtcctaaccgtaccgtaacgtcgtaacgtccggaacgtcccgtcggtacctagggtactaaaggtacgttacgtttcgtacgtttaactttcgtacgtaggtacagtactaattaacgtaatcgtaccgacggttcgtaccgtacgttcgtaccgtttacgttacgggtaccggccgggtaaacgttaccgngttaacgggaccttaacggaaccgttaaaccgtacggtttacgacgggttctaaccgg

SEQ ID NO: 243141 - DNA, 887 bp, Homo sapiens
  misc_feature: GYAE6OF02FXHC2.35.85.H08.1.454.CMB.1.raw
  modified_base (152)..(152): a, c, t, g, unknown or other
  misc_feature (152)..(152): n is a, c, g, or t
tcagtacagatcgtcacgaccggtgctcgatttagtatcactcagtcgcggggaggaactgctcagttaggacccagacggaaccagtggaacgccccagccgcagcttctcttcctcctgctacttcgtcggctcccagatatcactgganaatagtgatgacgcagtctaccaccactctgtctgtcgtccgtccgaggggactaggaccgccctaccctcgtcctgccgacgggaccagtcgaggtaggtagttacgccgaagtacctaaacgtttcggaccttacggtaaccaggtaccgaaggttaaacgttccggaccgtaacggggtccctacccggaaggtcccttacccgtcgttacgtttccggtttcggtcgttaccgtacccggaacggttacgggggtcccttcgggttaccgggtacctcccggtaacggttccgttaacgggttaccgtagggtccggtaaccggtaggtttacccgggtccggttacggttaccgggaaacgtaccggttaccggtttacctaaaccttcccgtaaccgtaaccgtaccgttaacgacccggtaccggtacggtaccgtaccggtaacggtaccgttacggttaacgttaaaggttttcgttaacggtaccgttttaacgttttacgtaccgtttacggaaacctacgttaacgttaaaccttaagttaaccgggtacgttaccggttaaaccggttcccgttaaaccggtttaacgggtaccgttaacccgtttgggttaaacccggtcccggggtaaacggggtaaccctaaccgggttaccggttaacggaaccgttaaccgaaacggtttaaaccggttaacggttcggtaccggtaggttaacccg

SEQ ID NO: 243142 - DNA, 758 bp, Homo sapiens
  misc_feature: GYAE6OF02JBIHH.35.85.H08.1.454.CMB.1.raw
  modified_base (723)..(723): a, c, t, g, unknown or other
  misc_feature (723)..(723): n is a, c, g, or t
  modified_base (753)..(753): a, c, t, g, unknown or other
  misc_feature (753)..(753): n is a, c, g, or t
tcagtacagatcgtcacgaccggtgctcgatttagtatcactcagtcgcgggggaggaactgctcagttaggacccagacggaaccagtggaagccccagcgcagcttctcttctcctgctattctggctcccagatatcactggagaatagtgatgacgcagtctccaaccactctgtctgtcgtctccgaagggggtacaaggacgtcccacccttcctacctcggcgaacgggcctaagttccgaagtacggttagttacgcgacgccaaacgtttaacgcccgttaggtacccaggtactaaacggtaaaggttccggaccgtacgggccgtacccgaacgggtcctaccccgtgtaactttcggtttttacggggtacttccggtaccgtaccggtaacggggtccctacggttccggttacggtcccctaagttccgtaaggtttccgaaggtcgggtaactcgggtcggtacccgttgacggggtaaccagggttacgtccaactccgtacctaacgtaactcgacggtaccaccggtacctcgtacctacgtaccgttaggaaacgtttcgtttacgtacgtttaagtttaacgttaacgttcggtaactaacggtactaaagtttaagtaaacgtaggttaccgtcgttaccgcgttaacgttccgttacgtacggtttacggaccgttagggaaccttacgtacggacggtanacgtaacgtaacggtaacgtgttaccggtnaccgg

SEQ ID NO: 243143 - DNA, 658 bp, Homo sapiens
  misc_feature: GYAE6OF02IC9FX.35.85.H08.1.454.CMB.1.raw
  modified_base (373)..(373): a, c, t, g, unknown or other
  misc_feature (373)..(373): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatagacgcagtctaccaaccactctgtctgtgtctccgaggggacagacgccacctctctgcgagggccagtcagagtgttgcagctaacttagccgtggaaccagcgaagtaagtcggaccaggcctacccgaggtctcccgtactacttcgtttggtagtcgtccgacggtacgggtaccgtcgtcgggtcgtacccgtaggtcgtacggttacgnggtcggacgtaggttcggacgttcggagggacgtagtacgttacctaacgtctaccgtaacctactcgacgtacacgtcccgtagtaccgtacgttacgtaacggtaacgttaacgttttacggtaccgtttacgttttaacgttacgttacggacgtaacgtaactaaagttaacgtagtacgtcgttaccgccgttacgtagtacgtcgttacgtttccggaccggtaacggaccgtagtcgtaggacgtacgtaacgtaacgtacgtacggtcggataccgg

SEQ ID NO: 243144 - DNA, 684 bp, Homo sapiens
  misc_feature: GYAE6OF02HF6KK.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgccaccctctccgtgcgacgggccagtcgagagtgttacgcagctaacgttgccgttaggtaccaggacgtaagtaaacggttcggacccgtaaggccctaccccgacggtccttccccgttactacgttttcggttttcgggtcgttccggtacccgtaaccggtacggggtccgtaccgttcgggttcgttacccccgtaggttcgtaacggggtttcgaacgggttggacgtacgggtcggttccgtacggttaggggaactaacggtacggttcaacctcctacgacctacgtcgacgacgaccgtccgtacgacgtacgtacgtacggtaagtttacgttcgtacttaagtttacttacgtgtacgatataataagtaatacgtcgtcgtactcgtacgttgaccgttcgtttacggacggtaacggacgtacgcggtacgacgacgtaacgaaccggtagtacggtcggtacgtcg

SEQ ID NO: 243145 - DNA, 703 bp, Homo sapiens
  misc_feature: GYAE6OF02HD1LZ.35.85.H08.1.454.CMB.1.raw
  modified_base (287)..(287): a, c, t, g, unknown or other
  misc_feature (287)..(287): n is a, c, g, or t
  modified_base (380)..(380): a, c, t, g, unknown or other
  misc_feature (380)..(380): n is a, c, g, or t
tcagtacagatcgtcacgaccggtgctcgatttagtatcactcagtcgcggggagagctctggggaggaactgctcagttaggacccagacggaccatggaagccccagcgcagcttctcttcctcctgctattctggcctcccagatactcacgtggagtaaatagtgatgacgacagtcctaccaactctctgtctgtctcgtacgagggacagcgccaccctctccgtgacgacggccagtagagtagtgttagcgatactaaacgttacgccgtagtaaccgngactaaggtaagttcggaccgtacggcctacccggcggttcctacgtacctagttttccggttggtcgtccgtacgaaccggttcggcccgtnttccggtaccgtaccgtgtaccgttggttacctaggtcggtacgtaggttcgtacgttaccggtcggtaaccgtaggttcccgtttaccgcgttaccgtaaccgacctaagccgttagaccgtaccggtacctacgtacgttaacgtgttaaacggttacgtttacggtttacggtaacttttcgtttaaggtttaacccgtccgttaagtaacgtaattaaacttaaggtaaaccgttgtacccgtcggtaccttggttaaccgtcttaccgttcgttacggaacgtacgtacgaacgttggactaggtaccgtacgtaacg

SEQ ID NO: 243146 - DNA, 824 bp, Homo sapiens
  misc_feature: GYAE6OF02FYA5N.35.85.H08.1.454.CMB.1.raw
tcagtacagatcgtcacgaccggtgctcgatttagtatcactcagtcggcggggagagctctgggaggaactgctcagttaggacccagacggaaccatggaagccccgagcgcacgccttctccttccgtcctgccttattctggctcccagatatcactggagaaatagtgatgacgcagtctccaaaccactctgtctgtcgtcctccgagggacaggacgcccacccctcgtcctcgcacgggtccagtccagacgtggttacgcagtccaacgtttagcccgttagggtaaccccacggtccgaaacggtaaaacggtttccgcccgtaacgggtcccttacccgaaggtcctacccgtacacgtttcccgttttaggggtcgttacgggtttaccccaacggttaaccgggggtcccgtaccggttacggggttcccggtttaccccgaacggggtttcccgtaaccggggttttaccaaacgggtttcggtaccggtaacggggtttacccgggacccgtttacccggtaacgggggtaaacctacggttaaccggtttacccgttaaccctacccgtttaacccgaaccccgtaaacccgttaccggtaaacggtacccgtaaccggtcccgtaccggtaccgttaccggttaccgttaacggtaaacgttacgttttccgtacgtttacgtttacgttaccgttacggttacgtaacgtactaacgttaactaacgtcgtacgtacgtaccgtcgtacgttcgtccgtacgttcggaccgtacggtacgacgacgtacggactacgtacgtaacg

SEQ ID NO: 243147 - DNA, 721 bp, Homo sapiens
  misc_feature: GYAE6OF02J1GL9.35.85.H08.1.454.CMB.1.raw
  modified_base (120)..(120): a, c, t, g, unknown or other
  misc_feature (120)..(120): n is a, c, g, or t
  modified_base (183)..(183): a, c, t, g, unknown or other
  misc_feature (183)..(183): n is a, c, g, or t
  modified_base (224)..(224): a, c, t, g, unknown or other
  misc_feature (224)..(224): n is a, c, g, or t
tcagtacagatcgtcacgaccggtgctcgatttagtatcactcagtcgcgggggaggaactgctcagttaggacccagacggaaccatggaacgccccagcgcagcttctccttcctctnctactctggcctccggaaggaacccacgtgggaactaaacagtagagtgaacgccgtagtccnccacgacctactcctctgtcgtacgtccgtacggagggganacgaccgccctaccctcgtactcgacgccgggctacggctaactaccttattaaccgtacctaccgtacgttccgtaggtactaccgtacgacgtaacgtaccgtaggtaccgacggtacccgaccgtaccggcccttaacgtccgtatccgtaggtggtacgactacctccgacccgtacgggcctacggtaccgtacgtaccgtaccgaccgtacggtacgtacgggtgtacgggtagggtacggtccggtacggaacgtacggttacgttacgtacttaccgactccgtaacgccgacgtaccgcgtaccgtcgtacgtcgtactacgtagtacgtttacggttacttagtttacgttacttcgtagtccttagtaccgttatacggttactaaccggttcgtaccgtcgttcggttacggtaccggtacggacggtacgtacggtaggccgtacgaacctacggtctaggcgaactcggactacgtacttccg

SEQ ID NO: 243148 - DNA, 811 bp, Homo sapiens
  misc_feature: GYAE6OF02F41O2.35.85.H08.1.454.CMB.1.raw
  modified_base (178)..(178): a, c, t, g, unknown or other
  misc_feature (178)..(178): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctntctgtgtctccgaggggacagacgcccaccctctcctgccgaggcctagtcaggtagtgttagcagactacgttacgccgtcggtaaccaggactaaggaagttccggaccgacggtcctacccgacggtcctccctcgtgttaccgtttggtggttaccgtccgtacggtacgggcccggtcgttacgggttccgtaccccggtaggttaccgaaggtttcgacgggtcggtagtacggggttcggtacgtacggtcgggtaaaccgtaacgtacggtttcccgaactttccgtaacccgaactaccgttacgaaccgtaccgtacgtaccccgtagtaaccgtaacggttacctaaggaagtttacgttttaccggtactttaacgttttaaactaccggtttagtaaccgtacgtaaacgttaaattaacggttaaaacgttcccggttaccgggttacgtaaccccggttacggttaaccggtttcgtaacccgttttaccggtttacccgggaacccggggttaaagggaacccgttaaaccggggttccggttaaacgggttacccgtaacggttaaacccggtaaacccggttaacggtaccggggttacgtaccccggttaacgg

SEQ ID NO: 243149 - DNA, 753 bp, Homo sapiens
  misc_feature: GYAE6OF02GT3YG.35.85.H08.1.454.CMB.1.raw
  modified_base (546)..(546): a, c, t, g, unknown or other
  misc_feature (546)..(546): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctcccagatatcacgtaggagaaataggttgatcggaccgcgagtcctacccaaaccgtactccttacgttctggttcgttaccgtaccgaagggggaccacggaaccgaccctaccccttccggtcctcgacgaacgggccctaggtaccgaggtaaggttggttaacgcgtacgtaactaaccgttaacgtccgtccggtaacacgtacgaaaggttaacggtcggaccgacggtcctacccgacggtcctaccgtctacgtttcggttttaggtcgttccggtaccgtacggtaccgggccgtcgttcggtccgtacccgaggttccgtacggttacgacggtcgacgtagggtcgtaacgtcggaaggtacgtacgttcgtacaccttacctccgtaacgtactccggtaacnccggacgtccgacgtaccgtagttaccaggttaacgttagtttaccggtattttaacgttacgttaccgtagtcgaaacgttaacgttaacttaacgttacgtaacgtcgtaccgtaccgtggtaacttcgtacgttcgtacggtacggtaacggacttacgacggttgaacgtacgtacgaacgttacgtcggtacgtctaaccgg

SEQ ID NO: 243150 - DNA, 808 bp, Homo sapiens
  misc_feature: GYAE6OF02G5FVQ.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctaccaaccactctgtctgtcgtcctacgagggacagacgccaccctctctgcacgggccagtcagtagtcgtagcagactaacgttagaccgtaggtaaccaagacctaaaggtaaacggttcggaccgtaacgggtccttacccggaacgggtcccttaccgtaccgtatttccggtttcggtacggtcgtaccccgaacggttacggggtcccgtcggttacgggtccgtaccccgtaagttccggtaagggtttacgtacggtcgggtacgagggttaaccggtcgtacccgggttaggggaaacctagggttaacgttactaaccggtttctaccggtaactactacgtacgaccgtacgtccgtacgtactacgtacgtaacgtaagttagtttacgtacgtttacgtttaaacgtttacgtacggttaacacgtaaaacgttaacgtattaaacgttccgtaacggttaccggttaacccggttaccgttaaagggtttccgtaacccgttttaggtttacccgggtaaccgggaaaccggggttaaacctaacggggtacgttaaccgggtaacggttaaaccttaaccgggaaaacggtttaaccccgtaggtttaaccggtccgtaaacccggg

SEQ ID NO: 243151 - DNA, 782 bp, Homo sapiens
  misc_feature: GYAE6OF02GJIX8.35.85.H08.1.454.CMB.1.raw
tcagtacagatcgtcacgaccggtgctcgatttagtatcactcagtcgcgggggaggaactgctcagttaggacccagacggaaccatggaagccccagcgcagcttctcttcctcctgctattctggctccagatatcactggagaaatagtgatgacgcagtctaccaaccactctgtctgtgtctccgaggggacaggacgccaccctctccgtgcgacgggccagtcagtagtagttagcagacaacttagcctggtaccagcgaagaaacgttggaccaggctcccgaggctacctacattccgtttggtcgtcgtccaacgtaggggcccgacgtgggtaccgtccctaagtcgtacggtttacgaggttcggacgacggtggtcccgttacggtacggggaacctaaggggttaacgttaccgtaacgttaccttaccgaaccgtaacgttaccgaacggtaccgaaccggtaccgtacggtaccgtaaccggttacgttacggtaaacgtttacgtttttacggaaccgttttaacgtttttaaacgttttaaccgttaacggtttaaccggaacggtaacccgttaaaatttaaacgtttaaaagttaaccggtaccgttaaccgggtacccttacccggttaacggtttaccggttaccgttaaccggttttttcggaacccggtaacggggtaaacccgtaacgggacggttaacgggtaacgtaaacgtaccggtaaaaccggtaaccgttaggtacggtacgtaaccgg

SEQ ID NO: 243152 - DNA, 773 bp, Homo sapiens
  misc_feature: GYAE6OF02JGY5P.35.85.H08.1.454.CMB.1.raw
  modified_base (184)..(184): a, c, t, g, unknown or other
  misc_feature (184)..(184): n is a, c, g, or t
tcagtacagatcgtcacgaccggtgctcgatttagtatcactcagtcgcgggaggaactgctcagttaggacccagacggaaccatggaagccccagcgcagcttctcttcctcctgctattctggcctacccagatatcacgtggaagaaataggtgagtacgacgcagtcctccaaccactnttgtcgtgtacgtcctccgaggggacaagcgccctacccgtctcctcgacgacgggcctaacgtcgtaagtggttagttacgactagtaaccgtaacgttacgaccggttacgtaaccgaagtccgtaaaggtaaacgttcggaacccgtacggtccccgtacccgtaggtccctcccgtacttacgttcgtttggtcgttaccgaccgtacggtacggtccgtacgttacggcctacccgtaggttccgtaaccggttgtaacgggttccgggacgttaacggtccgggtacgttaccgtaagggaccccgtaggtaccgttacccggtcgttaccctaacccgtaaccgtacgtaaccgcggttaacggacgttaccgtaccgtaaccgtaccgttacgtaacggttaacgtttaactttaccggttaacgttttaagtttaaaccggttctacgttaccgtaacgtaagtaaacttaggtaaactcgtacccgtagtccgttacgtacgtcggtcgttacggtcggtaccggtacggaactacgcgtagtacgaacttacgaaacggtttgacggttcgagtaccg

SEQ ID NO: 243153 - DNA, 823 bp, Homo sapiens
  misc_feature: GYAE6OF02HE3U4.35.85.H08.1.454.CMB.1.raw
tcagtacagatcgtcacgaccggtgctcgatttagtatcactcagtcgcgggggagagctcgtggggaggaactgctcagttaggacccagacggaaccatggaagccccagcgcagcttctcttcctcctgactatttcgtggcctacccagattactccacgtagggaaagtaaacgtagtaggtatagaaccggtcagttacctaccccaaccgtaaccttcgttgttcgtggttacgtccgaccggtagggggaccaaggtacgaccccctaaccccttccctccgtcggacccgacggggcccctagggtacctaaggaaggttcgtttaaccggaccgaagtaccttaaaacgttacgtccgtaacgggtaaacccgtagaaccgaaaggttaaacggttaccgggaccgtaaccgggttcccacccggttaccggtacctccccgttataccggtttcgttcgggtacggtttcgtacccggttaaccggtcggggtacccgtcggtcgggttacctcccgaaggttccgtacgttggaacgtggtaaccgtggtcgtcgttccgggaggactaggtaccgtctacgtctacaacgtacttcgaagcccgtacgacctccgagttcgtacttaacggtaattgttacttacgttacttagttaccgtgtactagaattaacgttataaacggtctacgggtacgtacccgttacggttaccgttcggaaaccgttttggttaccggaaccggtaacggggtaaccctaacggggttaccgtaacgggtaacggtaaccgttaaaccgggtaaccgg

SEQ ID NO: 243154 - DNA, 1091 bp, Homo sapiens
  misc_feature: GYAE6OF02I5PAT.35.85.H08.1.454.CMB.1.raw
  modified_base (162)..(162): a, c, t, g, unknown or other
  misc_feature (162)..(162): n is a, c, g, or t
  modified_base (177)..(177): a, c, t, g, unknown or other
  misc_feature (177)..(177): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctattctggcctccagatatcactggagaaatgtgatgacganagtcctaccaaaccncttctcgtacttagtcgtcctccgaaggggacacgaccgcccacccttcttccgtcggaccgacgggaccctagtacgaggtacgttaggttacgacgtaagaccgtaaacgttacggaccccgttacggtaacccgacggtaccgtaaaggtaaacgggttccgggacccggtaacgggtaccccgtaccccggtacggtacccttaccccgttaccgtacgttttaccggttttcgggttacggtccgtttaccccggtaccggggttaccgggtccccgggttaccgtttccggggtacccggttaccccgtacggttaaccgggttacgggttacggtaagggttccgggtaccgtacggggttaccgggtcggtttaaccgggtaaccggggtaacgtaacggtaaccgggtttaccccgtaaacccgtttcccgtaaaccccgtaccgtttaacccggaccggtaacccgtaaccggtaccccgtacccggtttaccggaacgtacggtttaaccggtaaggtttaacggttttaacgtttttacggtttaacccgtttttacggggtttttaaaccttttacccggttaacggtttaacccggttaaaccgggttaaaccgttttaaaacggtttaaacgtttaaaccggggtttacccgggtttaaaccgggttacccgggtttaaacccgggtttacccccgggtttaaacggggtttccccgtttaaaccgtttttacccccggggtttaacgggtaacccccggggtttaaaacccggggaccgggtttaaacccggttaacggggttaccgggtaaaccggtttaaaacccgggttaacccggttaaaaaccggggttaccggtttaacccgggggttacggttttaccccggtaaccccgg

SEQ ID NO: 243155 - DNA, 675 bp, Homo sapiens
  misc_feature: GYAE6OF02I65YI.35.85.H08.1.454.CMB.1.raw
tcagtacagatcgtcacgaccggtgctcgatttagtatcactcagtcgcggggaggaactgctcagttaggacccagacggaaccatggaagccccagcgcagcttctcttcctcctgctattctggcctcccagatatcactggagaaatagtgatgacgcagtcctccaacctactctgtctgtgtctccgagggacagagccaccctctcctgacacggccagtcagagttcggtagacagactaacttagcctaggtaccagacaagtaaagtcggccacggctaccgacggcctacctcgtacgttcgtttgtcgttcgtaccgtacgtacgggcgtcgttcggtcgtcctagtcgtacggttacaggttcggacgtaggtcggtacgtcggtacggacgtagtacgttaccgaaccgttcgtacctacacgttacacgacgacgtcccgtgtcgtacgttacgtagtaacgttagtttacgtgttagtttacgttacgttacgtacgtaagtaacgttaattaaagtaaacgtacgtacgttaccgtcccggttaacggttaacgttacggttaccgttaccggttttacggacccgggtaacgggtaccgtaacggtacggtaacggtaacgtaactaacgtaaacgtacgtcggttaggacgtaccg

SEQ ID NO: 243156 - DNA, 733 bp, Homo sapiens
  misc_feature: GYAE6OF02GMEUT.35.85.H08.1.454.CMB.1.raw
  modified_base (297)..(297): a, c, t, g, unknown or other
  misc_feature (297)..(297): n is a, c, g, or t
  modified_base (454)..(454): a, c, t, g, unknown or other
  misc_feature (454)..(454): n is a, c, g, or t
  modified_base (467)..(467): a, c, t, g, unknown or other
  misc_feature (467)..(467): n is a, c, g, or t
tcagtacagatcgtcacgaccggtgctcgatttagtatcactcagtcgcgggggaggaactgctcagttaggacccagaccggaaccatggaagccccagcgcagcttctcttcctcctgctattctggcctcccagatatcactggagaatagtgatgacgctagtctccaacctactctgtctgtcgtctccgagggacagcgacccacctctcctagcgacgggtcagtcagtgtgtagcatctaacgttacgtccgtacggtaccgagacaaggtaaggttgaccgaggtccnccgtaggcctaccgtacgactttcgttaggtgttacgtacctacggtacgggccgttcgtaggtttccgtacccgtaagtcggttacggttatacggggtgacgtgggtacggtacggtagggactaaggtacgttcctacgttccgaccaaccgtntacgacacgtccncgtcgactagttcgacgttagtacggttatttaggtacttactttagttacctgttaacgtacgttacctaagttacgtaagtacgttaaccgtccggttacccgttacgggttaaccgggttacccggttaacggaccgggtaacccggggttaaccgggtaaacgggttacccgggtaaaccggtaaacccggttaaaccggtaacccggtttcgggtaccgttttaccggacgtaacccccggttacccacggttttaacccc

SEQ ID NO: 243157 - DNA, 887 bp, Homo sapiens
  misc_feature: GYAE6OF02FLNA2.35.85.H08.1.454.CMB.1.raw
  modified_base (152)..(152): a, c, t, g, unknown or other
  misc_feature (152)..(152): n is a, c, g, or t
  modified_base (185)..(185): a, c, t, g, unknown or other
  misc_feature (185)..(185): n is a, c, g, or t
  modified_base (406)..(406): a, c, t, g, unknown or other
  misc_feature (406)..(406): n is a, c, g, or t
  modified_base (701)..(701): a, c, t, g, unknown or other
  misc_feature (701)..(701): n is a, c, g, or t
tcagtacagatcgtcacgaccggtgctcgatttagtatcactcagtcgcgggggaggaactgctcagttaggacccagacggaaccatggaagccccagcgcagcttctcttcctcctgctactctggctccgaggaaccactggagaaacngtgatgacgcagtactccacgcctactcccgtntactgtcgtctccggaggggatacgacgtccccacccttccttaccgtgcgacgggtcccacgttacgaacgtacgttaactttaaccgtaaccctaaacgttcgacccttaggttactacgaacgaccgaacgtaaaccgtacggttccgaaccgggcccttacccccggaggttcccttaccctactaacttacgttagttacggtaccgacgtaaccnccccgaaccgtaccggggtacccttacgggttaccgtacccgtccccgacggtccccggttaccgttacggtaagggtcggtaccggttcgggttcggggtttaccggtaacgggtactaaccgggttacccgtttacccaccgtttacctaaaccctaccgtaacctcgggtaacacccggtaccgtaccccgtttggtacccgtaacctttaccggttaggttaccttagttttaaccgggttttataccccggtttttaaagtttaccccggttttaagtcccgttaaagtntaaccttaacgtttagtaaacgttaacgttaacggtcccggttcccggttaacggtacccgggttttaacgggacggtaaacccggggtaccggaaccgggttaacgggttaacccgaacggttaaccgtaaccggtacgttcggtaacccgttagtacccgtaccgttacctacgttttaacccg

SEQ ID NO: 243158 - DNA, 764 bp, Homo sapiens
  misc_feature: GYAE6OF02HUY9N.35.85.H08.1.454.CMB.1.raw
  modified_base (204)..(204): a, c, t, g, unknown or other
  misc_feature (204)..(204): n is a, c, g, or t
  modified_base (714)..(714): a, c, t, g, unknown or other
  misc_feature (714)..(714): n is a, c, g, or t
tcagtacagatcgtcacgaccggtgctcgatttagtatcactcagtcgcggggaggaactgctcagttaggacccagacggaacatggaagccccagcgcagcttctcttctcctgctattctggctccagatatcactggagaaatgtgatagacgcagttctaccaacctactctgtctgtgtctaccgaggggacagtacnccctacctctctcgcgacgggtcagtcgagtacggttgtacgacacgtactaacgttacgccgtacgtacagacgtaagtaaggtcgacacggtcctacccgaggtccttaccacgttacttccggtttaggacgttccggtaccccgtaggtaccggggtcccgttcggtcgggttaccgtaccccgtagggtaccggttacggggttaacgtacgggtttacgggaccgtaacggttcgggtacccgtttcgggtaacggggtacaagggtttacccttaccggtccctttaccgtaccgtaaccctagtaccgacgttccgacgtacccgttgttaccgacgtttacgacgtttaaggtttaccgtttcgtaacgttttacggtttaacttacggtggttaacaaccgttaagttaaatttacgtaaccgttcggtaccggtaccgttcccgggttacgttaggtacccgttccgttttacggggttacgaaccgggaacggtaacncggtaacggttagacgtaacgtacgtaaaccgtggtagcctaccgtacgg

SEQ ID NO: 243159 - DNA, 807 bp, Homo sapiens
  misc_feature: GYAE6OF02G0TEE.35.85.H08.1.454.CMB.1.raw
  modified_base (178)..(178): a, c, t, g, unknown or other
  misc_feature (178)..(178): n is a, c, g, or t
  modified_base (188)..(188): a, c, t, g, unknown or other
  misc_feature (188)..(188): n is a, c, g, or t
  modified_base (216)..(216): a, c, t, g, unknown or other
  misc_feature (216)..(216): n is a, c, g, or t
tcagtacagatcgtcacgaccggtgctcgatttagtatcactcagtcgcggggaggaactgctcagttaggacccagacggaaccatggaagccccagcgcagcttctcttcctcctgctattctggctcccagatatcactggagaaatagtgatgacgcagtctccaaccactctntctgtgtccnccgaggggacagacgcccaccctctccngcgagggccagtcagagttgttagcagacctaacttacgcctggtaccagtccaaggaaaggttcggcccaacgggtcctacccccgaggtcccttccccgtacgtacgtttccgtttacgggtcttcggtaccctaccggttaggggtaccccgtcggtttacgggttccggttaaccccgtacggttaccgtacggttttaccgtaacggttcggggccgtaacgggtccgggtacgttccggtttacggggaacttaggttacggttacctaccgtttacccgacccgtacctacgttaaccgtacgaccgtaacggtcccgttacgaccgttacggtcggtaacggttaaggtttaacgttttacggtaccgttttaaacgtttttaaccgttccgttaccgttaccttaacgtaaacttaacgttaacgtttaaacgtaccggttacgtaccgggttcccggttaccgttaacgggttaccgttacgtttacccggttcgggtaaccggtaccgggggaacctacggtacggtcggaaagtaccgtaaccggttaacgtaccggtcggttaccggaccgttaacgg

SEQ ID NO: 243160 - DNA, 792 bp, Homo sapiens
  misc_feature: GYAE6OF02GIBMH.35.85.H08.1.454.CMB.1.raw
tcagtacagatcgtcacgaccggtgctcgatttagtatcactcagtcggcggggaggaactgctcagttaggacccagacggaaccatggaacgccccagcgcagcttctcttcctcctgctattctggcctcccagatatcactggaagaaagtagtgatgaccgcacgtcctaccaacctactctgtctgtcgtcctccgagggacagacgccctacccgtctcctgcgacggtccagtcgagtagttgttacgctacgtactaacgttacgcgtacggtaccagtacgtaaggtaaggttccggaccgacggtccctacccgagcccttaccgtacctcgtttacgtttggtacgttccgtaccgtacgggtaccgggccgtcgttcgggtaccgtacccgtacgtcgtacggttcgaggtcggacgtggtcgtacgtcggtacggtaacgtagtacgttacctaccgttaccacctaaccgacgtacgacgtccgtacgtaccgtacgtcgtaacgttccgtaaggtaacgttttacgttttcggtaacgttttaacgttttaaccgttaccggtcttaaccggtaaccgttaactaaaagtttaaacgttaacggttacgtccgtttaccccgggtaaccgtttaccggttagttaacccgttaccgttttcccgggtttaaccggggacccgggtttaaaaccggggtaccctaggggtaacccggtaggtaacctaaacggttacggttaaaccggttacggtacggttaccggtactaacccgg

SEQ ID NO: 243161 - DNA, 921 bp, Homo sapiens
  misc_feature: GYAE6OF02G7ZFL.35.85.H08.1.454.CMB.1.raw
  modified_base (637)..(637): a, c, t, g, unknown or other
  misc_feature (637)..(637): n is a, c, g, or t
tcagtacagatcgtcacgaccggtgctcgatttagtatcactcagtcgcgggggagaactgctcagtaggaccagacggaaccatggaagcccagcgcagcttctcttcctctgcttattctggcctccagatatcacgtaggaataaataggtagatggacgcagtctaccaccactctgtctgtcgtcctaccggagggacaggacgcccctaccgtctccgtacggaccgtacgggacctaggtacctaaggtaggttacggttacgaccgttaacgtaaccgtaaacgttccgggtaccgttaacgggtaaaccgtaacggaacgggttaaaacgggtaaacggggttccgggaaaccccggtacgggtaaccccttacccggggtacggttaccccttaaacccgtacggtttaacggtttccggggttttacggtacgttaacccggttacccggtaaacgggtaccgggtccggttacgtaccgggttaaccgaccccgttaggttaacccgggttacggttacggaacggggttcgacgttacgggtccgggttagttccgggaaaggtaaagaccggttaaggttacccaaccggtttacctaccgaacgtactacggaccggtaacnccggtaaacccgtgtaccgaaggttaaccgttaaaggtaacggttttacttaagtttaccgtttaacggtttaacctcgtacgtaacgaagttaacttaaaggtaaccgtaaggtacttacccggttcgttaaccggttacgttaccggtacttaaccgggtttaccggttaacgggaccgggggttttaaaccaacgggtaaccggtttaagggtaaaccgggtataaaaccggttaccggttaaaaggtccggtttacggggtacccttacccggggaaacc

SEQ ID NO: 243162 - DNA, 722 bp, Homo sapiens
  misc_feature: GYAE6OF02GTBFW.35.85.H08.1.454.CMB.1.raw
  modified_base (678)..(678): a, c, t, g, unknown or other
  misc_feature (678)..(678): n is a, c, g, or t
tcagtacagatcgtcacgaccggtgctcgatttagtatcactcagtcggcgggggaggaactgctcagttaggacccagacggaaccatggaagccccagcgcagcttctcttcctcctgctattctggctcccagatatcactggagaaatagtgatgacgcagtcctaccaaccactctcgtctgtcgtcctccgaggggacaggacgccctaccctcgtcctgccgacgggcctaagtcacgtagttagttacgacgtaacgtactaacgttacgccgttacggtaccagacgaaggtaaacgttcggaccgaggtccctaccgaggtcctaccgtacgtacgtttcgttcggtcgtcgtaccgtacggtacggtccgtcgttcgggttcctacccggtagttaccgtaacggtttcaacgggtcggtacgtacgggttcggtaccgttacgggtacgggaacgtacggtacgttccgtacttccgtaaccacctagtccgaacgcgtcggtcctcgacgtacgttcgtaggtaactttcgttacgtagtttacgtttacgtacgtcgtaacgtattaactaaattacgtaagtccgtacgttccggtacctcggtagttactaccggtttcgttacgggaccgggtaacggtccgtaaggtccgtaacggtaanaaccgttaaccggaaaccggttgttacgggaccttacgtaccgg

SEQ ID NO: 243163 - DNA, 697 bp, Homo sapiens
  misc_feature: GYAE6OF02GG544.35.85.H08.1.454.CMB.1.raw
  modified_base (238)..(238): a, c, t, g, unknown or other
  misc_feature (238)..(238): n is a, c, g, or t
  modified_base (666)..(666): a, c, t, g, unknown or other
  misc_feature (666)..(666): n is a, c, g, or t
tcagtacagatcgtcacgaccggtgctcgatttagtatcactcagtcgcgggggaggaactgctcagttacggacccagacggaaccatggaagccccagccgcagcttctcttcctcctgctattctggctcccagatatcactgagaaatagtgatgacgcagtcctaccaaccacgtctgtctgtcgtctcgaggggacagacgccaccctctcctgcgacgggccaggtcaggngtagttacgcagactaactttacggccgttacggtaccaggactaaaggtaaacggttcggaccacgggtcccttaccccggaggtcccctccttaccgtacgtttccgttttgggtcggttaccgtacccgtaaccggtcggggtcccgtcgttacgggtccgttccccgtaaggttccgtacggtttcgagggttcggacgtaggtcggtcgtcggtagggactaaggttcgtaccacgttcctaccacctagtccaacgccggacgtccccgttagcccgtaaggtccgtaagtaaccggttttatttcggtaactttaggtttacttacgtcgtaacagtaactaattaacgttacgtgccgtacgtacctaggttagttacgtccgttacgttacggccggtaacggacacgggtctaggtanaaccgtacgaaacggtctggtacgtctaccg

SEQ ID NO: 243164 - DNA, 903 bp, Homo sapiens
  misc_feature: GYAE6OF02HC8AK.35.85.H08.1.454.CMB.1.raw
  modified_base (109)..(109): a, c, t, g, unknown or other
  misc_feature (109)..(109): n is a, c, g, or t
  modified_base (202)..(202): a, c, t, g, unknown or other
  misc_feature (202)..(202): n is a, c, g, or t
tcagtacagatcgtcacgaccggtgctcgatttagtatcactcagtcgcgggggaggaactgctcagttaggacccagacggaaccatggaagccccagcgcagcttcncttcctcctgctattctggctccagatatcactggacgaaatagtcgatgacgcagtctccaaccactctgtactgtgtactccgaggggacngacgcccacccgttctccgtgccgtacgggaccacggtacgacggtaggttcggttacgacgtaggacctaacgtttacggcccttaggtaaccacggtacctaaagggtaaaacggtttcgggaccccgaagggtcccttaccccgaacggggtcccttaccccgttacgtaacgttttaccgttttggggtaccgttacggttaccccgtaaccgggtttacgggggcccctaacggttcggggttaccgtcccccggttaaagttccgggtaaccggggtttttaccgaacgggttcggggtaccgtaacgggttcggtaacccggtttcggtacgggggtaaacgtacgggtttacgtttaccggtaaaccctttaccggtttaccgaaacccgtttacgtaccggtaacgtacccggttaacggtccccgttacggtacggttacggttacccggtaagggtttaaacggtttacttttacgggtaccgttttaaaggtttttaccttacgggtgtttaccgaacgttaacgtaaacgtttagtaaacggttactcggttaacgttacccgttacggtaggtttcttaacggtttcggtttaccggaacccggttagggtaaacccgttacgacgggtttacggaacggtaacttaaccggtaaaaccggttgttcgggtacgggttacctacccg

SEQ ID NO: 243165 - DNA, 749 bp, Homo sapiens
  misc_feature: GYAE6OF02FZK2L.35.85.H08.1.454.CMB.1.raw
  modified_base (191)..(191): a, c, t, g, unknown or other
  misc_feature (191)..(191): n is a, c, g, or t
  modified_base (245)..(245): a, c, t, g, unknown or other
  misc_feature (245)..(245): n is a, c, g, or t
tcagtacagatcgtcacgaccggtgctcgatttagtatcactcagtcgcgggggactgcttcagggcagttggtagatgcccctctgggagagatccccaggggtgacagccatggaccctggaagggcctgggctagggacagggaccagagccagtccagggagaggacagagccaatggactggggtntactgtaacagccctgctggcgagagggaccagggccaccgtcctccgagggcncccatgctgcaaggtcggcagacggtcgccctgaacctgaacggccaatgacgaccaagacaggccaaggtggtgtgacgaccctggaggagcgtcgggccctcggtcccgaggcaggccgcgtccggcccctgcgtcgcctggtcgtcgggtcgtcggccacgttccgggtccgcccgtaggtcccggtaccgtcggtccgttccggacccgtacccgtaaggttccgggttaccgacccgaacccggacggaaacccgggcccgggggaacccccgaaccgggtaccccggtacgggtaccggtccccgttaccggtaacgggtttaccgggaaccgtaaccggacccgacccgggtaacgtaccccggtaaccggtccccgggttacggaacccggggttacccgtcccggggttacggggttaccgggggtacccggtaccggggtaccccggaacccggaacccccgggtaccccggtaaccccccgtaaacccccggg

SEQ ID NO: 243166 - DNA, 812 bp, Homo sapiens
  misc_feature: GYAE6OF02J222D.35.85.H08.1.454.CMB.1.raw
  modified_base (102)..(102): a, c, t, g, unknown or other
  misc_feature (102)..(102): n is a, c, g, or t
tcagtacagatcgtcacgaccggtgctcgatttagtatcactcagtcgcggggaggaactgctcagttaggacccagaccggaaccatggaagccccagcgnagcttctcttcctcctgctatctgactccagatactcagtgaagaatagtgaatcgacgactatacctaccaaccctaccgtcgttcgtcgttacgtcgtaccgttaccggaacgggtactacgaccgccccctcccgtactcctggccgaacgtaccgtagtacgaagttgttaccgtacgactaagtacccttaaagttcgaccgttacgaaccgacgtacgtaaggtaaccgttcggacccacggtcccgtaaccgcgtccttccgtcttaacgtttcggtttacggtccgtttcgacccggttaacgtcccggggtacccgtcgggtttcgtaaccccgtacccggttcggtacgtcggttaccggagggttgacggtcggttccggtcggttaccggacgttaaaccggggcggtttaaccgttacccggacctttacccgaacccgtacccgttaccgtaccggtaccgtaccggtaacccggtcccggttcgtaccgttaccggttacggtaaccggtttaccttaagtttaccggttacgttttaacgtttaacgttaacgttacgtaccgtaaccgttaattaaacgtaacgttaccgttaacggtcgttccgtaccggtcgtaacgtcgtacgttcgtacgacggtaacggtaccacggtcgacgaagtaacgtacgtaccgtgaacgttcgcgtacccg

SEQ ID NO: 243167 - DNA, 681 bp, Homo sapiens
  misc_feature: GYAE6OF02JS37Q.35.85.H08.1.454.CMB.1.raw
  modified_base (130)..(130): a, c, t, g, unknown or other
  misc_feature (130)..(130): n is a, c, g, or t
  modified_base (140)..(140): a, c, t, g, unknown or other
  misc_feature (140)..(140): n is a, c, g, or t
  modified_base (167)..(167): a, c, t, g, unknown or other
  misc_feature (167)..(167): n is a, c, g, or t
  modified_base (274)..(274): a, c, t, g, unknown or other
  misc_feature (274)..(274): n is a, c, g, or t
  modified_base (544)..(544): a, c, t, g, unknown or other
  misc_feature (544)..(544): n is a, c, g, or t
  modified_base (591)..(591): a, c, t, g, unknown or other
  misc_feature (591)..(591): n is a, c, g, or t
  modified_base (641)..(641): a, c, t, g, unknown or other
  misc_feature (641)..(641): n is a, c, g, or t
tcagtacagatcgtcacgaccggtgctcgatttagtatcactcagttcggcggggaggaactgctcagttaggacccagacggtaaccatggaacgccccagcgcagcttctcttcctcctgcttattcnggctcctagntatcactggagtaatagtgatgaacgnacgtcctaccgaaacctcgtcttgcgttgttacgtctaccggaggggacagaccggtcctacccgtctcctgacgacggccagttcaagtgttacgttagaccgtanacttaacgtcgtccgtaacgggtaccacgtaactaacgggtaaacgttccggaacccgacggacccgtaccctaccgggtaccttccggaccttacggttcgtttacggcgttcgtaaccgtaggtaccggtcgtcggttaacggtcctacccggtagtccgttaacggtctgggtacggtaccaggtcgggcctgggacgaaagtgtttacgtaccacgtttcacgacctacgtactacgacacgtcgcgtcgtacgtacgtgtacgtnttacgtacgttattacgttactatacgtagtacttaactacgtacgngtacgtccgtagttcgtacgttcgtacgttctggtaccggaggtaaccgngtcccgtagacgtaacacgtaacgagtcggataccgtacg

SEQ ID NO: 243168 - DNA, 412 bp, Homo sapiens
  misc_feature: GYAE6OF01DWP57.33.14.B03.1.454.CMB.1.raw
  modified_base (406)..(412): a, c, t, g, unknown or other
  misc_feature (406)..(412): n is a, c, g, or t
tcagtacacacactcacgaccggtgctcgatttagtgtgagtagtttggggggtatcatccctctcttcggcacaatacagtacgcccacaaatttcaagacagagtgcaagttttcgcgaacgaatcaacgaccacagtccacatggagttgaggagcctgacatctgaagacacggccgtatattactgtgcgagagatcaaaatgtggcgcaaagtggttacgggtttgactcctggggccagggaaccctggtcatcgtctcctcagcctccaccaagggcccatcggtcttccccctggcaccctcatccaagagcacctctggggcacagcggccctgggctgcctggtcaaggactacttccagtgtgtgtactgagcgggctgggcaaggcgcatagnnnnnnn

SEQ ID NO: 243169 - DNA, 417 bp, Homo sapiens
  misc_feature: GYAE6OF01CVAP1.33.14.B03.1.454.CMB.1.raw
  modified_base (410)..(417): a, c, t, g, unknown or other
  misc_feature (410)..(417): n is a, c, g, or t
tcagtacacacactcacgaccggtgctcgatttagtgtgagtagtttggggggtatcatccctctcttcggcacaatacagtacgcccacaaatttcaagacagagtgcaagttttcgcgaacgaatcaacgaccacagtccacatggagttgaggagcctgacatctgaagacacggccgtatattactgtgcgagagatcaaaatgtggcgcaaagtggttacgggtttgactcctggggccagggaaccctggtcatcgtctcctcagcctccaccaagggcccatccggtcttccccctggcaccctcctccaacgacgcacctcgtgggggcacagccggccctgggcctgcctggtcaaggactactccagtgtgtgtactgagcgggctggcaggcgcatagnnnnnnnn

SEQ ID NO: 243170 - DNA, 409 bp, Homo sapiens
  misc_feature: GYAE6OF01DCRJZ.33.14.B03.1.454.CMB.1.raw
  modified_base (405)..(409): a, c, t, g, unknown or other
  misc_feature (405)..(409): n is a, c, g, or t
tcagtacacacactcacgaccggtgctcgatttagtgtgagtagtttggggggtatcatccctctcttcggcacaatacagtacgcccacaaatttcaagacagagtgcaagttttcgcgaacgaatcaacgaccacagtccacatggagttgaggagcctgacatctgaagacacggccgtatattactgtgcgagagatcaaaatgtggcgcaaagtggttacgggtttgactcctggggccagggaaccctggtcatcgtctcctcagcctccaccaagggcccatcggtcttccccctggcaccctcctccaagagcacctctgggggcacagcggccctgggctgcctggtcaaggctacttccagtgtgtgtactgagcgggctggcaaggcgcatagnnnnn

SEQ ID NO: 243171 - DNA, 231 bp, Homo sapiens
  misc_feature: GYAE6OF01DDFZD.33.14.B03.1.454.CMB.1.raw
  modified_base (225)..(231): a, c, t, g, unknown or other
  misc_feature (225)..(231): n is a, c, g, or t
tcagtacacacactcacgaccggtgctcgatttagtgtgagtagttccgcgggcaactggggccagggaaccctggtcatcgtctcctcagcctccaccaaggcccatcggtcttccccctggcaccctcctccaagagcacctctgggggcacagcggccctgggctgcctggtcaaggactacttccagtgtgtgtactgagcgggctggcaaggcgcatagnnnnnnn

SEQ ID NO: 243172 - DNA, 522 bp, Homo sapiens
  misc_feature: GYAE6OF01CV2Z8.33.14.B03.1.454.CMB.1.raw
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
  modified_base (485)..(522): a, c, t, g, unknown or other
  misc_feature (485)..(522): n is a, c, g, or t
tcagtacacacactcacgaccggtgctcgatttagtgtgagtagtttgggggggtatcatccctctcttcggcacaatacagtacgcccacaaatttcaagacagagtgcaagtttttcgcgaacgaatcaacgaccacagtccacatggagttgaggagcctgacatctgaagacacggccgtatattactgtgcgagagatacaaaatggtggcgacaaaggttggttacgggtttgactccgtggggccagggaaccctggtcatccgtctcctcacgccctccaaccgacggcccactccggtccttcccccgtcggccacccctcctaccaagcgccacctcggtcgggggcacgacgccggcccgtgggcctcggccgtcggtacgaacggtaccttaccgttccgaaggtttcggttcgttacggtacgtgggacggccggggtcgtcgggacgagggccgacgagtagcangcngcnnnnnnnnnnnnnnnnnnnnnnnnnnnnnnnnnnnnnn

SEQ ID NO: 243173 - DNA, 231 bp, Homo sapiens
  misc_feature: GYAE6OF01EBXQU.33.14.B03.1.454.CMB.1.raw
  modified_base (210)..(210): a, c, t, g, unknown or other
  misc_feature (210)..(210): n is a, c, g, or t
  modified_base (216)..(231): a, c, t, g, unknown or other
  misc_feature (216)..(231): n is a, c, g, or t
tcagtacacacactcacgaccggtgctcgatttagtgtgagtagttccgcgggcaactgggccagggaccctggtcatcgtctcctcagcctccaccaaggcccatcggtcttcccctgcaccctcctccaagagcactcgtggggcacagcgccctggctgcctggtacaaggactacttccagtgtgtgtactgagcggctgcgagcncatagnnnnnnnnnnnnnnnn

SEQ ID NO: 243174 - DNA, 430 bp, Homo sapiens
  misc_feature: GYAE6OF01BZ8FR.33.14.B03.1.454.CMB.1.raw
  modified_base (312)..(312): a, c, t, g, unknown or other
  misc_feature (312)..(312): n is a, c, g, or t
  modified_base (408)..(409): a, c, t, g, unknown or other
  misc_feature (408)..(409): n is a, c, g, or t
  modified_base (411)..(430): a, c, t, g, unknown or other
  misc_feature (411)..(430): n is a, c, g, or t
tcagtacacacactcacgaccggtgctcgatttagtgtgagtagtttgggggggtagtcatccctctcttcggcacaatacagtacgcccacgaaatttcaagacagagtgcaagttttcgcgaacgaatcaacgaccacagtccacatggagttgaggagcctgacatctgaagacacggccgtatattactgtgcgagagatcaaaaatgtggcgcaaagtggttacgggtttgactccgtgggccagggaaccctggtacatcgtctcctcagcctccacaaggcccatcggtctcccctgcaccctcncaagagcacctcgtcggggcacagcggccctggctcgcctggcaaggactacgttccagtgtgtcgtactggacgcggctggcaaggcgcagtagnnannnnnnnnnnnnnnnnnnnn

SEQ ID NO: 243175 - DNA, 881 bp, Homo sapiens
  misc_feature: GYAE6OF01A0T8W.33.14.B03.1.454.CMB.1.raw
tcagtacacacactcacgaccggtgctcgatttagtgtgagtagtttgggtttagggggaaaacctcattcctcctctaaaagaacgcccctgggagcacagcgcatcaccatggactggacctggagttcctctttgtgggtggcagcagctacaggtgtccagtcccacgttccaacgtggtaccaatcgtgggtctgaggtagaagacggccgtgggtcctcgggtggacgggttcctcctgctaggttcgtctcgtaggggctccggtcctttacgacgtcctaaccttagtccggccctaacgtcctaacccggttacggggtcggccggaaccggaaccggggtaccccccgggaaagtaaaccgggggttccgttaggacgggtagggggtaacgggttagggggggttacctacggtaccgttccccgtccttccggttacggaccgaaactaacttaacccgtaacgtacccggacccctaaacgtaaaacgtttaccgaaagaacgaggttacggtaccggtacttaaacggtttcccggaaaccggtaaacgtaaaccgtaccgaaaaccgtacccaaccgtaacccggtaacaaccgtggttaacgggtacggttacggaaggaccgtaccgtacggaacgtactaccggtaacgaaacggacctaaccgggtaccgttaaattaccgtttaacgtacggttaggtaaccgaacggtaaagtactaaacggaacgttagggtccggtaaacgttacggtaaacgggttttcgggttaaaccggggtttctaacccgggttccgggacggggtaacccgtaacggggttaacccgttcgggtaaccggtcttaccgtaacccggttcccg

SEQ ID NO: 243176 - DNA, 943 bp, Homo sapiens
  misc_feature: GYAE6OF01DGP08.33.14.B03.1.454.CMB.1.raw
  modified_base (263)..(263): a, c, t, g, unknown or other
  misc_feature (263)..(263): n is a, c, g, or t
tcagtacacacactcacgaccggtgctcgatttagtgtgagtagtttgggtttagggggaaaacctcattcctcctctaaagaagcccctgggagcacagcgcatcaccatggactggacctggaggttcctctttgtggtggcagcagctacagggtcgtccagtcccagttaccaactggtacaatcgtgggtctggaggtagaaggaggcctggggtcctcgggtggacgggtctcctgcaggtcgtcgtcgtggggacncggtcccttacgacgacctaacgttcacgaccctactaccgtaccggtggggtacggacccggaaccggaaccggggtaccccccggaaacgggtaaaacgggttccgttgggtaacggggttagggggtacgggttacgggggggttaacttccggtaaccgttcccccgtttacgttcccggttccgggtaacctaacgtaaaaaccgtaccgtaaccggttaacccggaaccctaaaacgttaaaacctttaccgaaacggtaaacgtaagggtacggttaacgtaaccgtttaacggttttaccggaaaccggtaaacgtaaaacgttaaacccgaaacccgtaaccgaacggtacccgttaacccgtaaccgtaacggtttaggggtaaccggtttaagggtacggaacggttaaaccggttcgtaaacccgtagttacccgtaaacggaaccgggtaacccggtaaacggtaaccggttttaaataccgtttaacgttcgggtaacggacgtaagggaattaaacgtaaacgtaaggtacggtacggaaccgaaggttaaacgggtttagggggttttaaccggttaggtacccgggtttacgggacccgggggtacccggaaaccgggtaacccggtttacgggtacggttacccttcggttccctaccccgg

SEQ ID NO: 243177 - DNA, 411 bp, Homo sapiens
  misc_feature: GYAE6OF02HY68X.33.14.B03.1.454.CMB.1.raw
  modified_base (404)..(411): a, c, t, g, unknown or other
  misc_feature (404)..(411): n is a, c, g, or t
tcagtacacacactcacgaccggtgctcgatttagtgtgagtagtttgggggtatcatccctctcttcggcacaatacagtacgcccacaaatttcaagacagagtgcaagttttcgcgaacgaatcaacgaccacagtccacatggagttgaggagcctgacatctgaagacacggccgtatattactgtgcgagagatcaaaatgtggcgcaaagtggttacggtttgactcctggggccagggaaccctggtcatcgtctcctcagcctccaccaagggcccatcggtcttccccctggcaccctcctccaagacgcacctctggggcacagcggccctgggctgcctggtcaaggctacttccagtgtgtgtactgagcgggctgggcaaggcgcatagnnnnnnnn

SEQ ID NO: 243178 - DNA, 414 bp, Homo sapiens
  misc_feature: GYAE6OF02FJ6SD.33.14.B03.1.454.CMB.1.raw
  modified_base (409)..(414): a, c, t, g, unknown or other
  misc_feature (409)..(414): n is a, c, g, or t
tcagtacacacactcacgaccggtgctcgatttagtgtgagtagtttggggggtatcatccctctcttcggcacaatacagtacgcccacaaatttcaagacagagtgcaagttttcgcgaacgaatcaacgaccacagtccacatggagttgaggagcctgacatctgaagacacggccgtatattactgtgcgagagatcaaaatgtggcgcaaagtggttacgggtttgactcctggggccagggaaccctggtcatcgtctcctcagcctccaccaagggcccatcggtcttcccccctggcaccctcctccaagagcacctctgggggcacagcggccctgggctgcctggtcaagggactacttccagtgtgtgtactgagcgggctgggcaaggcgcatagnnnnnn

SEQ ID NO: 243179 - DNA, 417 bp, Homo sapiens
  misc_feature: GYAE6OF02HT09I.33.14.B03.1.454.CMB.1.raw
  modified_base (410)..(417): a, c, t, g, unknown or other
  misc_feature (410)..(417): n is a, c, g, or t
tcagtacacacactcacgaccggtgctcgatttagtgtgagtagtttggggggtatcatccctctcttcggcacaatacagtacgcccacaaatttcaagacagagtgcaagttttcgcgaacgaatcaacgaccacagtccacatggagttgaggagcctgacatctgaagacacggccgtatattactgtgcgagagatcaaaatgtggcgcaaagtggttacgggtttgactcctggggccagggaaccctggtcatcgtctcctcagcctccaccaagggcccatcggtcttcccccctggcaccctcctccaagacgcacctctgggggcacagcggccctgggctgcctggtcaaggactacttccagtgtgtgtactgagcgggctgggcaagggcgcatagnnnnnnnn

SEQ ID NO: 243180 - DNA, 864 bp, Homo sapiens
  misc_feature: GYAE6OF02GHIFG.33.14.B03.1.454.CMB.1.raw
tcagtacacacactcacgaccggtgctcgatttagtgtgagtagtttagggttaggggggtaccaggagtcagaactctgggtgtctacaacctatggcctggatccctctacttctcccctctcactctctgcacaggctctgcggcctcctacgagctgacacagccaccgtcggtttctgtgtcacgtgggacaggacggccaggactcacctgcctctggagatgctattcggaccaaagctaatacgtctttattcggtaccagccagaacgccaggccaggcccctgtactgaataatatacaaagagaatgagacggcccttcgacgggtactcccgtaggacgcgtaactttccgccgggtacttaacgaaacgttcgaccgtaaggggaacccaaacgtaacggttaccgtaaccggtttacgaacccgtaacttaccgtaacgggttacgggaacgttacccgaaggggtaaccaacgggtaaaaccgggaccggtaacggaccgtttaacggaaacccgttaacttacccgtaaccgttaccggtaccccgtaaccttaccgtaaccgggtaccccgggtaaccttaccgggtaacgggtttacggggttaacgggggtttcggggttaccgggttttaccggggaaccggggttaaacccggggttaaccgtaaacggggttttacccgggaaccccggttaccgttttaaccggggtacctaacccgggttacccccggtaaaacgggggttccccgttaaccccgggttacccccccgggtttacgggttaacccccgtaccggtttaccccgggtttaccccggttttaccccccctaacccccccggg

SEQ ID NO: 243181 - DNA, 409 bp, Homo sapiens
  misc_feature: GYAE6OF02G9L5N.33.14.B03.1.454.CMB.1.raw
  modified_base (404)..(409): a, c, t, g, unknown or other
  misc_feature (404)..(409): n is a, c, g, or t
tcagtacacacactcacgaccggtgctcgatttagtgtgagtagtttggggggtatcatccctctcttcggcacaatacagtacgcccacaaatttcaagacagagtgcaagttttcgcgaacgaatcaacgaccacagtccacatggagttgaggagcctgacatctgaagacacggccgtatattactgtgcgagagatcaaaatgtggcgcaaagtggttacgggtttgactcctggggccagggaaccctggtcatcgtctcctcagcctccaccaagggcccatcggtcttcccccctggcaccctcctccaagagcacctctgggggcacagcgcctgggctgcctggtcaaggctacttccagtgtgtgtactgagcgggctggcaaggcgcatagnnnnnn

SEQ ID NO: 243182 - DNA, 449 bp, Homo sapiens
  misc_feature: GYAE6OF02HLE9M.33.14.B03.1.454.CMB.1.raw
  modified_base (433)..(449): a, c, t, g, unknown or other
  misc_feature (433)..(449): n is a, c, g, or t
tcagtacacacactcacgaccggtgctcgatttagtgtgagtagtttggggggtatcatccctctcttcggcacaatacagtacgcccacaaatttcaagacagagtgcaagttttcgcgaacgaatcaacgaccacagtccacatggagttgaggagcctgacatctgaagacacggccgtatattactgtgcgagagatcaaaatgtggcgcaaagtgggttaacgggtttgacttccgtggggccgagggaaccctggtcagtcgtctcctcagcctccaccaacggcccatcggtccttcccccgtggccacccctccctccaacgacgccacctcgtcgggggcacagcggcccgtgggctcggccgtggtacaaggtactactccgagtgtgtgtactgagcgggctgggcgtaaggcgacagtagnnnnnnnnnnnnnnnnn

SEQ ID NO: 243183 - DNA, 480 bp, Homo sapiens
  misc_feature: GYAE6OF02HBLKN.33.14.B03.1.454.CMB.1.raw
  modified_base (439)..(439): a, c, t, g, unknown or other
  misc_feature (439)..(439): n is a, c, g, or t
  modified_base (441)..(480): a, c, t, g, unknown or other
  misc_feature (441)..(480): n is a, c, g, or t
tcagtacacacactcacgaccggtgctcgatttagtgtgagtagtttgggggggtatcatccctctcttcggcacaatacagtacgcccacaaatttcaagacagagtgcaagttttcgcgaacgaatcaacgaccacagtccacatggagttgaggagcctgacatctgaagacacggccgtatattactgtgcgagagatcaaaaatgtggcgcaaaagtggttacgggtttgactccgtggggccagggaaccctgggtcatcgtctcctcagcctccaccaagggcccatcggtcttccccctggccacccctcctccaagacgccacctcgtggggcacgacgcggccctgggctcgccgtggtacaacgggactacttccgagttgtgtgtactgacggcgggtctcgggacgtaagggccgacacgtagcgngnnnnnnnnnnnnnnnnnnnnnnnnnnnnnnnnnnnnnnnn

SEQ ID NO: 243184 - DNA, 798 bp, Homo sapiens
  misc_feature: GYAE6OF02HYLX3.33.14.B03.1.454.CMB.1.raw
tcagtacacacactcacgaccggtgctcgatttagtgtgagtagtttgggtttagggggggggtaccgaggaggcaggaactcctgggtcgtcgtctaccagtggcctggattccctctacttctcccccgtctcactctctgcacacggctcgtgcggcctcctacgagtcttgacacgacgtacctaaccggtcgtttctgtgtacacgtgggacacggacgcctaggtacgtccaccgtggccttcgttagggacgtaggttcgggacctagttcgacctaaacgtcctaaagttaccggtctttacgttcgggtaacccgtacgtaccgtaacggtaacgtaccgtacggtacccgtaccggtacccgtaggtacgtacggtaacgtaacgtaacgtaaacgaaacgtaacggtaacggtacggaacggtaaccggtcccggtaacggtaacgggtacctaccggtaggtacggtacgttaccgttccggtaccggtactaacgtaacgtacggtacgtaacggactaacgtacggtaccgtacggtacgaccgtacgtacgtacgtacgtacgtaccgtaggacgaacggtaacgaccggtacgtacgtacgtactacgtccgtacgtacgacctacgtacgacgtaccgtacgtacgtacggtcggtacggttcggtacggtaccggtacggtacgtacgtacgtacgtaccgtacgtacggtacgaccgtaccgtaacgtcccgtaccggtacccgttacgtaccgtaccgtccgttccggtcccgtaccg

SEQ ID NO: 243185 - DNA, 470 bp, Homo sapiens
  misc_feature: GYAE6OF02IAQBJ.33.14.B03.1.454.CMB.1.raw
  modified_base (457)..(470): a, c, t, g, unknown or other
  misc_feature (457)..(470): n is a, c, g, or t
tcagtacacacactcacgaccggtgctcgatttagtgtgagtagtttggggggtatcatccctctcttcggcacaatacagtacgcccacaaatttcaagacagagtgcaagtttttcgcgaacgaatcaacgaccacagtccacatggagttgaggagcctgacatctgaagacacggccgtatattactgtgcgagagatcaaaatgtggcgcaaagtggttacgggtttgactccgtggggccagggaccctggtcatcgtctctcagcctccaccaaggcccatcggtccttccccctggccaccctccctccaacgacgcctaccgtcgtcgggggcacgacggccggcccgtgggcctcggcccgtgggtaccgaacgggccttaaccgttccgaggttcgtcggtcgttacgtggaggccgggtcgtcgggacgtaagggcgctagtagnnnnnnnnnnnnnn

SEQ ID NO: 243186 - DNA, 426 bp, Homo sapiens
  misc_feature: GYAE6OF02FSX75.33.14.B03.1.454.CMB.1.raw
  modified_base (416)..(426): a, c, t, g, unknown or other
  misc_feature (416)..(426): n is a, c, g, or t
tcagtacacacactcacgaccggtgctcgatttagtgtgagtagtttggggggtatcatccctctcttcggcacaatacagtacgcccacaaatttcaagacagagtgcaagttttcgcgaacgaatcaacgaccacagtccacatggagttgaggagcctgacatctgaagacacggccgtatattactgtgcgagagatcaaaatgtggcgcaaaagtggttacgggtttgactcctggggccagggaaccctggtcatcgtctcctcacgcctccaccaagggccccatcggtccttcccccctcggccaccctccctccaagagcacctcctgggggcacgagcggcccgtggctgcctggtcagactacttccagtgtgtgtactgagcgggctggcgaaggcgacatagnnnnnnnnnnn

SEQ ID NO: 243187 - DNA, 177 bp, Homo sapiens
  misc_feature: GYAE6OF01ATC7B.49.87.H10.1.454.CMB.1.raw
  modified_base (176)..(177): a, c, t, g, unknown or other
  misc_feature (176)..(177): n is a, c, g, or t
tcagagtcgagagacacgaccggtgctcgatttagcagtactgcgttgggtttgggggaagaggaagactgaccggtcccccaggagttcaggtgcgtgggcacagccggccctgggctgcctggtcaaggactacttcctctctcgactctgagcgggctggcaaggcgcatagnn

SEQ ID NO: 243188 - DNA, 182 bp, Homo sapiens
  misc_feature: GYAE6OF02G7UAJ.49.87.H10.1.454.CMB.1.raw
  modified_base (173)..(182): a, c, t, g, unknown or other
  misc_feature (173)..(182): n is a, c, g, or t
tcagagtcgagagacacgaccggtgctcgatttagcagtactgcgttgggtttggggaagaggaagactgacggtcccccaggagttcaggtgctgggcaacagcggccctgggctgcctggtcaaggactacttcctctctcgactctgagcgggctggcaaggcgcatagnnnnnnnnnn

SEQ ID NO: 243189 - DNA, 548 bp, Homo sapiens
  misc_feature: GYAE6OF01DG4AH.23.24.C02.1.454.CMB.1.raw
  modified_base (277)..(277): a, c, t, g, unknown or other
  misc_feature (277)..(277): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccggcaagtcagacaattgacaactattaaattggtatcgccagagaccggaaagcccctnacctcctgatctatgctgcgtccactttacaaagtgggtccatcacgttcagtgcggtggatctgggacagagtcactctcacatcagcagtctgcagcctgaagtattttgactaacttactactgtacaacagtacgttaacctttacccccgaagtaccgttcggaccgaacggggaccaagggtggaaccgtactaccgaaaaccgtaacgtaggtacggtccttggacctaacccgattttacaggttcctttcgaactttccccg

SEQ ID NO: 243190 - DNA, 503 bp, Homo sapiens
  misc_feature: GYAE6OF01DKCHV.23.24.C02.1.454.CMB.1.raw
  modified_base (490)..(490): a, c, t, g, unknown or other
  misc_feature (490)..(490): n is a, c, g, or t
  modified_base (500)..(500): a, c, t, g, unknown or other
  misc_feature (500)..(500): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaatggtatcgccagagacccgggaaagcccctcacctcctgatctatgctgcgtccactttacaaagtgggtcccatcacggttcagtggcggtggatctgggacagagttcactctcaccatcagcagtctgcagcctgaagtattttgctaacttactactgtcaacagacgttacctttacccccaagtaccgttcggccaggggaccaaggtgacatcaaacgaactgtggctgcaccntctgtcttcntcc

SEQ ID NO: 243191 - DNA, 574 bp, Homo sapiens
  misc_feature: GYAE6OF01CY6ZY.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaatggtatcgcagagacccggaaagcccctcacctcctgatctatgctgcgtccactttacaaagtgggtcccatcacggttcagtggcggtggatcgtgggacagagttcactctcaccatcagcagtctgcagcctagaagtattttgactaacttactactgtaccaactagtaacgtttaacccttacccccgtaagtacccgtttccggacccgtaacgggggacccaaagggttcggaacctaacgtaccaaaaccggtaacgtggtacggccgttacggaccaaccctaacttccgttagtttcccttcgtatttccccg

SEQ ID NO: 243192 - DNA, 582 bp, Homo sapiens
  misc_feature: GYAE6OF01D90HP.23.24.C02.1.454.CMB.1.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtggganacacagtcacatcacttgccggnaagtcagacaattgacaactatttaaattggtatcgccagacgacccggaaagcccctcacctctgatctatgctgcgtccactttacaaagtcgggtacccatcacggttcagtggcggtgatcgtagggacaggtacgttcacgtctacaccatcagcagtctgcacgcctagaacgtattttgactaactttactactagtactaacacgtaacgtttaccctttacccccgaacgtaccggtttccggaccgtaacggggaccctaagggtacgaacgaacgtaaccgtaaaccggaacgttggtacggccgtacgaccgtaaccctaacttcttagttccgtttcacgtttaccccg

SEQ ID NO: 243193 - DNA, 618 bp, Homo sapiens
  misc_feature: GYAE6OF01C8LYN.23.24.C02.1.454.CMB.1.raw
  modified_base (197)..(197): a, c, t, g, unknown or other
  misc_feature (197)..(197): n is a, c, g, or t
  modified_base (269)..(269): a, c, t, g, unknown or other
  misc_feature (269)..(269): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatccctcctgtctgcatctgtggganacacagtcacatcacttgccgggcaagtcagacaattgacaactattaatgtatcgacagacgaccggaacncccctacacctcctgactctatcgctcgccgtacctaactttaacgaaacggttcggggtaccctagtcgtacggttcgaggtcgggcgggtaggtactcggtagggaactaggtacgttccaactcctaccaccgtatccgagcgtacgttctagactacgtacctaggaagttacgttttcgaacttaaacttactacttacgtacaacgtacgttaaccgtttaacccttaccccgaaagtacccggttacggaccgtaacggggacctaagggtcggaacaacgtaacaaacggtacgtggtacggtctagacccactacttcctagttccttctacgttccccg

SEQ ID NO: 243194 - DNA, 521 bp, Homo sapiens
  misc_feature: GYAE6OF01CAO5N.23.24.C02.1.454.CMB.1.raw
  modified_base (514)..(514): a, c, t, g, unknown or other
  misc_feature (514)..(514): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaattggtatcgcagagaccggaagcccctcacctcctgatctatgctgcgtccactttacaaagtcgggtccatcacggttcagtggcggtggatcgtgggacagagttcactctcaccatcagcagtctgcagcctagaagtatttgactaacttactactgtacaactacgtacgttacccttaccccgaagtaccgttcgaccgacgggaccaagggtcgacgactacgaaacgtactagtcggctcgcacctatctatcttcncttcccg

SEQ ID NO: 243195 - DNA, 511 bp, Homo sapiens
  misc_feature: GYAE6OF01E3ZBA.23.24.C02.1.454.CMB.1.raw
  modified_base (486)..(486): a, c, t, g, unknown or other
  misc_feature (486)..(486): n is a, c, g, or t
  modified_base (505)..(505): a, c, t, g, unknown or other
  misc_feature (505)..(505): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaattggtatcgccagagacccgggaaagcccctcaccctcctgatctatgctgcgtccactttacaaagtggggtcccatcacggttcagtggcggtggatctgggacagagttcactctcaccatcagcagtctgcagcctgaagtattttgactaactttactactgtcaacagtacgtttaccttcccccaagtaccgttcggccgaggggaccaaggtgacatacaaacgactgnggctgcacatctgtcttcnttcccg

SEQ ID NO: 243196 - DNA, 746 bp, Homo sapiens
  misc_feature: GYAE6OF01B2AMG.23.24.C02.1.454.CMB.1.raw
  modified_base (278)..(278): a, c, t, g, unknown or other
  misc_feature (278)..(278): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgactaactatttaaatggtatcgcagagacccggaagcccctnacctcctgatctatcgctgccgtcctactttaacgaaacggttcgggtaccctagtaccgtaccggtttacaggtcgggtacgggtaggtaacgttcgtaggggaactaaggtacgtttaccaacgttcctaccgaacccacttaccgaacggtcctaacggttccttacggacccgtaacggtacccgttaagggtaaacgtttacgttttttacggaaccgttaaacccttttaacttaaccgtttacgttaaccaaaccgttaacgtttaaccgttttaaccccctttaccccccgtaaaggttacccggtttaccgggacccgtaaccgggggaacccgtaaacgggttacggaaacctaaacgttaaacccgtaaaaccggtaaccgttacgggtacggtcccgtacgacccttaaccgtacgttaccgttacggtttaccctttccgtaccgtttacccccg

SEQ ID NO: 243197 - DNA, 644 bp, Homo sapiens
  misc_feature: GYAE6OF01BN2G7.23.24.C02.1.454.CMB.1.raw
  modified_base (203)..(203): a, c, t, g, unknown or other
  misc_feature (203)..(203): n is a, c, g, or t
  modified_base (284)..(284): a, c, t, g, unknown or other
  misc_feature (284)..(284): n is a, c, g, or t
tcagacgcgagtatcacgaccggtgctcgatttagtacagatcgttagggaaagggggagtcagtctcagtcaggacacagcatggacatggacgggtccccgctcagctccgtggggctcctgctactctggctcgaggtggcagatgtgacatccagatcgacccagtctccatcctccctgtctgctatcgtggtggganacacagtcaccatcactcggccggacaagtcagactaagtgaactaacttaatttaatggtatcgacagacgaccggaacncccctcgacctctgacttctatcgctcgccgtacctaacgtttaacgaaacggttcgggtaccagttcgtaacggttcgaagggttcgggacggtaggtacgtcggtagggactaaggtacgttccacttccgtacaccatcagtcacgtctgactacgtcgtaagtaagttcttttacgaccttaaactttactactacggtaacaaccgttacgttaacccgtttaaccccttaccccgaaggttcccggttaccggaccggtaacgggaaccgtagggtacgaacgacttaaccggaaagtccgtaggacggtctacggtaaccacgttacttcgttagtaccttcgtacttccccg

SEQ ID NO: 243198 - DNA, 586 bp, Homo sapiens
  misc_feature: GYAE6OF01DO2LX.23.24.C02.1.454.CMB.1.raw
  modified_base (355)..(355): a, c, t, g, unknown or other
  misc_feature (355)..(355): n is a, c, g, or t
  modified_base (395)..(395): a, c, t, g, unknown or other
  misc_feature (395)..(395): n is a, c, g, or t
tcagacgcgagtatcacgaccggtgctcgatttagtacagatcgttagggaaagggggagtcagtctcagtcaggacacagcatggacatgagggtccccgctcagctcctgggctcctgctactctggctccgaggtggcagatgtgacatccagatgacccagtctccatcctccctgtctgcatctgtgggagacacagtcaccatcacttgccgggcaagtcagacaattgacaactatttaatggtatcgcagagacccggaaagcccctcacctcctgatctatgctgcgtccaactttacaaagtcgggtcccatcacggttcaggtggcggtggatcgtgggacagngttaccactctcaccatccagcagtctgcagcctagaatntttcgactaacttactactgtacaacgtacgtacgtttaaccccttacccccgtaagtaccggttaccgggtcccaacgggggaccctaaaggggtacgtaaccgaattaacccgaaaacggtaaccgttggtacggtcctaggacccaaccttacgttaccttcggttaccctttccgaactttcccccg

SEQ ID NO: 243199 - DNA, 530 bp, Homo sapiens
  misc_feature: GYAE6OF01CD481.23.24.C02.1.454.CMB.1.raw
  modified_base (197)..(197): a, c, t, g, unknown or other
  misc_feature (197)..(197): n is a, c, g, or t
  modified_base (271)..(271): a, c, t, g, unknown or other
  misc_feature (271)..(271): n is a, c, g, or t
  modified_base (511)..(511): a, c, t, g, unknown or other
  misc_feature (511)..(511): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtggganacacagtcaccatcacttgccggcaagtcagacattgacaactattaatgtatcgcagagaccggaagcccctnacctcctgactcatgctgcgtccactttacaagtcgggtccatcacggttcagtggcggtgatcgtgggacagtattcactctacaccatcagtcagtctgctagcctagaagtacttttagactaactttactactagtacaacgtacgtacgttaacccttaccccgaagtaccgttccggacgtaacgggaccgaaggtcgaacataacgaaacgtactggtcggctcgacaccgtntactgtcttctacttcccg

SEQ ID NO: 243200 - DNA, 606 bp, Homo sapiens
  misc_feature: GYAE6OF01DDMLL.23.24.C02.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (277)..(277): a, c, t, g, unknown or other
  misc_feature (277)..(277): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtcctccatccctccctgtctgcatctgtggganacacagtcaccatcacttgccggnaagtcagacaattgaacaacttatttaaatggtatcgaccagacgacccggaancccctacacctcctgatctatgctgccgtacctactttaacgaaaggttcgggtacccagtcgtacggttcgaggtcgggtcggtggagttcgtggggaactaggtacgtttcaacgttcctaccaaccgatcacgcagtctgctagcctagaagttatttcgactaacttactactacgtactaacgtacgtaacctttaaccccttaccccgaaggttaccgttaccggacgaacggggtaccaagggtacgactaacgtaacgtaaaaccgtacgtggtacggtcctacgaccaacctagttcctaggttccttcgacgttccccg

SEQ ID NO: 243201 - DNA, 532 bp, Homo sapiens
  misc_feature: GYAE6OF01C1KD1.23.24.C02.1.454.CMB.1.raw
  modified_base (526)..(526): a, c, t, g, unknown or other
  misc_feature (526)..(526): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaattggtatcgccagagacccgggaaagcccctcacctcctgatctatgctgcgtccactttacaaagtggggtcccatcacgttcagtggcggtggatctgggacagagttcactctcaccatcagcagtctgcagcctgaagtattttgctaacttactactgtacaactagtaacgtttaccctttacccccgaagtaccgtttccggaccgtaacggggacccaaagggtcggaacactacaaaacgtactgtggctgccacctatctgtcttcnttcccg

SEQ ID NO: 243202 - DNA, 605 bp, Homo sapiens
  misc_feature: GYAE6OF01A73XL.23.24.C02.1.454.CMB.1.raw
  modified_base (197)..(197): a, c, t, g, unknown or other
  misc_feature (197)..(197): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtggganacacagtcaccatcacttgccgggacaagtcagacaattgacaactatttaaattggtatcgaccagacgaccggaacgcccctcaccctcagatctatgctgcgtccactttacaacggtcgggtaccatccgacggttcagtggcggtggactcgtagggacagtacgtcactctacaccatcagcacgtctagccagctagaattacgtttagacttaactttactacgtacgtaccaaacgttacgtaaccgtttaaccccgttacccccgaaagttaccggtttacccggaccggtaacggggaacccgtaacggtacgggtaaacctacgtaaaccggaaaacgtacgttagtacgggtcacgtaccaccgttacgtccgttattcctcgtaccgttacccg

SEQ ID NO: 243203 - DNA, 568 bp, Homo sapiens
  misc_feature: GYAE6OF01C9BYS.23.24.C02.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtggganacacagtcaccatcacttggccggnaagtcagacaattgacaactatttaatggtatcgcagacgaccggaaacgcccctcacctcctgactctatcgctcgccgtcctaacttttaacgaaaggttcggggtacccagtcgtacggttcaggtcgggcggttggagtcgtgggaacaggtacgttcacgtctacacctatcacgcagtctgcagacctagtaatatttgactaactttactactacgtacaacgtacgtaacgttacccttaccccgaagtaccgtacgaccgtaacggggaccaagggtcgacactacgaaacgtactaggtcggctacgacacgtatacctgttccttctcgttcccg

SEQ ID NO: 243204 - DNA, 550 bp, Homo sapiens
  misc_feature: GYAE6OF01B5T86.23.24.C02.1.454.CMB.1.raw
  modified_base (197)..(197): a, c, t, g, unknown or other
  misc_feature (197)..(197): n is a, c, g, or t
  modified_base (543)..(543): a, c, t, g, unknown or other
  misc_feature (543)..(543): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtggganacacagtcaccatcacttgccgggcaagtcagacaattgacaactatttaaattggtatcgccagagacccgggaaagcccctcacctcctgatctatgctgcgtccactttacaaaggtgggtcccatcacggttcagtggcggtggatcgtgggacagacgttcacgtctcaccatcagcagtctgcagcctagaagtatttgactaacttactactagtacaacagtacgtttaccctttaccccgaagttaccgttcggaccgtaacggggaccaaagggtcggaactacgtaccgaaacggtaactggtaggctacgtaccacctataccttagtccttcnttccccg

SEQ ID NO: 243205 - DNA, 707 bp, Homo sapiens
  misc_feature: GYAE6OF01C5JCY.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctcgaggtggcagatgtgacatccagatgacccagtctccatccctcctgtctgccatctggtgggagacacagtcacctatcacttcggccgggacaagtcagaactaattacgaactaaacttaatttaaagttaggtaactcgaccaaggacggaaccgggaaacgtcccctacaccctctcgatccgtatcgtcgtgccgttacctaactttaacgaaacgggttcgggtaccagtacgtaccggttacgaggtcgggtacggtaggtacgtcggtacgggaactaggtacgttccaacttccactaactactcaagctacgtctacgctacgaccgtaaggtaatacttttacgaaccttaacttactaaccgtagtacctaaaccgtacgttaacccgtttaaccccttaccccggaaaacggttcccggttaaccgggacccgtaaacggggaacccgtaagggttaccggaactaacgtaaaccgaaaaccgggtacgtacgggtacggtcctaacgtaccgtaacctacgtttacgtaggtttaccctttacggtaccctttaccccg

SEQ ID NO: 243206 - DNA, 548 bp, Homo sapiens
  misc_feature: GYAE6OF01CV9XY.23.24.C02.1.454.CMB.1.raw
  modified_base (198)..(198): a, c, t, g, unknown or other
  misc_feature (198)..(198): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctggtggganacacagtcaccatcacttgccggcaagtcagacaattgacaactattaatgtatcgcagacgaccggaaacgcccctcacctcctgatctatcgctgccgtcctactttacgaaacggtcggggtcccatcgacggttcaggtgggcggtggatcgtgggactagtagttcactctacaccntacagcagtcngcagctagagtatttcgacttaacttactactacgtactaacgacgttaaccgttaaccctttaccccgaaggtaccggttaccggacgtaacgggaccaagggtcgaacacgtacaaacgacgtgcggctacgcactactctctacttctctcccg

SEQ ID NO: 243207 - DNA, 575 bp, Homo sapiens
  misc_feature: GYAE6OF01BTZZJ.23.24.C02.1.454.CMB.1.raw
  modified_base (198)..(198): a, c, t, g, unknown or other
  misc_feature (198)..(198): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatccctccctgtctgcatctgtggganacacagtcaccatcacttgccgggcaagtcagacaattgacaactatttaaattggtatcgccagagacccgggaaagcccctcacctcctgatctatgctgcgtccactttacaaagtcgggtcccatcacggttcagtggcggtgatcgtgggacagtacgttcactctcaccatcagcagtctgcagcctagaagtagttttgactaactttactacttcgtacaactacgtaactttacccctttacccccaaggtaccgtttaccggaccgtaacggggaccgaagggtcggaactacgtaaccgaaacgtaacgtggttacggccgtacgacccacccgtacttaccgtgttaccttcgtcgtttaccccg

SEQ ID NO: 243208 - DNA, 558 bp, Homo sapiens
  misc_feature: GYAE6OF01DMMZE.23.24.C02.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
tcagacgcgagtatcacgaccggtgctcgatttagtacagatcgttagggaaagggggagtcagtctcagtcaggacacagcatggacatgagggtccccgntcagctcctggggctcctgctactctggctccgaggtggcagatgtgacatccagatgacccagtctccatccctcctgtctgcatctgtggganacacagtcaccatcacttgccggcaagtcagacattgactaactatttaatgtatcgcagagacccggaagcccctcacctctgatctatgctgcgtcctactttacaaaggtcgggtccatcacggttcaggtggcggtggatcgtagggacaggtacgtcacgttctcaccatcagtctacgtctacgctagcctagtaatattttacgactaacttactacttgtaccaactagtaaccgtttaccctttaccccgaaagtccggtttacggaccgtaacggggtaccaagggttcgaactacgtacaaacggtaactggtacggctcgacactcttactgttacttcgacttccccg

SEQ ID NO: 243209 - DNA, 600 bp, Homo sapiens
  misc_feature: GYAE6OF01D618P.23.24.C02.1.454.CMB.1.raw
  modified_base (232)..(232): a, c, t, g, unknown or other
  misc_feature (232)..(232): n is a, c, g, or t
  modified_base (285)..(285): a, c, t, g, unknown or other
  misc_feature (285)..(285): n is a, c, g, or t
  modified_base (429)..(429): a, c, t, g, unknown or other
  misc_feature (429)..(429): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtcctccatccctccctgtctgctatcgtggtgggacacacagtccaccatccacttcggccggganaagtcagactaattgactaacttaatttaattgtatcgcagacgaccggaacncccctacacctcctgacttctatgctgccgtacctactttacgaagtcgggtccatcgtacggttcaggtcggcggtagcgtcgtagggactagtacgttcaacgtctacacatcgacgctacgtctgacacgtctagaagttntttacgacttaacttactactacgtactaactacgttaccgttaacccttaccccgaaggttaccgttaccggaccgtaacggggacctaagggtacgtactaactaacgtaaaccgtacgttgtacggtctacgacctacctacttcgtattccgttctaccgttccccg

SEQ ID NO: 243210 - DNA, 518 bp, Homo sapiens
  misc_feature: GYAE6OF01AX2EH.23.24.C02.1.454.CMB.1.raw
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaattgtatcgcagagacccggaagcccctcacctcctgatctatgctgcgtccactttacaagtcgggtccatcacggttcagtggcggtggatctgggacagacgttcactcncacatcagcngtctgcagcctgaagtntttgctaacttactactgtacaactagtacgtttacctttcctacctaacggtaccgtttacggccgtacggggacctagggtcggacattaccgaaacgtactgtggctgccacatctcgttctctacg

SEQ ID NO: 243211 - DNA, 557 bp, Homo sapiens
  misc_feature: GYAE6OF01AP1QH.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgcgggagacacagtcaccatcacttgccgggcaagtcagacaattgacaactatttaaattggtatcgccagagacccgggaaagcccctcaccctcctgatctatgctgcgtccactttacaaagtcgggtccatcacggttcaggtggcggtggatctgggacaggagttcactctcaccatacagcagtctgcagcctagaagtatttgactaacttactactagtacaactagtacgtttacccttacccccgaagtaccgttccggaccgtacggggaccctaagggtcgactacgtaaccgtaaacgactacggtacggctacgaccgaacctattccgtagttcttccgtacgttccccg

SEQ ID NO: 243212 - DNA, 571 bp, Homo sapiens
  misc_feature: GYAE6OF01CT3AY.23.24.C02.1.454.CMB.1.raw
  modified_base (197)..(197): a, c, t, g, unknown or other
  misc_feature (197)..(197): n is a, c, g, or t
  modified_base (272)..(272): a, c, t, g, unknown or other
  misc_feature (272)..(272): n is a, c, g, or t
  modified_base (414)..(414): a, c, t, g, unknown or other
  misc_feature (414)..(414): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtggganacacagtcaccatcacttgccgggcaagtcagacaatgacaactaatttaatggtatcgcagacgaccgggaacncccctacacctctgactctatcgctgcgtcctactttacgaaaggtcgggtaccagtctacggttcaggtggcggtggagtcgtagggactaggagtttcacgtctacacctatcagcagtctagcacgtcctagaacgttntttacgactaacttactactgtacaacgtacgttaccgtttacccttacccgaacggttaccgtttcggaccgtaacggggactaagggtcggactataaccgaaacgtaccgtggttacggctcgacctactactcgttactcttctcttaccccg

SEQ ID NO: 243213 - DNA, 712 bp, Homo sapiens
  misc_feature: GYAE6OF01C8IS0.23.24.C02.1.454.CMB.1.raw
  modified_base (102)..(102): a, c, t, g, unknown or other
  misc_feature (102)..(102): n is a, c, g, or t
  modified_base (316)..(316): a, c, t, g, unknown or other
  misc_feature (316)..(316): n is a, c, g, or t
  modified_base (511)..(511): a, c, t, g, unknown or other
  misc_feature (511)..(511): n is a, c, g, or t
tcagacgcgagtatcacgaccggtgctcgatttagtacagatcgttagggaaagggggagtcagtctcagtcaggacacagcatggacatgagggtccccgntcagctcctggggctcctgctactctggctccgaggtggcagatgtgacatccgagatcgacccagtcctccatccctcctgtctgcattcgtggtgggaacacacacgtccacctatccacgttcggccgggacaaaggtccaagaactaagttagaacctaaacttattttaaaagttggtaactcgaccgaggaacggaacccgggaaacnccctaatccacccgtcctagtactctatcgtctcgtacgtacctacgttaacgaacggtcgggtaccacgtccgtacggttacgaggtcgggtcggtacgtagttcggaggtaacgtagtacggttcctaaccgtctacctacacttacgacgtaccgtacgtccgtagaccgtacggtacgttagtaacgtttnttttaacgacctttaaacttaaccttacgtacgtacccgtaaagttaccgtttaacccgtttaccccgttaaccccggaaggttacccggttacccgggaaccggaaccggggtaaccgtaaggggtaccgaaccgtaagttaaacccggaacgtacgttcggtcggcttacgacctacgtactcgttacgtctcctaccg

SEQ ID NO: 243214 - DNA, 643 bp, Homo sapiens
  misc_feature: GYAE6OF01CA572.23.24.C02.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatcgacccagtctccatccctccctgtctgcatcgtggtggganacacagtccaccatcacttggccggnaagtcagtactaattgactaacttatttaagttggtatcgaccagacggacccggaagcccctnacctctgatctatgctgccgtcctaactttacgaagtcgggtaccatcgtacggttacaggtggcggtgacgtcgtaggaactagtatctacgtcctacacctatcgaagctagtctgcacgtctagacttatttcgacttaacgtttatacgtactaactaacgtacgttaacccttttaccccttaccccgaacggttaccggttaccggaccggttaaccggggacctaaacgggttcgaaccgtaacctaaacgggttaaaccgtcgttagggtaccggtcccttacggaaccccttaaccgttacgttcccgttaccgtttacctttcccgtaaccgtttaccccgg

SEQ ID NO: 243215 - DNA, 673 bp, Homo sapiens
  misc_feature: GYAE6OF01BAJZK.23.24.C02.1.454.CMB.1.raw
  modified_base (190)..(190): a, c, t, g, unknown or other
  misc_feature (190)..(190): n is a, c, g, or t
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
tcagacgcgagtatcacgaccggtgctcgatttagtacagatcgttagggaaagggggagtcagtctcagtcaggacacagcatggacatgacgggtccccgctcagctccgtggggatcctgctactctggctccggaggtggcagatgtgacatccagatcgacccagtctccatcctcctgtctgcntcgtggtggganacacaactcactatcacgttcggccgganaacgtcaagaactaattagaactaacttaattttaaagttggtactcgacgtaggacggaacccgggaacgcccctacgaccctctagtactctatcgtctcgacgttacctaacgtttaacgaaacggttcgggtaccctagtaccgtcggttacgagggtcgggtcgggtagtacgtttcgggtacgggaacgtacggttacttcgtaaccgtcctacgaacctagtaccagtctagtcctcgactacgtacgtaagtaacgtagtttacgacttaacttactactgtaactaactacgttaccttaacccttacccgaaggtaccgttaccggtacggaacgggtaaccgtaaggtacggtaactaacgtaactaaaccggtgtacggtacggtcgtacgtacaccgtcgtacgttacttaccttacgtccttaccccg

SEQ ID NO: 243216 - DNA, 694 bp, Homo sapiens
  misc_feature: GYAE6OF01CIWL4.23.24.C02.1.454.CMB.1.raw
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (434)..(434): a, c, t, g, unknown or other
  misc_feature (434)..(434): n is a, c, g, or t
  modified_base (447)..(447): a, c, t, g, unknown or other
  misc_feature (447)..(447): n is a, c, g, or t
  modified_base (468)..(468): a, c, t, g, unknown or other
  misc_feature (468)..(468): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtcctccatccctccctgtctgcatcgtggtgggagacacacgtccaccatcacgttcggccgggacaagtcaagactaattgaactaaacttatttaaagtggtatcgacaggacggaacccgggaacncccctcacctctanactntagtcgctcgccgtacctaacttaacggaaaggttccgggaccctagtcctaacggggttacaggttcgggtcgggtagtacgttcggtagggactaggtacgttcaccttcacctacgtnactagctagtccncgcgtacgacgtaagagtttnttacaccgttaacttactacgtacgtactaaaccgtcggttaacctttaaccccttaaccccgaaggttacccggttaccgggaaccggtaacggggtaaccctaagggttaccggaacctaaggtaaacccgtaaaaccggtacgttagggtacgtccgtaccgaaccccgtaacccgttacttacccgggtttacttaacctttccgtaacccgtttccccccg

SEQ ID NO: 243217 - DNA, 608 bp, Homo sapiens
  misc_feature: GYAE6OF01C6PS1.23.24.C02.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (382)..(382): a, c, t, g, unknown or other
  misc_feature (382)..(382): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtggganacacagtccaccatcacttgccgggnaagtcagacatgacaactatttaatggtatcgcagacgaaccggaaacgcccctcacctcctgatctatgctgctcctaactttacgaaagtcgggtccagtcgtacggttcaggtggcggtggtatcgtgggacagacgttcacgttctcactatcanctagtctagacacgtacctagtaacgtattttcgaccttaactttacctacttcgtactaactacggttaacttttaacccctttaccccgaaagttacccggtacggtaccgaacggggtaccaagggttaccggaactacgtaaaccgaaacggtaaacttgggtacggtcgtacggaccctaaccgttacttctttacgtttacccgttctaccgtttccccg

SEQ ID NO: 243218 - DNA, 702 bp, Homo sapiens
  misc_feature: GYAE6OF01DNH1O.23.24.C02.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
tcagacgcgagtatcacgaccggtgctcgatttagtacagatcgttaggggaaagggggagtcagtctcagtcaggacacagcatggacatgagggtccccgctcagctccgtggggctcctgctactctggctccggaggtggcagatgtgacatccagatgacccagtctccatccctccctgtctgcatctggtggganacacagtccaccatcacgttggccgggacaagtcaagactaattgaactaacttaattttaaagttggtactcgaccaagacggaaccccgggaaacncccctccacctcctgatctatcgctcgccgtacctaactttacgaaagggtcgggtaccctagtccgtacggttcgaggtcgggtcgggtggtacgtcggtaggggactaggtacgttacctactcctaccaacctatacgacgacctacgtctaggacctacggaccgtaaggtaagttactttacggaacccttaaacctttactaacttcgtaactaaaccgttacggttaaacccgttttaccccgttaaccccgaacgggttacccggttacccgggacccggtaacgggggtaccgtaaagggtaccgaacgtaacgttaacggaaaccgtacgttggtacgggtacctacggtacccaacgttactacgttccgttaccttcctcgttacccccg

SEQ ID NO: 243219 - DNA, 568 bp, Homo sapiens
  misc_feature: GYAE6OF01BFCAD.23.24.C02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtcctccatcctccctgtctgcatctgtgganacacngtccaccntcacttgccggnaagtcagacattgacaactatttaatggtatcgcagacgaccggaagcccctnacctcngatctangctgcttaccactttaacgaaacgttcgggtaccctaagtcctacggtttcgagttcgggcggtagacgtcgtgggtacaggtattcactctcaccagtcagcagtctgctagctagagttacttgactacttcactcgtacaactacgtacttacccttacccgaagttaccggttcggaccgtaacgggtaccagggtcgaactagtaacccgaaacgtaccgtaggtacgccgttacgaccctacgtacgtcgttacgcctttacgcgtttccccgg

SEQ ID NO: 243220 - DNA, 776 bp, Homo sapiens
  misc_feature: GYAE6OF01BLW58.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaaccatcacttgccgggcaagtcagacaattgaactaacttatttaaattggtatcgccagacggacccggaactcccctacacctcctagacttctatcgctcgccgtactactttacgaaacggtcgggtacccagtccgtacggttcaggtgggtccggtagggtacttcgagggactaacggtacgttaccacttccgtaccgacctaacgtccaggtacctacggttaccgttacgaccgtaacggtcccgttaaggtaaacgtttacgttttacgtaaccgttaaaacttttacccgttaaccgttacgttaacctaaaccggttaacggttaaacccgtttttaacccccgtttaccccccggtaaaaggttaccccgggtttaccgggaaccccggtaaacggggggtaacccgttaaaacggggttccgggaaaccttaaccggttaaaccgaaaacccgggttaaacggtttagggaccgggttacccgtaccggtaaacccccgaaccgttaccgtttccgtttaacgtttcccctttacgtacccggttttaccccccg

SEQ ID NO: 243221 - DNA, 588 bp, Homo sapiens
  misc_feature: GYAE6OF01DPH8U.23.24.C02.1.454.CMB.1.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
  modified_base (411)..(411): a, c, t, g, unknown or other
  misc_feature (411)..(411): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtggganacacagtcaccatcacttcgccgggacaagtcagactaattgaactaactaatttaaattggtatcgccagacgacccggaancccctcacctctgatctatgctgctcctactttaacaaggtcggtacccatcgacggttcaggtcggcggtggactcggtagggactagacgttcactccncactancagcagtcagcagtcctagagttntttacgacttaactcttacgtcgtactaacgtacgtaaccgtttaccccttaccccgaaggttacccgttaccgggacccgtaacgggggtaccctaagggtaccgactaacgtaccgaaacggtacgtggtacggctaacgcctaacctagttcttactacctctacgttaccccg

SEQ ID NO: 243222 - DNA, 699 bp, Homo sapiens
  misc_feature: GYAE6OF01E1ZCN.23.24.C02.1.454.CMB.1.raw
  modified_base (131)..(131): a, c, t, g, unknown or other
  misc_feature (131)..(131): n is a, c, g, or t
  modified_base (338)..(338): a, c, t, g, unknown or other
  misc_feature (338)..(338): n is a, c, g, or t
tcagacgcgagtatcacgaccggtgctcgatttagtacagatcgttagggaaagggggagtcagtctcagtcaggacacagcatggacatgagggtcccccgctcagctcctgggggcctcctgctactcnggctccggaggtggcagatgtgacatccagatcgaccctagtcctaccactcccctcccgtgtcctgctatcgtggtgggacaccacagtccaccatcctacgttcggcccgggacaagtccagaacctaattcgaactaacttaatttaagtggtactccgacgagacggaacccgggaactcccctactaccctctagtatctancgcgtcgccgtacctactttaacgaagggtccggtaccagtccgtacggttcaggtgggcggtaggactcggtaggacagttcgtccacttccacactagtcacgtactagtctgacgacgtcgtagtaacgttgtttacgaaccttaaccttaacgttcctacgtaaccaacgtacgttaacccgttttaacccccgttacccccgtaagggttacccggttcccgggaaccgggtaacggggaccccgttaaaggggaccgtaactaaccgtaaaccgtaaaccggtaccgtgggtaccggtctacccggacctaacccgttactacgttccggtttaccttccggtcctttacccccg

SEQ ID NO: 243223 - DNA, 643 bp, Homo sapiens
  misc_feature: GYAE6OF01CTBA5.23.24.C02.1.454.CMB.1.raw
  modified_base (102)..(102): a, c, t, g, unknown or other
  misc_feature (102)..(102): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (355)..(355): a, c, t, g, unknown or other
  misc_feature (355)..(355): n is a, c, g, or t
tcagacgcgagtatcacgaccggtgctcgatttagtacagatcgttagggaaagggggagtcagtctcagtcaggacacagcatggacatgagggtccccgntcagctccgtggggctcctgctactctggctccgaggtggcagatgtgacatccagatcgacccagtctccatccctcctgtctgcatctggnggganacacagtccactatcacgttggccgganaagtcaagactaattgaactaacttaatttaatgtatcgacaaggacggaaccggaacgcccctacacctctanatctangctcgtactacctactttaagaacggtcggtaccagtcgtacggttnaggtggtcgggtgtactcggtaggactagtacgttacacgtctcaacctatcgaagtctagtcgtacgacacgtacgtagtaattagtttcgaacttaacgtctactagtactaaacgtacgttaccctttacccttacccgaagttccggttaccggaccggtaacgggacgtaacggtacgaactaaacgtaaccgtaaaccggtaacgttcgggacggtacctacggtaaccctaaccggttacttaccgttaccgtttacccttaccgttccgtttaacccccg

SEQ ID NO: 243224 - DNA, 651 bp, Homo sapiens
  misc_feature: GYAE6OF01D8D5L.23.24.C02.1.454.CMB.1.raw
  modified_base (198)..(198): a, c, t, g, unknown or other
  misc_feature (198)..(198): n is a, c, g, or t
  modified_base (433)..(433): a, c, t, g, unknown or other
  misc_feature (433)..(433): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccggaggtggcagatgtgacatccagatgacccagtcctcatcctcctgtctgcatctggtggganacacagtcaccatcacttgccggcaagtcagaactaattgaactaaacttaatttaaagttggtatccgaccaagacgaaccccgggaaagccccctacgacctcctagatcctatcgctcgctccaactttaacgaaacgggtcggtaccacgttcgacggttcaggtggcggtaggatcggtagggactaaggtacgttcacgtcctacaccatacgagtcgtaagtctgacncgacctaagtaagtattttcactaacttactagtactacgtaactaacgtaacctttacccgttacccccgaagtaccggttaccgggacccgtaaggggaaccctaacggggtagaaccgtaactaaaccggaaaacgtaaccgtgggtaacggtcctaccgggtaccaaaccctacgtttaccgtagtttacccgtttacgtaaccctttaccccg

SEQ ID NO: 243225 - DNA, 625 bp, Homo sapiens
  misc_feature: GYAE6OF01A0R9D.23.24.C02.1.454.CMB.1.raw
  modified_base (102)..(102): a, c, t, g, unknown or other
  misc_feature (102)..(102): n is a, c, g, or t
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (283)..(283): a, c, t, g, unknown or other
  misc_feature (283)..(283): n is a, c, g, or t
  modified_base (560)..(560): a, c, t, g, unknown or other
  misc_feature (560)..(560): n is a, c, g, or t
  modified_base (592)..(592): a, c, t, g, unknown or other
  misc_feature (592)..(592): n is a, c, g, or t
tcagacgcgagtatcacgaccggtgctcgatttagtacagatcgttagggaaagggggagtcagtctcagtcaggacacagcatggacatgagggtccccgntcagctcctggggctcctgctactctggctccgaggtggcagatgtgacatccagatcgacccagtcctccactccctccctgtctgcatctgtggganaccacagtcaccatccacgttcgccggganaagtcagactatagactaactatttaatgtatcgcagacggaacccggaacncccctcacctctagactactatactcgtcctacctaacttacgaaggtcgggtacccagtccgtacggttcaggtcgggcggtagtagtcgtagggacagtacgttccacttctaccactataccgacgctaggtcctacgacgtcgtaaccgtaggtaaagtttactttacgaaccgttaacctttacgtaaccttgtacctaacgtaccgtttaccttaacccccgtttaccgaacggtccggttaccggaccggtacgggacctaaggccgaanacctaaacgaacgtactcggtgactcgaaccnctacgtcttactacttcctacttcccgtacccg

SEQ ID NO: 243226 - DNA, 709 bp, Homo sapiens
  misc_feature: GYAE6OF01B3UU0.23.24.C02.1.454.CMB.1.raw
  modified_base (101)..(101): a, c, t, g, unknown or other
  misc_feature (101)..(101): n is a, c, g, or t
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
tcagacgcgagtatcacgaccggtgctcgatttagtacagatcgttagggaaagggggagtcagtctcagtcaggacacagcatggacatgagggtccccntcagctcctggggctcctgctactctggctccgaggtggcagatgtgacatccagatcgacccagtcctccatccctccctgtctgcatcgtggtggganacacagtccaacctatcacgttcggccgggacaagtcagactaagttgaactaacttaatttaaagtcggtactccgacaaggaccggaacccgggaacncccctacaccctcgtagacttctagtcgtctacgtcctacctaacgtttaacgaacgggttcggtaccctagttaccgtacggtttacgagggttcggggtacggtcgtagttccgggtagggaacgtaaggtacgttcctactccgtaaccacctaacgtcgaacgtcgtagtcctacgacccgtagtaccgtaaggtaactttcgtttaacgtaccttaacctttacgtactacgtaaccaacgttacgttacccgttttaacccctacccgtaaggttacccggtaccgggaacggtaacgggtacccgtaagggtacgaacgtactaaaccggtaaacggtacgttcggacgtacctaccgaacctacttacgtcgttacctttctaccgttcccgttaccccg

SEQ ID NO: 243227 - DNA, 667 bp, Homo sapiens
  misc_feature: GYAE6OF01BMELJ.23.24.C02.1.454.CMB.1.raw
  modified_base (625)..(625): a, c, t, g, unknown or other
  misc_feature (625)..(625): n is a, c, g, or t
  modified_base (645)..(645): a, c, t, g, unknown or other
  misc_feature (645)..(645): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctcgaggtggcagatgtgacatccagatcgacccagtcctcctactccctcctgtctgctatcgtggtagggacacacgacgtccaccgtatccacgttcggccgggtacaagtaccgagaactaagtacgaacctaattaactttaagtggtatccgacgaacggaacggacccgggaaaccgcccctaccacccgttacgagtactactagcgtcctgccttactacgtttaacggacggttccgggtacctagtaccgtacggttacgacgggtcgggtcggtacggacgtcggtaggacgtacgtacgttctaccgtactacaacacgtgacgactacgtcgacgctacgctaagtaacttacttacgtaactaacttactacgtacttaacgaaacctcgttaaccgttaaccccttaccggaacgttccggttaaccggacggtaaccgggtaacctagggtacaacgtacgtaaaccggacgtacggngtacggctacgacctacgtntcgtacttctacgttcctcccg

SEQ ID NO: 243228 - DNA, 770 bp, Homo sapiens
  misc_feature: GYAE6OF01AY6C3.23.24.C02.1.454.CMB.1.raw
  modified_base (200)..(200): a, c, t, g, unknown or other
  misc_feature (200)..(200): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatcgacccagtctccatccctccctgtctgcatctggtggganacacagtccaccatcacttggccggacaagtcagactaattgaacaatttttttataaagttggtactcgaccaaggaccggaacccgggaactccccctacaccctcctagacttctagtcgcctcgccgttacctaacgtttaacgaacggttccgggtacccagtaccgtacggttcagggtcgggtacggtggtactcggtacgggactaggtcgttacctacgttacctaccaacctagtccgtagtacccgtacggttctacggacctacggtaccgtaagggttaaacgtttacgttttacggaacctttaaaccgtttacttaccgttacgtaacctaaaccgttaaccggtttaaccccgttttaccccctttaacccccggaaaggttaccccgggtttaccgggaacccgggttaacgggggtaacccttaagggggtaccgaaaccctacgttaaaacccggtaaaaccgggtccgttgggttaccggtaaccgttaccgaaccccttaccgtactttaccggtttacgttacccctttacgcccttttaccccccgg

SEQ ID NO: 243229 - DNA, 827 bp, Homo sapiens
  misc_feature: GYAE6OF01BL5VG.23.24.C02.1.454.CMB.1.raw
  modified_base (788)..(788): a, c, t, g, unknown or other
  misc_feature (788)..(788): n is a, c, g, or t
tcagacgcgagtatcacgaccggtgctcgatttagtacagatcgttagggaaagggggagtcagtctcagtcaggacacagcatggacatgagggtccccgctcagctccgtggggctcctgctactctggctccgaggtgcagatgtgacactccagtatcgaccctagtcctacccatccccttccctgttcctcgtactacgttcgtggtacgggaacacaaccgtacgtaccaacctataccgtacgttcgggaccccgggactaacgtccgaacgtaactaaacgttcgaaaccttaaacgtttaaatttttaaacgttacggtaacgtccggaaccgaaacggggtaacccggtaaaacccccgggggtaaaccctacccccccgtaccgtaacccctttacccgtacgtaacctttaaccgttacgtcgtacccgttaccgtacccgttaacccttaacgtttaaacggtaaacgggttcccggtaccctacgttaccgtaaccgggttcgtaacgggtcggtacggggtacgtacgtccggtacggtacgtaacgttaccgtacctaccgtactacccgactacgtacgacgttacgatccgtagacctacgtcgttaacgttaagttacctttcgtaaccttaactttaccgtagtaccttaacgaaccgttacgtttaccccgtttaacccgttaacccgaaggtttaccggtaccgaccggtaacgggtaccggtagtacgtaccgtaaccaaaccgtaacggtcgttagccggtanccgtaacgtctattcccttacgtctcgtcccgttacccg

SEQ ID NO: 243230 - DNA, 572 bp, Homo sapiens
  misc_feature: GYAE6OF01AJQTJ.23.24.C02.1.454.CMB.1.raw
  modified_base (198)..(198): a, c, t, g, unknown or other
  misc_feature (198)..(198): n is a, c, g, or t
  modified_base (274)..(274): a, c, t, g, unknown or other
  misc_feature (274)..(274): n is a, c, g, or t
  modified_base (424)..(424): a, c, t, g, unknown or other
  misc_feature (424)..(424): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatccctccctgtctgcatctgtggganacacagtcaccatcacttgccgggcaagtcagacaattgactaactatttaaatgtatcgccagagacccgggaancccctcacctcctgactctatgctgccgtacctactttacaacggtcgggtcccatcgacgttcaggtcggtcggtggactcgtacgggacgtagtacgttcactctccaacctatcacgctagtctgacgtacgtaccgtgtaaagttnttttacgactaccttacgtacctgtacaactacgtactttaccccttacccgaagtaccgtcgtaccgaacgggaccaagggtcgacacgtaccgaaagtcgtaggtcgtctacgcctacccgtatcgttactctaccgtcttacccg

SEQ ID NO: 243231 - DNA, 786 bp, Homo sapiens
  misc_feature: GYAE6OF01D3F88.23.24.C02.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacagatcgttagggaaagggggagtcagtctcagtcaggacacagcatggacatgagggtccccgctcagctccgtggggctcctgctactctggctccgaggtgcagatgtgacatccagatcgacccagtcctccactccctcctgtctgctactctggtcggganacacgagtaccacctatcacgttcggccgggataacgtcagtaactaagttacgaactaacttaatttaagttcggtaatccgaccgtacggtaaccggaaccccgggaaacctccccgtacctaacccgttcctacgtaacttcgttacgttaccggccgttccggtaccgttacccttaacgttttaaaccgtaaacgggttccgggtaacccccagttaccggtacggttcgaacgggttcgggtacgggtaggtacgtcggtaacgggacgtaaggtccttacgacttccctacctaaccgtactaccgacgtcgtacgttccgtagtacccgtacgtacgtacgtaaacgtttagtttacgtaactaaccgtttacttaccgtacgtacctaaacgtacgtttaacccgtttaaccccgttaccccgaacggtttacccggttaccgggaccggtaaccgggtaccgttaacggtaccgtaaccgtaacgtaaaccgtaaacgtacgtacggtacggtaccgtacgtaccctaaccgtaccttccgttacgttaaccttccgtaccgtttacccccg

SEQ ID NO: 243232 - DNA, 1103 bp, Homo sapiens
  misc_feature: GYAE6OF01CIXQ9.23.24.C02.1.454.CMB.1.raw
tcagacgcgagtatcacgaccggtgctcgatttagtacagatcgttagggaaagggggagtcagtctcagtcaggacacagcatggacatgacgggtccccgctcagctcctgggcctcctgctactctggcctccggaggtggcagatgtagacatccagatcgacccagtcctccactccctcccgtgtctcgctacgtcgtgggtcgggaacgacacacgtaccaaccctatacctaccgttcggggaccccggggtaacaaacggttaccaaacggtaaccgttaaaacgtttacgaaaaccttaaaaacctttttaaagtttttaaaaacggtttcgggttaaaccgttacccgggaacccgaaacggggtaaaacccggggtaaaacccccccgggggggtaaaacccttccccccccgttaaccccgtaaccccccggtttaccccgttaacgggttaacctttaccggtttaaacgtcccgggttcccgttaccggttaacccggtttaacccccctttaaaaccggttttttaaaacccgggaaaaccggggggtttaccccgggggttaaccccctaaacggtttaccccggttaaccggggttttaccggtaagggggttccgggggttaacccgggggttaacggtaacgggtttacccggggtttacggggaaacgtttaacggggttacccggtttacccctaccggtttacccctaaaccctaacccgtaacgttaccgaacgttaccggtaacgttaccgtccggtaaccggaacccgtttaacggttaacggtaaagtttttaccgggtttaacctaaacccgtttaaacctttaaccgttaccggtttaacggtaaaccctaaacgggttttaccctttaaacccccggtttttaaccccccgttaaccccgggaaacgggttacccggttccggggaaaaccgggttaccggggtaaccggtaacggttaccgaaaccgtaaccgtaaaaccgaaaaccggttacggtgggttaccgttaccgtaccaacccgttaaccgttcgtttacccgttacgtttacctttacccgtacccgttccccg

SEQ ID NO: 243233 - DNA, 872 bp, Homo sapiens
  misc_feature: GYAE6OF01BX4F9.23.24.C02.1.454.CMB.1.raw
  modified_base (505)..(505): a, c, t, g, unknown or other
  misc_feature (505)..(505): n is a, c, g, or t
  modified_base (539)..(539): a, c, t, g, unknown or other
  misc_feature (539)..(539): n is a, c, g, or t
tcagacgcgagtatcacgaccggtgctcgatttagtacagatcgttagggaaaagggggagtcagtctcagtcaggacacagcatggacatgagggtccccgctcagctccgtggggctcctgctactctggctccgaggtggcagatgtgacatccagatcgacccagtcctccattccctcctgtctgcatctggtgggacacacagtccaaccatcctacgttcggacccgggacaaagtccaagtactaaagtttcgaactaaaacgtttaactttttaaaacgttggttaacttaccggacccaaggaacccggggaaacccccggggaaaaccgtccccccttacgtaaccccgttcccgtgtaaccttaccttacgtcgtcgttcggtcccgttaccttaacgtttaaaccgaaacgggttcgggtacccctagtccggtaaccgttcgaacgggttcgggacgggttgtagtcggtgggaacgtagtacgtttaccncgttacctaccacctagtacacgtactacgttcncgacacggtccttaaggtaactttacgtttaccgtaacctaaccgttttaaaccgtaccgttacggtaaaccctaacggttaaccgttaaacccgttttaaccccccgtttaacccccgaaagggttacccggttaacccgggggtaaccccggttaaacgggggaaacccccggttaaaggggttaacccggtaaacccggtaaccgttaaaaccggttaaaacccgggaaccgtttaccgggttacgggacccgttacggaaccccgtttaaccctacgttaccggtttaaccgtttaccctttaacccgcccgtttttaacccccccggg

SEQ ID NO: 243234 - DNA, 857 bp, Homo sapiens
  misc_feature: GYAE6OF01ASUWJ.23.24.C02.1.454.CMB.1.raw
  modified_base (102)..(102): a, c, t, g, unknown or other
  misc_feature (102)..(102): n is a, c, g, or t
tcagacgcgagtatcacgaccggtgctcgatttagtacagatcgttagggaaagggggagtcagtctcagtcaggacacagcatggacatgagggtccccgntcagctcctggggctcctgctactctggctccggaggtggcagatgtgacatccagatcgacccagtctccactccctcctgtctgctatcgtggtgggacacacacgtccactatccacttcggccggacacgtcgaagactaagttacgaactaaacttaattttaaagttaggttaactccgaccaaggtaacgaaccggttaaccggggaaacctcccccgttaccaacccgttccgtagtaccttcgttacgtcgtcgttcgtaccgttacctaactttaacggaaacggttccgggtaccctacgtacgtaccggttcgaaggtcgggtacggtagtacgtcggtacggtaacgtacggtacgttccgaccttccgtacctaaccgtactaccgaggtaccgtaacgttccgtacgaccgttacggtaacccgtttaagggtaaaccgttttcgttttaaaccgtaaccgtttaaacccgtttaccgttaaccgtttaccgtaaaccgttaaacgttaaccgtttaaccccgtttttaaccccccgttaacccccgggtaacggtttaaccccgggtttacccggggaaccccgggttaaacgggtaaccccggttaaagggttaacccgggtaaaccttaaaccggtaaacccggtaaaaccgttaccgggtacggtttacccggacgttacccgaacccttaccgttccgtttaacccgttcggtttccccttaacggttacccccg

SEQ ID NO: 243235 - DNA, 801 bp, Homo sapiens
  misc_feature: GYAE6OF01BIHMA.23.24.C02.1.454.CMB.1.raw
tcagacgcgagtatcacgaccggtgctcgatttagtacagatcgttaggggaaaggggggagtcagtctcagtcaggacacagcatggacatggacgggtccccgctcagctccgtggggcctcctgctactctggcctcggaggtggcagatgtgacactccagactcgaaccctagtcctaccacttcccctcccgtgtctcgctacttcggtggtacggggacaccactacgtaccaacctactaccgtaccgttcggacccgggaactaacggtcaacgtaactaattacgaaccttaagtttaagtttaagttcggtacgtccgaacgaacggaacccggaaccccgggaacctacccccgtacctacccgttcgtacgtacttacgtacgtcgtacgtaccgtaccgttaaccttaacggtttaaacggaccgggtttccggtacctacggtaccgtacggttacgcggggtacgggtcggtagtacgtacgggtacggaacgtacgttacgtacctaccgttaccaccgtacctacgtacacgtaccgcgttacggacgaccgtacgtaagttacgttaagttctttacgaaccttaacctttacgtaccgtaaccgtacgtaaccgttacccgttaaccccgttttaccccgtaaaccggaccgggtttaccggtaccggaacgggaacgggtaccgaagggtacctaaacgtacgtaaaccgtacggtacgtacgggtacgtcaaccggtaccctaacgttctaccgttattccttaacgtcccgtaccccg

SEQ ID NO: 243236 - DNA, 617 bp, Homo sapiens
  misc_feature: GYAE6OF01EN002.23.24.C02.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (421)..(421): a, c, t, g, unknown or other
  misc_feature (421)..(421): n is a, c, g, or t
tcagacgcgagtatcacgaccggtgctcgatttagtacagatcgttagggaaagggggagtcagtctcagtcaggacacagcatggacatgagggtccccgntcagctcctggggctcctgctactctggctccgaggtggcagatgtgacatcagatgacccagtctccatccctcctgtctgcatcgtgtggganacanacgtacaccatcacttgcctgacaagtcaagaactaagttnaactaacttaattttaaacgttggtaatcgacaagacggaacccgggaaactcccctacgtacctccgtagtatctactgactcgccgttacctactttaacgaaaggttcgggaccatacgtacgtagacggtggtaggtcgtagtcgtggaacagtacgtcaactctacaactactnaacgctagtcgtcgacgacgtcgtagtaattagttttcgaactttaaacgttactacgttacgtacaacgtacgttaactttacccctacccgaagtccgttaacgacggtaacggacgtaaggtacgaacgtaactaacgtaaacgtaagtggtacggactacgacctaacgtattacgttcgttctttcgtacc

SEQ ID NO: 243237 - DNA, 906 bp, Homo sapiens
  misc_feature: GYAE6OF01ARPG1.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctgggctcctgctactctggctccgaggtgcagatgtgacatccagatcgacccagtcctccatccctccctgtctgcctatcgtggtgggacgaccacacgtaccaccgtattacctaccgttcggacccgggtacaagtaccgaacggtaactaaattcgaaacctaaacctttaaagttttaaaagttcgggtaaccttccggaccctaacgggaaccggtaaacccccgggaaccgtccccctactaaccccgttcctagtaccttctacgtcgccgtcggtccgttaaccttaacgttttaacgaaacgggttccgggtaccctacgttaccggtaccggttacgaagggttcgggtaccgggtggtacgtacggtagggaacctagggtactttcccgacttaccgacctaacgtaaccgtcgtacgtactacggtccgtagaccgtacgtcgttaaaggttacgtttacctttaaccggtaaccctttaacgtttaccgttaaccggttaccgtttaacgaaaaccccggtttaaccgttttccccgttttaaaccccccgttacccccgggttaaagggtttacccccgggtttaacccgggtaacccggggttaaaccgggggtaaacccgttaaccgggtaaacggggttaccctaaaaccgggttaaaccccgtaaaaccgggttcccggtttaggggtaaccctcgggtttaacccacccgttaaccgttacccgtttaacgtttaccgttttaccccgttaccgttacccccgtttacccccgg

SEQ ID NO: 243238 - DNA, 904 bp, Homo sapiens
  misc_feature: GYAE6OF01BW2XF.23.24.C02.1.454.CMB.1.raw
  modified_base (512)..(512): a, c, t, g, unknown or other
  misc_feature (512)..(512): n is a, c, g, or t
  modified_base (866)..(866): a, c, t, g, unknown or other
  misc_feature (866)..(866): n is a, c, g, or t
tcagacgcgagtatcacgaccggtgctcgatttagtacagatcgttaggggaaagggggagtcagtctcagttaggacacagcatggacatggagggtccccgctcagctccgtggggcctcctgctactctggctccgagggtggcagatgtgacatccagatcgacccagtcctccactccctcccttgtctgactatcgtggtagggagacacacgtccaccatactacgtcggccggacaacgtacagaactaattacgaactaaactttaatttaaagttcggtaactaccgaccgaacggaaccggaaccccggggaaacctcccctaccctacccttccgtagtacttactacgtcggtaccgtcggtaccgttaaccttaacggtttaaaccggtaacggggttcccggggtaccctaggttaccggttaaccgggttacggacgggttacggggtcgggttacggtaccgttcgggacgggtaacgtaaggttacgttacccncgttaccctaccaacctacgtacctacggtaccttacggtacgtacggaacctacggtaaccggttagtaaacggttttcgttttaccgtaaaccgttttaacccgttaacctttaaccggtacgttaaacccgtttaacgttaaccccggtttaacccgttttaaccccccgtaaccccggttaaacgggtttaccccgggttaacccggggtaaccggggtaaccccggggtttaacgggaagggtttaacccggtaaccgtaaaccgggtaaacccggttaaaaggtccgggttacgggtcgggttaacccggtaacctacccgttaaacccgttcggtttaaccccgttnttaaaccccgtttcccgtccccgtttccccgtaccccg

SEQ ID NO: 243239 - DNA, 874 bp, Homo sapiens
  misc_feature: GYAE6OF01CR924.23.24.C02.1.454.CMB.1.raw
  modified_base (154)..(154): a, c, t, g, unknown or other
  misc_feature (154)..(154): n is a, c, g, or t
tcagacgcgagtatcacgaccggtgctcgatttagtacagatcgttagggaaagggggagtcagtctcagtcaggacacagcatggacatggacgggtccccgctcagcctccgtggggctcctgctactctggctccggaggtggcagatgtnacataccagactcgacccagtcctaccactccctcctgtctgctattcgtggtagggacaacactacgtaccacctactccgtacggttccgggaccgggtactaaggtaccgaacgtaactaagttacgaaacttaaacgtttaaagttttaagttacggtaacgtccgaaccggaacggaacccggggtaaaccccgggtaaaccccgtccccctaccgtaaccccctttccgtacgtacttccttacgtccgtacccgttcgtacccgttaaccttaaccgtttaacggtaacgggttccgggtaaccctacgttaccggtaccgggttacgacggggtacgggtacggtaggtcgtacgggtacgggtactaacggttacttaccgtactacccgtaacctacgtacgtaccgtacgtacttaccggttcacggacctacggtacgttaaggttaacctttacttaccgtaaacctttaaccgttaccttaccgttaacgtaaccgttaaccggttaacccgttttaccccgtttaaccccggttaacccgggtaccggttaccccgggtaccggggaaccgggtaaccgggtaaccggtaacgggttacaaaccgtaccgtaaaacgtaaaccggtacgggtcgtaacggtcccgtaacgtacccgtttaaccctacggtttcttacccgttacccttcgttaacccgttccccc

SEQ ID NO: 243240 - DNA, 834 bp, Homo sapiens
  misc_feature: GYAE6OF01AIYET.23.24.C02.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
tcagacgcgagtatcacgaccggtgctcgatttagtacagatcgttagggaaagggggagtcagtctcagtcaggacacagcatggacatgagggtccccgntcagctccgtggggctcctgctactctggcctccgaggtcgcagatgtgacatccagtactcgaccccagtcctaccgtactccctcccgtgtcnggtctattcgtggtcgggacaccacacgtccaacctactcctaccgttcgggacccggggtactaagtaccaaggtacctaagttccggaaccttaaacttaagttttaaaacgttcggtactaccggaccgtaagacccgggaacccgggaacctccccctacacccgttctagacttctagtcgctcgtacctaccgttaacgttaacgacgggttccggtacctagtccggtacggtacgtacggggtcggtaccggtacgtacttcggggacggtacgtacggttaacctccgtaacctccgtaccgtacgtacgttaccgacgtaccgttacgttccgtacgtacccgtaacgggttacctaagggttaacgttacgtttacgaacccttaaacgtttaccgttcgttaaccggtaactaacccggtacgttttaacccggtttacccccgttaacccggtaacggtttaccccgggtaccggaccgggtaaccgggtactaaccgggttacgaaccgttacgtaaacccggtaaacggttcccgttagggtttaaccggccccttaaccggtccgtaacccttaaccgggtttcgtacccgtttcccgtttaactccccgggtttaccccg

SEQ ID NO: 243241 - DNA, 901 bp, Homo sapiens
  misc_feature: GYAE6OF01CGJ0J.23.24.C02.1.454.CMB.1.raw
  modified_base (245)..(245): a, c, t, g, unknown or other
  misc_feature (245)..(245): n is a, c, g, or t
tcagacgcgagtatcacgaccggtgctcgatttagtacagatcgttagggaaagggggagtcagtctcagtcaggacacagcatggacatgacgggtccccgctcagctccgtgggctcctgctactcgtggctccggaggtggcagatgtagacatccagatcgaccccagtcctccactcccgtccctgtctgcctatcgtggtagggacacacgatacacctatctaacgttcggcccgggntaacgtcaagactaagttagaactaactttaattttaaagttggtaactccgaccgaacggtaaccggtaaccccggggaaacctcccccccgtaccaccccgttcccgtacggtacttaccgtacgtccggtccgttccggtacccgttacccttaaaaccggttttaaaccgggtaaaaccgggggttaccccgggtaccccttaaggttaccccggtttaaaccggggttaccgggtaaggggtttccgggggttacccggggttaagggttaaccgtttccgggtaacggggggtaacctaaacgggttcgtttaaccctaccggtttaccctaacctaaccgtattcggaactacgttaccgtctacgtaccgtacgtaaccgttaggtaagtttacgtttacgtaaccgtttaaccgttacgtaccttacgtaacctaaaccgttacccgtttaacccgtttaacccccgttaccccggtaacgggttaccccggttaccgggaaccggtaacccgggggtacgtaacggggtaccgggaaaacccttaaccgtaaaacccgtaaacggttccggttaacgggtacggtccggttaccaaacgtcccttaacgtttcgttaccgtttccttaccgtccccgttaccccgg

SEQ ID NO: 243242 - DNA, 753 bp, Homo sapiens
  misc_feature: GYAE6OF01EX0ZW.23.24.C02.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatcgaccctagtctaccatccctcctgtctgcatctaggtaggganacacagtcaaccatcacgttcggccgggataacgtcgaagaacaattacgaactaacttaatttaaaagttggtaactaccgaccgtagaaccgggtaaccccgggaaaccgacccccgtacctaaccccgttacccgtagaacttaccgtaagtcgtaccgtcggtaccttacccttaacgtttaacgaaacggttaccggggtacccctaacgttaccgtaacggttcgtaaggttcggggccgggttaggtacgtcggttacgggaaccaaggttcgtaccgtaccgtcctactaacccactacgacgtacctagttaccgtgaccctacgtacgtaagtaacgttacgtttacgtaacttaaacctttacctaaccttagttaaccaacgtaacgttaccgtttaaccccttaacccccgtaagtacccggttaccggaacggaaccggggtaacgtaacgggtagaacctacgaacgtaaaccgtaacgtcggtagtccgtagaacctaccggtatcgttagttaccttcgtactttacccccgg

SEQ ID NO: 243243 - DNA, 936 bp, Homo sapiens
  misc_feature: GYAE6OF01BFNSN.23.24.C02.1.454.CMB.1.raw
  modified_base (101)..(101): a, c, t, g, unknown or other
  misc_feature (101)..(101): n is a, c, g, or t
  modified_base (209)..(209): a, c, t, g, unknown or other
  misc_feature (209)..(209): n is a, c, g, or t
tcagacgcgagtatcacgaccggtgctcgatttagtacagatcgttagggaaagggggagtcagtctcagtcaggacacagcatggacatgagggtccccntcagctccgtggggcctcctgctactctggctccggaggtgcagatgtgacatccaggactcgacccagtctccatccctcctgtcctagctactcgtgtacgggganaccacagtccaaccactcgtacgttcggacccggataagtccgaagtaacctaaattaccgtaacctaaacgttttaaagttttaaacgttaggtaccttaccggaaccgtaacggtaaacccggggaaacccccggaaaacccggtccccccttaacccctacccccgttaccgttaacggtaacgttacctacggttccggtcgttaacccggtcccgttaacccgtttaaaacccgtttaaaaccgggtaaaacgggggtttacccccgggacccctttaacgggttaacccggttaccggtttacgggtaacggttcgggggaccggggttatacggttcgggtaacgggtaacgtaacggttacgtacccgtacttacccgtaaccgtacgtctacgtacgtacgtacgtctacgtatacccggcgttaaacggttattacggtttaactacccgtttaaacgttaccttacgtaaacgttaacccgaaaccggttaaccgtttacccccggttaaacccctttaaccccggtaacgggtaaccccggttacccgggggtaaacccgtaaccggggggtaacccttaaacgggttaaccggtaacccgttaaacggaaaccccggtaaaaggtaccgggttaccggtaccgtcccggttaacgaacccgttaacccttagttcccgttaacttcccgtttaaccgttcccgttaaccccccg

SEQ ID NO: 243244 - DNA, 817 bp, Homo sapiens
  misc_feature: GYAE6OF01A57VT.23.24.C02.1.454.CMB.1.raw
  modified_base (205)..(205): a, c, t, g, unknown or other
  misc_feature (205)..(205): n is a, c, g, or t
tcagacgcgagtatcacgaccggtgctcgatttagtacagatcgttagggaaagggggagtcagtctcagtcaggacacagcatggacatgagggtccccgctcagctccgtggggctcctgctactctggctccggaggtggcagatgtacgacatccagatcgacccagtctccatccctcctgtctgctatcgtgtaggganacacagtccacctatacctacttcggcccggactaagtcagtacaattcgaactaaatttaattttaaagtcggtaacttccgacccgtaaggaaccggaaaccccggggtaaactccccccgtactacccgttacccgtaggtaacttaccgtaacgtcggtccttaccggtacccggtttaacccttaaacgttttaaaaccggaaacggggtttccccggggtacccctaacgttacccggttaaccggtttacgagggggttcggggaacggggttcgtaaacgtttcggacggggtaaacaacggggtttacgtttccaaccttacccgtacgaacccgttataccgagtaccgtaacgttccgtaacggcctaacggtaccgttaagtaacgttactttaccggtaaccttaaaccgtttacctaccgttacgtaacctaaacgtaccggtttaacccgtttaaccccttaaccccggtaagggttacccggttaccgggtaccggtaacgggtaaccgtaaggtacgaactaacgtaaacgtaaacgtacgtcggtacggtctacggactacctacgttccgttattccgtaacctcgttacccg

SEQ ID NO: 243245 - DNA, 503 bp, Homo sapiens
  misc_feature: GYAE6OF02IUXFG.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaattggtatcgccagagacccgggaaagcccctcacctcctgatctatgctgcgtcactttacaaagtgggtccatcacggttcagtggcgtggatctgggacagagttcactctcaccatcagcagtctgcagcctgaagtattttgactaacttactactgtcaacagagttaccctttccccaagtacgttcggcctaggggaccaaggtcgacatacgaaacgactagtggctgcacatctgtcttcattcc

SEQ ID NO: 243246 - DNA, 500 bp, Homo sapiens
  misc_feature: GYAE6OF02F2G0J.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaattggtatcgccagagacccgggaaagcccctcacctcctgatctatgctgcgtccactttacaaagtgggtcccatcacggttcagtggcggtggatctgggacagagttcactctcaccatcagcagtctgcagcctgaagattttgctaacttactactgtcaacagagttaccttccccaagtaccgttcggccagggaccaaggtgacatcaacgaactgtaggctgcaccatctgtcttcattccg

SEQ ID NO: 243247 - DNA, 539 bp, Homo sapiens
  misc_feature: GYAE6OF02JIJFQ.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaattggtatcgccagagacccgggaaagcccctcacctcctgatctatgctgcgtccactttacaaagtgggtcccatcacgttcagtggcggtggatcgtggacagagttcactctcacatcagcagtctgcagcctagaagtatttgctaacctttactactgtacaacagtacgtttacccttacccctaagaccgtttcggaccgtaacgggacccgaagggtcgaactactacgaaacgtaacgtggtaggctacgaccaaccgtatccgtgtcttactacttcccg

SEQ ID NO: 243248 - DNA, 566 bp, Homo sapiens
  misc_feature: GYAE6OF02GQH6T.23.24.C02.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtggganacacagtcaccatcacttgccgggnaagtcagacaattgacaactatttaaattggtatcgccagagacccggaaagcccctcaccctcctgatctatgctgcgtccactttacaaagtcgggtcccatcacggttcagtggcggtggatcgtgggacagagttcactctcaccatcagcagtctgcagcctagaagtattttgctaactttactactgtacaactagtacgttaccctttaccccgaagtaccgttaccggaccgacggggtaacccaaagggtacgaaccgtacgttaccgaaaaccggtaacttaggtacggtacctacgacctaacctagttccttcgtctttaccacttccccg

SEQ ID NO: 243249 - DNA, 503 bp, Homo sapiens
  misc_feature: GYAE6OF02GMI0Y.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaattggtatcgccagagacccgggaaagcccctcacctcctgatctatgctgcgtccactttacaaagtggggtcccatcacggttcagtggcggtggatctgggacagagttcactctcaccatcagcagtctgcagcctgaagattttgcaacttactactgtcaacagtagttacctttccccaagtacgttcggccaggggaccaaggtcgacatcaaacgaactgtggctgcaccatctgtcttcattccc

SEQ ID NO: 243250 - DNA, 541 bp, Homo sapiens
  misc_feature: GYAE6OF02JUFXZ.23.24.C02.1.454.CMB.1.raw
  modified_base (274)..(274): a, c, t, g, unknown or other
  misc_feature (274)..(274): n is a, c, g, or t
  modified_base (525)..(525): a, c, t, g, unknown or other
  misc_feature (525)..(525): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactattaaattggattcgccagagacccgggaaanccccgtactacctcctgatctatcgactgcgtccaactttacaaaggtgggtcccatcacggttcagtggcggtggatcgtgggacagtagttcaacgtctcaccatcagcagtctgcagcctgaacgtatttcgactaacttactacgtgtacaactagacgttacccttccccaagtccgttcggaccgacgggacctaaggtcgactataccgtaaacgacgtggacggtactggactaccactcgtntacgttctacttcccg

SEQ ID NO: 243251 - DNA, 503 bp, Homo sapiens
  misc_feature: GYAE6OF02GYTVL.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaattggtatcgccagagacccgggaaagcccctcacctcctgatctatgctgcgtccactttacaaagtggggtcccatcacggttcagtggcggtggatctgggacagagttcactctcaccatcagcagtctgcagcctgaagattttgctaacttactactgtcaacagtagttacctttccccaagtacgttcggccaggggaccaaggtgacatacaacgaactgtggctgcacatctgtcttcattcccg

SEQ ID NO: 243252 - DNA, 555 bp, Homo sapiens
  misc_feature: GYAE6OF02I4QDJ.23.24.C02.1.454.CMB.1.raw
  modified_base (380)..(380): a, c, t, g, unknown or other
  misc_feature (380)..(380): n is a, c, g, or t
tcagacgcgagtatcacgaccggtgctcgatttagtacagatcgttagggaaagggggagtcagtctcagtcaggacacagcatggacatgagggtccccgctcagctcctgggctcctgctactctggctccgaggtggcagatgtgacatccagatgacccagtctccatcctccctgtctgcatctgtgggagacacagtcaccatcacttgccgggcaagtcagacaattgacaactatttaaatgtatcgcagagacccgggaaagcccctcacctcctgatctatgctgcgtccactttacaagtgggtcccatcacggtcagtggcggtgatcgtgggacagagttcactctccaactatcagcagtctgacngcctagaagtatttgactaacttactcttagtacaacgtacgtacgttaccctttacccccgaaagtaccgttaccgggaccgaacggggtaacccaagggtacgacacgtaccaaacggtaactcggtaggccttcggactaccctagtccttggtcctttacgactttccccg

SEQ ID NO: 243253 - DNA, 584 bp, Homo sapiens
  misc_feature: GYAE6OF02I27CU.23.24.C02.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
tcagacgcgagtatcacgaccggtgctcgatttagtacagatcgttagggaaagggggagtcagtctcagtcaggacacagcatggacatgagggtccccgctcagctcctgggctcctgctactctggctccgaggtggcagatgtgacatccagatgacccagtctccatcctccctgtctgcatctgtggganacacagtcaccatccacttgccgggnaagtcagacaattgacactattaatgtatcgccagagacccgggaaagcccctnacccgtctgatctatgctgcgtccactttacaaagtgggtcccatcacggttcagtggcggtgatctgggacagagttcactctcaccatcagcagtctgcagcctgaatattttagctaacttactaactgtaccaactacgtaacgtttaccctttacccccgtaagtaccggttaccggtccgaacggggtaccgaaacgggttaggaaccgtactaaccgaaaccggtaaaccgttacggttacgggtaccttaggacctaacccgtacttaccgttacgttaccgtttcctactttacccccg

SEQ ID NO: 243254 - DNA, 526 bp, Homo sapiens
  misc_feature: GYAE6OF02HJJGS.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaattggtatcgccagagacccgggaaagcccctcacctcctgatctatgctgcgtccactttacaaagtgggtcccatcacggttcagtggcggtggatcgtgggacagagttcactctcaccatcagcagtctgcagcctagaagtattttgactaacttactactgtacaacagtacgttaccctttaccccaagtaccgttcggcccgaaggggaccaagggtgacagtacaaacgtaactagtggctgaccaccatcctgttccttacattcccg

SEQ ID NO: 243255 - DNA, 699 bp, Homo sapiens
  misc_feature: GYAE6OF02IC1RG.23.24.C02.1.454.CMB.1.raw
  modified_base (168)..(168): a, c, t, g, unknown or other
  misc_feature (168)..(168): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
tcagacgcgagtatcacgaccggtgctcgatttagtacagatcgttagggaaggggagtcagtctcagtcaggacacagcatggacatgagggtccccgctcagctcctggggctcctgctactctggcctccgaggtggcagatgtgacatccagatgacccagtcnccatccctcccgtgtactgcactctggtggganacacgataccnccaatccacttggcccgggcaaagtccaagacaattcgacaactaattaattagtatcgacagacgaccggaacgccctacaccctacctacgatctatacgtcgtaaacgtcgtacctaactttacgaacgttcgggtacccgtactcgtaccggttacgtacggtacgggtcggtcggtagtcgtacgggtacgtaagtacgtctactcgtccaactactaccgtacgaccgtacggtcgtcgtaccgtacgtaccgtacggtaacgttacgttttacggtactaaccgtttacccgtttaccttacgttaaccgtaaccttaacgtaaccgtttaacccgtttacccctaacggtaccgttaccggtacccggtaacgggtaccggtaacgggtacgtaacgacgtaccgaaccgtaacggtacggtacggtaccgtacgtaccgtacgacttaccgttacgttaccttaccgtaccttacccg

SEQ ID NO: 243256 - DNA, 565 bp, Homo sapiens
  misc_feature: GYAE6OF02I8PH9.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaatggtatcgcagagacccgggaaagcccctcacctcctgatctatgctgcgtccactttacaaagtgggtcccatcacggttcagtggcggtggatcgtgggacagagttcactctcaccatcagcagtctgcagcctagaagtatttgactaacttactactgtacaactagtacgtttacccttaccccgaaagtaccgttccggaccgtaacggggacctaaagggtcgaaccagttaccaaaacggtaacgttacggtacggtaccttacgaccaccgtacgttaccgttaggttacctttaccatttccccg

SEQ ID NO: 243257 - DNA, 544 bp, Homo sapiens
  misc_feature: GYAE6OF02HDLOU.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaattggtatcgccagagacccgggaaagcccctcacctcctgactctatgctgcgtccactttacaaagtcgggtcccatcgacggttcagtggcggtggatcgtgggacagagttcactctcaccatcagcagtctgcagcctagaagtattttgactaactttactacttgtacaaactagtacgtttaaccctttccccaaagtaccgtttccggaccgtaggggacccaagggtcggaacactacgaaacgtaactgtacggctagacaccattcctagtcttacacttcccg

SEQ ID NO: 243258 - DNA, 547 bp, Homo sapiens
  misc_feature: GYAE6OF02F6SQU.23.24.C02.1.454.CMB.1.raw
  modified_base (197)..(197): a, c, t, g, unknown or other
  misc_feature (197)..(197): n is a, c, g, or t
  modified_base (534)..(534): a, c, t, g, unknown or other
  misc_feature (534)..(534): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtggganacacagtcaccatcacttgccgggcaagtcagacaattgacaactatttaaattggtaatcgccagagacccgggaaagcccctcacctcctgatctatgctgcgtccactttacaaagtgggtccatcacggttcagtgcggtgatgtggacagagttcactctcaccatcagcagtctgcagcctgaagtattttgctaacgttactacctgtaccaaactagtaacgtttaccctttcccccgtaaacgtaccggtttacgggacccgtaacggggacccaaagggtcggaactactaccgaaacgtaactgtaggactcgacaccactccgtntcttcacttcccg

SEQ ID NO: 243259 - DNA, 510 bp, Homo sapiens
  misc_feature: GYAE6OF02FS3GN.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaattgtatcgccagagacccgggaaagccccctcacctcctgatctatgctgcgtccactttacaaagtgggtccatcacggttcagtggcggtggatcgtgggacagagttcactctcacatcagcagtctgcagcctagaagtattttgactaacttactactgtacaacagtacttaccctttaccccaagtaccgttccgaccgaacgggaccaaggtgacatacaacgtaactgtcgctgcacactctgtcttcatcc

SEQ ID NO: 243260 - DNA, 579 bp, Homo sapiens
  misc_feature: GYAE6OF02J1ZEX.23.24.C02.1.454.CMB.1.raw
  modified_base (398)..(398): a, c, t, g, unknown or other
  misc_feature (398)..(398): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactattaaatgtatcgcagagaccggaagcccctcacctcctgactctatgctgcgtcctactttacaaagtcgggtccctatcgtacggtcagtggcggtggatcgtagggacagacgttcactctcacctactacagcagtctgcagcctagaagtntttgactaacttactactgtacaacgtacgtacttaccctttaccccaagtaccgttaccggaccgtaacggggacctaagggtacgtaacctacgtaccgaaaccggtaaccgttggtacggtaccgtacggtacctaacccgttacgtaccgttgttacccgtttactactttaccccg

SEQ ID NO: 243261 - DNA, 543 bp, Homo sapiens
  misc_feature: GYAE6OF02F4BVF.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatccctccctgtctgcatctgtgggagacacagtcaccatcacttgccgggcaagtcagacaattgacaactatttaaattggtatcgccagagacccgggaaagccccctcaccctcctgatctatgctgcgtccactttacaaagtgggtcccatcacggttcagtggcggtggatcgtgggacagagttcactctcaccatcagcagtctgcagcctagaagtattttgactaacttactactgtacaactagtacgtttaccctttccccgaagtaccgttaccggaccgaacggggacctaagggtacgacacgtacgaaacggtaactagtacggctagccactactccgtgtcttctattccccg

SEQ ID NO: 243262 - DNA, 556 bp, Homo sapiens
  misc_feature: GYAE6OF02FO0JI.23.24.C02.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (377)..(377): a, c, t, g, unknown or other
  misc_feature (377)..(377): n is a, c, g, or t
  modified_base (547)..(547): a, c, t, g, unknown or other
  misc_feature (547)..(547): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtggcatccagatgacccagtctccatcctccctgtctgcatctgtggganacacagtcaccatcacttgccggnaagtcagacaattgacaactatttaaattggtatcgccagagacccgggaaagcccctcacctcctggatctatgctgcgtccactttaacaagtgggtcccatcacggttcagtggcggtggatcgtgggacaggtagttcacgtctcacatcancagtctgcacgcctagaagtattttgacctaaactttactaccttagtaccaaacgacgtacgtttaacccctttaccccgaaagttaccgttcggacccgaaggggaccaagggtcgactataccaaacgtaacgtgtacggtctagccaccgatccgttgttaccttnaccttcccg

SEQ ID NO: 243263 - DNA, 627 bp, Homo sapiens
  misc_feature: GYAE6OF02HILUQ.23.24.C02.1.454.CMB.1.raw
  modified_base (197)..(197): a, c, t, g, unknown or other
  misc_feature (197)..(197): n is a, c, g, or t
  modified_base (375)..(375): a, c, t, g, unknown or other
  misc_feature (375)..(375): n is a, c, g, or t
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtggganacacagtcaccatcacttgccgggcaagtcagacaattgaacaacttatttaaattggtatcgccagacgaacccggaaacgcccctcaacctcctgactctatcgctcgccgtcctaactttaacgaaagtcggggtacccagtcctacggttcaggtggcggtggatcgtgggacngtagttcactcctcaccatcagctacgtcngcagcctagaagttntttacgacttaacttactctacgtacaacgtacgtaacgtttaccccttaccccgaagtacccggtttaccgggaccgggtaaccgggtaacgtaacgggtacgaactaaccgtaaacggtaaacccgtgggttaccgtacggtaccgttacgaccgtaaccgttacgttccgtttacggttaccgtttaccttaccgtttcccccg

SEQ ID NO: 243264 - DNA, 600 bp, Homo sapiens
  misc_feature: GYAE6OF02ILAO7.23.24.C02.1.454.CMB.1.raw
  modified_base (275)..(275): a, c, t, g, unknown or other
  misc_feature (275)..(275): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactaatttaatggtatcgcagacgacccgggaaacncccctcacctcctgactctatcgctcgacctcctaacttaacgaacgggtcggtacccagtcgtacggttacgaggtgggtcggtggtacgtcgtaggacagtacgttacactcctcacctactcacgactagtctacgcacgtccgtagtaacgttgtttaccgtaacttaaacctttctaacgtactaaccaacgtacgttacctttaccccttacccgaagtaccggttccggaccgaacgggaacgaacggtacgactacgtacgtaaacgtcgtcgtcggactacgactacctattccgtcgtaccttcgtaccttcccg

SEQ ID NO: 243265 - DNA, 573 bp, Homo sapiens
  misc_feature: GYAE6OF02HE169.23.24.C02.1.454.CMB.1.raw
  modified_base (197)..(197): a, c, t, g, unknown or other
  misc_feature (197)..(197): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtggganacacagtcaccatcacttgccggcaagtcagacaattgacaactatttaaattggtatcgcagacgacccgggaaagcccctacacctcctgactctatgctgcgtcctacttaacaaaggtcgggtacccatcacggttcaggttggcggtggacgtcgtagggacagtacgttcactctcaccatacagctagtctgcagccgtagaagttatttcgactaactttactactcgtacaaacgtagtaccgtttaccctttacccgaagttaccggttcggacccgtaacggggaccaagggtacgaacctacgtaacgaaacgtacgtaggtacggtactacgaccactactcgtcgttacttcgtacttcccg

SEQ ID NO: 243266 - DNA, 633 bp, Homo sapiens
  misc_feature: GYAE6OF02JG0FU.23.24.C02.1.454.CMB.1.raw
  modified_base (221)..(221): a, c, t, g, unknown or other
  misc_feature (221)..(221): n is a, c, g, or t
  modified_base (252)..(252): a, c, t, g, unknown or other
  misc_feature (252)..(252): n is a, c, g, or t
  modified_base (288)..(288): a, c, t, g, unknown or other
  misc_feature (288)..(288): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggacacacagtcaccatcacttgccggnaagtcagacaattgacactattaatgtatcncagagaccggaagcccctacacctcctgactctatnctacgctccgtacttaacgaagtcgggtaccagtctacggttcaggttggcggtggacgtcgtgggaccgtagacgttacacgtctacaccgattccacggtactaagttccgtacgtcgaacgtacccgttaggaaacgtttactttaggtaaccttaaacttaaccttacgttcgtaactaacctaaggttaccgtttacccctttacccgtaaacgttaaccggtccgggtaaccgaacgggtaaccgtaacgggtacgtacacgttaccgaaaacgtaacggtttacggacgtaccgtagacccgtacgtacgtcttacggtaccttacgacctttacccg

SEQ ID NO: 243267 - DNA, 759 bp, Homo sapiens
  misc_feature: GYAE6OF02G7I8G.23.24.C02.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtcctccatccctccctgtctgcatctgtggganacacagtccaccatccacttggccggnaagtcagacaattgacaacttatttaaagttggtatcgaccaagacgaacccgggaaacgcccctacacctcctagactctatcgctcgtccgtacctaactttaacgaaaggttcggggtacccctaagtaccgtaccggtttacgacggttacgggacgggttaggtaacgtttccggtaggggtaccgtaacggtacggtttaccctacgttacccgttacccaacccgtactaccgaacggtacccgtaacggttccgttacgaccgtaacgtacccgttaaggtaaacggttattttaccggaaccttaaaccgtttaactacgttacgtaaccaaacgttaacggttaaccttttaacccccttaccccgaaaggttacccggtttaccgggacccggtaaacgggggtaaaccctaaaggggtaccgaacctacgtaaccgtaaaaccggtaacgttcggtacgggtccgtacgtaacccgacctacgttaccgttccggtttacctttaccgacgtttacccccg

SEQ ID NO: 243268 - DNA, 598 bp, Homo sapiens
  misc_feature: GYAE6OF02H93D5.23.24.C02.1.454.CMB.1.raw
  modified_base (590)..(590): a, c, t, g, unknown or other
  misc_feature (590)..(590): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattcgactaaactatttaaattggtatcgccagtacgaacccgggaaacgcccctacacctcctgactctatgtctcgtcgtcctactttacaaaggtccgggtaccagtccgacggttcaggtcgggtcgggtggactcgtagggacgagtacgttcactcctacacctataccagtctaagtctcgctacgccctaggtaagtacgttttgacttaaactttactaacttcgtactaactagttaaccttacccgtttaccccaacgtcggttaccggccgaacgggacgaacggtgaaccacgtaacgaaacgtacgttgtacggcgtagaccgactactccgttagtcttaccntttccccg

SEQ ID NO: 243269 - DNA, 665 bp, Homo sapiens
  misc_feature: GYAE6OF02HNHLJ.23.24.C02.1.454.CMB.1.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatcgtgtggganacacagtcaccatcacttgccggnaagtcagacaatgacaacttatttaattgtatcgcagacgaccggaancccctacacctcctgactctatgtctgccgtcctactttaacaaaggtcggggtaccctagtccgtacggttcgaggtcggcggtagtacgtcgtagggacgagtacgtactacgtcctacaccacgtacaacggtctaacggttctcggaccacgtccgttaaggaactttaacgtttacgaaccttaaaccgtttacttaaccgtagtaacctaaaccgtacggttaacccgttttacccgttaaccccgtaacggttacccggttacggtacccgggtaacgggtaaaccgtaacgggtaacgtaaccgtactaaccggtaaacggtacgttacggtacgtacggtacgaccgtaccttcggtaccttggttaccttacgtcttaaccccgg

SEQ ID NO: 243270 - DNA, 756 bp, Homo sapiens
  misc_feature: GYAE6OF02JY70F.23.24.C02.1.454.CMB.1.raw
  modified_base (153)..(153): a, c, t, g, unknown or other
  misc_feature (153)..(153): n is a, c, g, or t
  modified_base (206)..(206): a, c, t, g, unknown or other
  misc_feature (206)..(206): n is a, c, g, or t
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
tcagacgcgagtatcacgaccggtgctcgatttagtacagatcgttagggaaagggggagtcagtctcagtcaggacacagcatggacatgagggtccccgctcagctccgtggggctcctgctactctggctccgaggtggcagatgtgacntccagatcgacccctagtctcccatcccctcctgtcctgcattctggtggganacacaagtcaccgatctacgtcggcccgggataacgcaagtacattcgaactaattaacttaaattggtactccggactaacggaggaacccggtaaacgccccctanaccctctgactcntagctgtccgtacctacgttaactaacggtcggtaccagtaccgtaggttccaggtcgggtagggttacgagttccggtaggaactacggtaacgttcaaacccgttcgtaccctaccgagttaaccgacgtacggttacgttccggtacgacctacggtacgttacggtaagttttaccgttagaccttttaaactacccgtttacgttaaacgccaaaacggttaccgttaacccggtttaacccccttaacccccgaagggtttaaccccgggttaccgggtaaaccggtaacccggggtaaaccggtaacgggttaaccgtacccaagttaaacccgaaacgttaaccgggttcgacttcccgggaagtaccccttacgttaaccgtccggttacgttttaccctttaccgtcccgtttaccccg

SEQ ID NO: 243271 - DNA, 684 bp, Homo sapiens
  misc_feature: GYAE6OF02FKZ32.23.24.C02.1.454.CMB.1.raw
  modified_base (289)..(289): a, c, t, g, unknown or other
  misc_feature (289)..(289): n is a, c, g, or t
tcagacgcgagtatcacgaccggtgctcgatttagtacagatcgttagggaaagggggagtcagtctcagtcaggacacagcatggactatgagggtccccgctcagctcctggggctcctgctactctggctccgaggtggcagatgtgacatccagatgacccagtctccatccctccctgtctgcatctggtgggagacactagtccaccatcacttgccgggcaagtcagactaattgaactaactaatttaaattggtaatcgaccagacggacccgggaaacnccccctactaccctccgtagactcgtagtcgcctgccgttacctactttaacgaaaggtcgggtacccagtcgtacggttcaggttcggcgggtacgtagtccgtagggtacagtagttccacctcctaccacctatccaagtcagtctagcgtagtccctagtaacgttacttttacgtaaacctttacttacgttagtaactaacgtaggttaaccgtttaccccgtttaaccccgaaaggttacccggtttccgggaacccgtaaacgggggtaaccctaaagggtaccggtaacaactaccgaaaacgtaccggttacgtagggtacctacgtaccctaacttacgttccgttaaccggttctttaccgttaccttccccgttaaccccgg

SEQ ID NO: 243272 - DNA, 647 bp, Homo sapiens
  misc_feature: GYAE6OF02HMA6J.23.24.C02.1.454.CMB.1.raw
  modified_base (197)..(197): a, c, t, g, unknown or other
  misc_feature (197)..(197): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatcctccctgtctgcatctgtggganacactagtcaccatcacttcgccgggacaagtcagacaattgacaactatttaaagttgtatcgcagacgaccggaacgcccctcaccctctgacttctatcgctcgccgtacctactttaacgaaaggtccgggtacctagtccgtacggttcgaggtcggacggtggacttcgtagggacaacgtacgttacaccgtcctaccacctagtccgaacgctaacggttcctggaccacgtacgtagtaacgtagttttacgacttaacttaccttacgtacgtacctaaacgtacgtaccgtttaaccccgttacccgaacggttaccggttccggaaccgtaacgggtaccgtaagggtacgaaccgtacgtaaccgtaaaccggtactacggtacggtacctacgtacctaccattccgttacgtttccttacctaccgtttaccccg

SEQ ID NO: 243273 - DNA, 579 bp, Homo sapiens
  misc_feature: GYAE6OF02FJ2I1.23.24.C02.1.454.CMB.1.raw
  modified_base (375)..(375): a, c, t, g, unknown or other
  misc_feature (375)..(375): n is a, c, g, or t
  modified_base (446)..(446): a, c, t, g, unknown or other
  misc_feature (446)..(446): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatccctccctgtctgcatctgtgggagacacagtcaccatcacgttcgccgggcaagtcagacaattgacaactatttaaattggtatcgcagagacccgggaaacgccccctacaccctcctgtactctagtgtctcgtcgtccctacttttaacgaaacgttcggggtccccatcgacggttcagtcgggcggtggatccgnggtacagacgttcactctaccaccatcagcagtctgacagccgtagaatagtttcgactaacttactactntacaacgagttaccgttaccctttacccgaagtaccgttacgccgacgggtaaccgaaggtacgactactacgaacgtaacgtgtacggcttacgccgaacctcgtacgttcgttccttacctcgttaccccg

SEQ ID NO: 243274 - DNA, 794 bp, Homo sapiens
  misc_feature: GYAE6OF02FN5CG.23.24.C02.1.454.CMB.1.raw
  modified_base (277)..(277): a, c, t, g, unknown or other
  misc_feature (277)..(277): n is a, c, g, or t
  modified_base (779)..(779): a, c, t, g, unknown or other
  misc_feature (779)..(779): n is a, c, g, or t
tcagacgcgagtatcacgaccggtgctcgatttagtacagatcgttagggaaagggggagtcagtctcagtcaggacacagcatggacatgagggtccccgctcagctcctgggctcctgctactctggctccgaggtggcagatgtgacatccagatgacccagtctccatcctcctgtctgcatctgtgggagacacagtccaccatcctacgttggccggacaagtcagacaattgaacactaatttaattagtatcgccagacgacccggaancccctacacctactcgactcgtactacgtctcgtccgttacctaacgtttaacgaaaggttccggggtaccctacgttaccgaccggtttcgaaggttcgggtacgggtgggtacgttcggtacgggactacggtacgttacaacgttcctaccgtaacctagttaccgaaacggtccgttaacggttccgttacggaacccgtaccgtaaccggttaacggttaagttaacgtttttaccgggaacctttaaaccgttttaaccttaccggtttaccgttaaaccgtaaaccggttaaccggtttaacccggttttaacccccggtttttaaacccctaaacggggtttaacccgtttaccccgggaccggtaaaaccggggtacccgttaaagggggttacccggaaacttacccggtaacgtaaaaccggttaaccggtaggttaccgaccggttccgaaccgtaccttaccggtttaccgtctttacccggtttaccnccgttttaaccccgg

SEQ ID NO: 243275 - DNA, 649 bp, Homo sapiens
  misc_feature: GYAE6OF02JK8SP.23.24.C02.1.454.CMB.1.raw
  modified_base (202)..(202): a, c, t, g, unknown or other
  misc_feature (202)..(202): n is a, c, g, or t
  modified_base (223)..(223): a, c, t, g, unknown or other
  misc_feature (223)..(223): n is a, c, g, or t
  modified_base (403)..(403): a, c, t, g, unknown or other
  misc_feature (403)..(403): n is a, c, g, or t
tcagacgcgagtatcacgaccggtgctcgatttagtacagatcgttagggaaagggggaggtcgagtctcagtcaggacacagcatggacatgagggtccccgctcagctcctgggctcctgctactctggctccgaggtggcagatgtgacatccagatgacccagtctccatcctcctgtctgcatctgtgggacacacngtcaccatcacttcgccgganaacgtcagactaattcgacaactaattaaattgtatacgtacagacgaaccggaacgccctcacctcacgatactatgctgcgtcctacttacaagtcgggtaccatcgacgtcgacgtggtcgtagactcgacggacgacgtaacgttcactcgtacaccgtactacgacgtcagttcngacgacgtacgtagaacgttacgtttacgaccgtaactttactaccgtagtacctaacgtacgttaacctttaccccttaacccgaaagttccggttaccgggacccttaacgggggtaaaccgaacggtacggtaactaccggttaaaccgaaaccgtcggtttaacggtcgttaaacccggtagtaccccgtaaaccgtacgtttaccgttaaccggtttaccgttacttaaccccggttcccc

SEQ ID NO: 243276 - DNA, 647 bp, Homo sapiens
  misc_feature: GYAE6OF02FSBEB.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatccctccctgtctgcatctggtgggagacacagtcaccatcacttcggccgggcaagtcagacaattgacaactatttaattggtatcgcagagacccgggaagcccctcacctctgactctatgctgccgtccctagtttaacaaaggtcggggtccctaatccgtacgttcgagtgggacgggtggacttcgtgggacctaaggtacggttccacttcctacacctatccagcacgtctgacacgtccgtagaagttagttttacgactaactttacctacgttcgtacctaaacgtacgttaaccctttacccgtttacccccgaacgttacccggttacccggtaccggtaaccggggtaacccgtaaagggtaccgtaaccgtacgtaaccggaaacgttaacggtcggtaccggtaccgtacgtaccgaccctacgtttaccgtcgtttaccttaccgtactttccccg

SEQ ID NO: 243277 - DNA, 819 bp, Homo sapiens
  misc_feature: GYAE6OF02FY0VT.23.24.C02.1.454.CMB.1.raw
  modified_base (200)..(200): a, c, t, g, unknown or other
  misc_feature (200)..(200): n is a, c, g, or t
  modified_base (287)..(287): a, c, t, g, unknown or other
  misc_feature (287)..(287): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccggaggtggcagatgtgacatccagatgacccagtctccatccctccctgtctgcatctggtggganacacagtccacatccacttcggccgggacaagtcaagaactaagtgaactaactatttaaattgtatcgacagacggacccggaaancccctacaccctctgactctatcgctcgccgtaccctaactttaacgaaacggtcggggtaccctacgtcgtaccggttacgtacggtggggtaccggtggaacttggtacgggtacaggtacgttacctacgttacctcccgaacctacgttaccgaacggtaccgtacggttaccgtcggacccgtaacggtacccgttaaggtaaacggtttaacgttttttacgggaaacccctttaaacgtttttaacccgtttaccgttaaaccgttaccgtaaaacccggtaaccgtttaaaccggtttttaacccccccgttttaaccccggaaacggggttttaacccccggtttaaccggggtaaccccgggtaaaccgggggggttaaaccctaaacgggggttacgtaaacccgtacgggtaaacccgtaaaacggttaaccgggttaacggtaccggttaaccgtacccggaccgttaaccctcggtttacccgtttaggttaccctttaccgtaaccctttcccccgg

SEQ ID NO: 243278 - DNA, 639 bp, Homo sapiens
  misc_feature: GYAE6OF02IBTH2.23.24.C02.1.454.CMB.1.raw
  modified_base (294)..(294): a, c, t, g, unknown or other
  misc_feature (294)..(294): n is a, c, g, or t
  modified_base (321)..(321): a, c, t, g, unknown or other
  misc_feature (321)..(321): n is a, c, g, or t
  modified_base (432)..(432): a, c, t, g, unknown or other
  misc_feature (432)..(432): n is a, c, g, or t
  modified_base (461)..(461): a, c, t, g, unknown or other
  misc_feature (461)..(461): n is a, c, g, or t
  modified_base (631)..(631): a, c, t, g, unknown or other
  misc_feature (631)..(631): n is a, c, g, or t
tcagacgcgagtatcacgaccggtgctcgatttagtacagatcgttagggaaagggggagtcagtctcagtcaggacacagcatggacatgagggtccccgctcagctccgtgggctcctgctactcgtggcctccggaggtggcagatggtgacatccagatgacccagtctccatccctcctgtctgctatcctggtggacgacacagtccacacgtcacgttggccggacaagtcagactagttagaactacttaatttaacgtgtactcgccaaggacgacccggaaacncccctacgaccttcctagacttctacncgtaccgtcgccgttacctacgtttaacgaacggttcgggtcctagtaccgtacggttcaggtcggacggttacgagtcgtagggacgagtacgtcacgtcctacacgtancgacgctagtctgcacgtactagtacgtntttacgactacttactacgtactacgtaacgtacgttactttaccccgttaccctaaggtcccggtttaccggaccgggtaaccggtaaccgaaggtacgtaactacggtaaacaaccggtaccggtaggttaccgcgttacggacctacgtcttacggtctacgttacncttacccg

SEQ ID NO: 243279 - DNA, 634 bp, Homo sapiens
  misc_feature: GYAE6OF02GYM15.23.24.C02.1.454.CMB.1.raw
  modified_base (199)..(199): a, c, t, g, unknown or other
  misc_feature (199)..(199): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatccctccctgtctgcatctggtggganacacagtccaccatccacgttcggcccgggacaagtcagactaatgactaacttaatttaaattggtatcgacagacggacccgggaaacgcccctacacctcctgactctatgctcgcgtcctaactttacgaaggtcgggtaccagtccgtacggttcgaggtcgggcggtggtatcggtaggacgtagtacgttcactcctaccaccatccgagcgtaagtccgtgaccgtacgccgtaggtaacgttagtttcgacttaaacttaccgtactacgtacaacgtacgttacctttacccctttaacccgacgttaccggttccgaccgggtaaggggtaccctaagggtacgaactagtaaccgaaacggtacgtacggtcggtactacgacctaccgtcttccgttcgttaccttcctacgttacccccgg

SEQ ID NO: 243280 - DNA, 840 bp, Homo sapiens
  misc_feature: GYAE6OF02IY4HJ.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctccgtggggctcctgctactctggctccgaggtggcagatgtgacatccagatcgacccagtcctccactccctccctgtctgctatctggtggagacacagtcaccatcacttcggccgggacaagtcagaactaattcgaacaaacttaattttaaaagttggtaacttaccgaccgtaaacggaaccggaaaccccggggaaaacgtcccccctacctaacccgtcccgtacggtaacttacttacgtcgtccgtacgtccgtaaccctaaccgtttaaacggaaaacgggttccggggtacccctaacgttaccggtaacggttacgtaagggttcggggtaccgggtaggtacgttccggtaggggaacgtaacgggttacgttacctaccgttacctaccgtaacccgtataccgaacgtaccgtacgttaccgtacggtaccgacgtaccgttaaggtaaacgttaagtttttaccggaacctttaaaccgtttaaccttaaccgtaacgttaaacgtaaaccgtaaccgttaaaccggttttaacccccttttaaccccggtaaacggttaacccgggttaccgggaacccgggtaaaccggggtaacccgttaaaggggtaccgtaaccgtaccgtaacgtaaaaccggtacggtacgggtacggtacctaccgggtacctaccgtacgttaccgttcggttaccttacctacccgttaccccg

SEQ ID NO: 243281 - DNA, 588 bp, Homo sapiens
  misc_feature: GYAE6OF02I7KB9.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctgggctcctgctactctggctccgaggtggcagatgtgacatccagatgacccagtctccatcctcctgtctgcatctgtgggagacacagtcaccatcacttgccgggacagtcagacaattgacaactattaatgtatcgcagacgacccggaacgcccctcacctcctcgactctatgctgccgtcctactttacgaaaggtcgggtaccatcgacggttcagtcggcggtggatcgtggacagtagttcactctcacatcagctagtcgtgcacgtcctagtaagtagtttacgacttaacttactacgtactacgaactacgttacgttaccctttacccgaacgtaccggttaccggaccgtaacgggtacccgtaaagggtcgaaccgtacgtaaccgtaaacggtaacgttacggtcggtaccgtcgaccctacgtacgttccgttacgttaccttacgtacttaccccg

SEQ ID NO: 243282 - DNA, 843 bp, Homo sapiens
  misc_feature: GYAE6OF02HXBRD.23.24.C02.1.454.CMB.1.raw
  modified_base (206)..(206): a, c, t, g, unknown or other
  misc_feature (206)..(206): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (473)..(473): a, c, t, g, unknown or other
  misc_feature (473)..(473): n is a, c, g, or t
tcagacgcgagtatcacgaccggtgctcgatttagtacagatcgttaggggaaagggggagtcagtctcagtcaggacacagcatggacatgagggtccccgctcagctccgtggggctccgtgctactctggctccggaggtggcagatgtgacatccagatacgaccagtcctccactccctcctgtctgccatctggtggganacactagtaccaacctatcctacttcgggaccgggaccaaggtcagaactaattacgaactaacgttaatttaaagttgtactaccgaccgaaggaaccggaacccgggaacctccccgtactacctccgtanacttacctaanggtactacgccgtaccttaacttaagaacgggttcgggtaccagtaccgtacggtacgtagggttcgggtacgggtaggacgttacggtacggggaacgtacggtagtttaaccacccgttanaaccccgtaacctaacgtacccgacggtaccgttaacggttccgtacggtacccgtaaccggtaacgtaacggttaaaccgttttaggtttaaccttaaacccggtttaaacctttaacccgtttaaccgttaacgttaaacccgaaaccgtttaaaccggtttaaaccccgtttttaacccccgtttaaccccgtaaaccggggttaccccgggttaacccgggtaaccggggtaaaccgggtaaccggtaaacggggttacgaacccgtaaacgtaaccggtaaccgtaaccggtttacgtacggaccgttacgaaccggtaacctcgtttaccgtaccggtttacttacccggtacctttacccccg

SEQ ID NO: 243283 - DNA, 987 bp, Homo sapiens
  misc_feature: GYAE6OF02IMZ3P.23.24.C02.1.454.CMB.1.raw
  modified_base (196)..(196): a, c, t, g, unknown or other
  misc_feature (196)..(196): n is a, c, g, or t
tcagacgcgagtatcacgaccggtgctcgatttagtacagatcgttagggaaagggggagtcagtctcagtcaggacacagcatggacatgagggtccccgctcagctcctgggctcctgctactctggctccgaggtggcagatgtgacatccagatgacccagtctaccatcctcctgtctgcatctgtggganacacagtcaccatcacttcgccggacaagtcagactaattcgaactaaacgttaatttaaacgttaggtacttaccgacctaaggaaccggaaaccccggggtaaaacgtcccccctacctaacccttaccgtcgtacttccttatcggtcctcgtaccgttaccttaccgttttaaacgtaaacggttccgggtacccctaacgttccggtaacggttcgtacgggtacggggtacggggttacgtacggtttccggttacggggaaccgtacgggttaacccgttttaccgacccgttttacccggtaacccttaaacccgtacgttaacccgtaagggtaacccgtaccggttaacgttacggtaaccggttaaccggtaaccggttaacggtttaaacggttttaacgttttttaaccggaacccctttaaaaacccgtttttaaccgtttaacccgtttaaacgtaacccgttaaaaccccggttaaaccgggttttaaaccccggtttttttaaaacccccgtttaacccccccgggtaaaaacggggtttttaacccccgggtttaccccggggtaaacccggggttaaacccggggggttaaacccggttaaaacgggggttaacccgggtaaaactaccggttaaacccggtaaaaaacccgggttaccgggtttaacggggtcccggtaaccgtttacccgggtaaacccttacccggtaaaccgtttccggttttaacccggtttaacccctttccggtaaccccgtttttaacccccgg

SEQ ID NO: 243284 - DNA, 831 bp, Homo sapiens
  misc_feature: GYAE6OF02JUWAE.23.24.C02.1.454.CMB.1.raw
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtgcagatgtgacatccagatgacccagtctccactccctcctgtctgctactcgtggtgggaanaccgacngtccacctatcaccgttggaccgggctaaagtccgaagtaacaatttcgaacctaacttaatttaagtcgtaatcaccgagacggacccggtaaacgcccctacaccctcgtagactcgtactcgctacgtacgtaccctaattaaccgtaaggtccgggtccccaagttccgtaacggttccagggtcggtcggacgttcgtacgtcgggtaacaacggttcttacccgaaccttcctaacccgaccgtagtaccgtaccggtaacgtccggttaccgtacggaaccttccgggtaccttaacgggtaaaccggttacgtttttaacccggaaactttaacccgttttaaaccggttacccgttaaacgttaccccgtaaaacggttaaccggttttaccccgtttaaacccccggtttaacccccgtaccggggttaaaccccggttttacccggggaacccgggttaaaacccggggttaccgtaaaccgggtttaccggtaaccgtaaccgttaaccggtttaaacccggaaccggtttcggtttaaacggccgtaaccgttacccggaacgtttccgtaccggttacccgttacgtttacccgtacgtttacccccg

SEQ ID NO: 243285 - DNA, 701 bp, Homo sapiens
  misc_feature: GYAE6OF02GZUDA.23.24.C02.1.454.CMB.1.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (284)..(284): a, c, t, g, unknown or other
  misc_feature (284)..(284): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (397)..(397): a, c, t, g, unknown or other
  misc_feature (397)..(397): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtgcagatgtgacatccagatgacccagtctccatccctccctgtctgcatcgtgtggganacacagtccacatcacgttggccgganaacgtcagacaattgaacaactatttaaagttggtatcgaccagacgacccgggaaacncccctacaccctcctagacttctagtgctgccgtacctacttacgaagtcgggtccagtcacgtcagtgnggtgatcgnggacagacgttcactcacacatcagactagtcancagcctagaagttctttacgactaaacttactacgtacgtacctaaacgtagttacccggtttaaacccctttaccccggaaaacgttacccgggtttaacccggacccgggtaaaacgggggtaaaccccgtaaaaggggttaacggtaaacccgtaacgttaaacccggtaaaaccggttaaacccgggtacgggttaacgggaacccgtttaaccgggtaacccctaaaccccgggttaacttttaacccgggttaccggttttaacccgtttaacccgttaccccgttttaaccccccgg

SEQ ID NO: 243286 - DNA, 726 bp, Homo sapiens
  misc_feature: GYAE6OF02JW751.23.24.C02.1.454.CMB.1.raw
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (684)..(684): a, c, t, g, unknown or other
  misc_feature (684)..(684): n is a, c, g, or t
tcagacgcgagtatcacgaccggtgctcgatttagtacagatcgttagggaaagggggagtcagtctcagtcaggacacagcatggacatgagggtccccgctcagctccgtggggctcctgctactctggcctcggaggtggcagtatgtagactagtccaggactcgacccgagtcctccactccctcccgtgtctgcctagtcgtggtgggacacgaccagtccaccgtatctacgttcggccggtacaagtcacgataattacgactaaacttaacgtttaaagtcggtactccggaccgaacggtaacggaacccgggtaaccnccccgtacctaccgtcccganacgtctactcgtcgtacgtacctacccgttaacgttaacgtaaacggtccggtaacccgtactaccggtaccggttacgacgggtcgggtcggtacggtaccgttcggaacggggactaacggtacttcccgttaaccgccgttacccgattaacgccgtacgacgtcgtaacgtcgacgaccgtaccgtagttaccggtttattaccgtactaattacgtaacgtacgtaaccaacgttacgtacccttaacccgttacccgtaaggtacccgtacgggtacggaaccggtaacggttacgacgtaaccgacgtaaccaacggtcgtacggtntaacgccgaactaccgtctaccttcgtaactcgtacctcccg

SEQ ID NO: 243287 - DNA, 932 bp, Homo sapiens
  misc_feature: GYAE6OF02IDLJ5.23.24.C02.1.454.CMB.1.raw
  modified_base (173)..(173): a, c, t, g, unknown or other
  misc_feature (173)..(173): n is a, c, g, or t
  modified_base (211)..(211): a, c, t, g, unknown or other
  misc_feature (211)..(211): n is a, c, g, or t
tcagacgcgagtatcacgaccggtgctcgatttagtacagatcgttagggaaagggggagtcagtctcagtcaggacacagcatggacatgagggtccccgctcagctccgtgggctcctgctactctggctccggaggtggcagatgtgacatccagatcgacccagttccnccacttccctccctgtctcgcctattcgtggtgggaanaccactagtccaacctatacctaacgttcgggcccgggtataaaggtccaagacctaaagttcgaactaaactttaaattttaaagttggtaacttccgaccgtaaggaaccggaaccccgggtaaaaccgtccccctacctacccgttccgtataccttctaacgttcgaccgttgtacccgttaccgttaacgttttaaccggaaacgggttccgggttaacccctagttaccggttaacggtttacggaacgggtttcgggccgggttaggtaacgtttcgggacggaaaccgtagggtttaacgttacccgtaccttaccctaaccgtacccaacgtttcgaacggttaactccggttcctaggaccgtacgtacgttaacggttaaacgttttcgttttaccggaaccttttaaaccgtttaacgttaccgttaacggtaacctaaaccggttaaaccggtttaaccccgttttaacccccgtttaaacccccgggttaaccggttccccgggggtttttaaacccgggaaccccggggtaaaccggggggtaaaacccgtttaacggggtaacccggttaaaccgtaacccggttaaaacccgggaaacccgtaaacggtttcccgggggttacaaccgtttaaacccgcccggttaaacgttaccggtttacccgtttaaccggtttcctttacccgtaccgtttaccccccgg

SEQ ID NO: 243288 - DNA, 704 bp, Homo sapiens
  misc_feature: GYAE6OF02JSK5L.23.24.C02.1.454.CMB.1.raw
tcagacgcgagtatcacgaccggtgctcgatttagtacagatcgttagggaaagggggagtcagtctcagtcaggacacagcatggacatgagggtccccgctcagctcctgggctcctgctactctggctccgaggtggcagatgtgacatccagatcgacccagtcctccatccctcctgtctgctatctggtgggacacactacgtcaaccatccacgttcgccgggacaagtacaagaactaagttacgaactaacttaatttaaagttggtaactcgaccgtaagacggaacccggaaaccgtcccctacgaccctcgtagactctacgtgtacgtcgaccgttacctaacgtttaaccgaaagggttccgggtaccctacgtaccgtacggttacgtaggttcgggtacggttcgtacgtcggtaggacgtagtacgttctacctcgacctacatacacgtactacgtctacgtagaccgtagtaacgtaactttcgttacgtaaccttaacctttacgtacgttactactaaccgtaacgttaccgtttacccctaaaccgtacgggtacctacccgggtaacgtaccggggaacctaagggtacccgaactacgtaacgtaaacggtacgtacggtacctacggaccgttaccgtacgttaccgttgtaccgttacctacgttaccgttacccccg

SEQ ID NO: 243289 - DNA, 835 bp, Homo sapiens
  misc_feature: GYAE6OF02HC1B2.23.24.C02.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatcgacccagtcctccatccctccctgtctgcatcgtggtggganacacagtcaccatcacttggccgggcaagtcagactaagttcgaactaacttaatttaaacgttggtactcgaccaggaacggtaacccgggaaacnccccctacaccctccgtagacttctatcgcgtcgtccgtaccctaacttttaaccgaaacgggttccggggtacccctaagttacccgtaacgggtttaccgaagggttcgggacgggttcggtaacgttacggtacggggaacgtaagggttacgtttccgtaaccttccgtaccaaccctaagtaccgaacgtccgtaacggttccgtacgtaccgtacggtacccgttaagggaaacgttttagttttaccggaaacctttaaacccgttttacgtaaccgtttaccgtacctaaaaccggttacgtttaaaccccggtttttaacccccctttaccccggtaaacgggttacccgggtttacccgggaacccgggtaaccgggggttaaacccggaaacggggttaccggaaccgttacgttaaaccggaaaaccggttaacgttcggggtaaccgttaaccgtacccggtacccgtaacccgttacttacccggttacgttttacccgtttaccctaccgtttacccccgg

SEQ ID NO: 243290 - DNA, 849 bp, Homo sapiens
  misc_feature: GYAE6OF02F77Z5.23.24.C02.1.454.CMB.1.raw
  modified_base (102)..(102): a, c, t, g, unknown or other
  misc_feature (102)..(102): n is a, c, g, or t
  modified_base (202)..(202): a, c, t, g, unknown or other
  misc_feature (202)..(202): n is a, c, g, or t
  modified_base (814)..(814): a, c, t, g, unknown or other
  misc_feature (814)..(814): n is a, c, g, or t
tcagacgcgagtatcacgaccggtgctcgatttagtacagatcgttagggaaagggggagtcagtctcagtcaggacacagcgatggacatgagggtcccgntcagctcctggggctcctgctactctggctccgaggtggacagactgtgacactccagtaatcgaaccccagttcctaccattcccttccctggttcgtnacctatcgttggtagggtacgaacctaacgacgttccaaacccttacgtaccgtacggttttccggcccggggtaactaaacggttcaacgtaacctaaagtttcggaaaccttaaattttaaacgttttaaaagttggttacttaccggaccaagggaccggtaacccccggggtaaactcccccgtactaacccgttctaacggactttcgtaacgtcgtctaccggtttaccgtacctttaaacgtttaaacggtaacgggttccgggtaacccctaggttaccgttaacgggttcgtaacgggttcgggggtacggtcggttaaacgtttcccggtaaagggaaccgttaacggttacgttccgtaaacccgttccgtaacccgtaactaccggtacgtaacggtaacgtcgttcgtaacggaccgtaaccgggttcttaacggtattttaccgtttacggaaaccttaacgtttacgtctaacgtacccgtaatacgtttcccgttaaaccctccggtaaacgtaccggttcgaaccggaacggttaacgcggtagacccgtataaaccggaaccgttcggttaggacctacgtaaccgacgtaacnccgtttacttacggtacctttacaaccgtttcccg

SEQ ID NO: 243291 - DNA, 825 bp, Homo sapiens
  misc_feature: GYAE6OF02HQ8N6.23.24.C02.1.454.CMB.1.raw
  modified_base (207)..(207): a, c, t, g, unknown or other
  misc_feature (207)..(207): n is a, c, g, or t
tcagacgcgagtatcacgaccggtgctcgatttagtacagatcgttagggaaagggggagtcagtctcagtcaggacacagcatggacatgacgggtccccgctcagctccgtggggctcctgctactctggctcggaggtgcagatgtagacatccagatcgacccagtcctccaacttccctcccgtgtctgctatcgttagggngggacgacacgtagtaccaacctataccgtacgttcgggacccgggtacaacgtcgaagaactaagttcgaacttaaacttaagttttaaagttaggtactaccggaccgtaacggaaccgggtaaacccccgggggaaacctccccctaaccgtacccgttaccgtacggtacttacctaagtcggtacctccgtacccgttacttaactttaacggaaacgggtccggtacctacgtcgtaaccgggttcgaggtcgggtacggtaggtacgtacggtacgggacgtaaggtacgttacctacgtccgtacccaacgtacgcgtaacgtaccgtagttcacggtaaccgtcgtacggttaacggttaaacgttaccgttaacggtaaaccctttaaccgttaacttaccgttaacgtaaccgttaaccgtaccgtttaaacccgttttaacccccgttaacccggtacggttacccggtaccgggtaacccgggaaacgggtacggtaaacgggtccgtaaaccgtaacggtaaaccgtaaaccggtcggttaaccgggcgtaacgttaccgaccttacgtacgttccctagtttacccgttactacccgttcccg

SEQ ID NO: 243292 - DNA, 626 bp, Homo sapiens
  misc_feature: GYAE6OF02FWXN9.23.24.C02.1.454.CMB.1.raw
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
  modified_base (422)..(422): a, c, t, g, unknown or other
  misc_feature (422)..(422): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctccgaggtggcagatgtgacatccagatgacccagtctccatccctccctgtctgcatctgtgggagacacagtcaccatcacttcgccgggcaagtcagacaattgaacaactatttaaattggtatacgccagagaacccgggaagcccctacacctcctagactctatgctgccgtaccactttaacaaacggtcggggtacccatacgtacggttcgaggtcggnggtggactcgtaggacagagttcactntccacatcagtcagtctgacacgtcctagaagttntttgactaactttactacgtagtacaactaggttaaccgtttaacccttaccccgtaaaggttaccggttaccggacccggtaaacggggtaacccgtaaagggttacgaacctacgtaaccgtaaacggtaacgttacggtacgggtacctacggtacccaccgtacttccgtacgtttacccttaccgtactttacccccgg

SEQ ID NO: 243293 - DNA, 740 bp, Homo sapiens
  misc_feature: GYAE6OF02JPM1I.23.24.C02.1.454.CMB.1.raw
  modified_base (526)..(526): a, c, t, g, unknown or other
  misc_feature (526)..(526): n is a, c, g, or t
  modified_base (605)..(605): a, c, t, g, unknown or other
  misc_feature (605)..(605): n is a, c, g, or t
tcagacgcgagtatcacgaccggtgctcgatttagtacagatcgttagggaaagggggagtcagtctcagtcaggacacagcatggacatgagggtccccgctcagcctccgtggggctcctgcctactctggctccggaggtcggcagtatgtcgactactccaggatcgacccagtcctccactcccgtcctgtctgcacttcgtcggtgggaacaccactacgtacctacctatacctacggttacgggcccgggtactaacgtcaacggtaactaacgttacgaactaacgtttaatttaacggtaggtactacgaccgtaaggaccggaaaccccggtaaccgtcccttaccgtaacccttaccgtcggtaacttaccgtacgacggtcctcggtaccgtacccttaacgttaacgaacgggttccgggaccttacgtccggtaccggttacgagggttcgggtacggtggaacttcggtacggaactaggtaccttcctaccgttcctagtaacccgtanaccgtacggtacgtaccggttgtccgacgtagccggttaagtaacggttactttacggacccttaaacgttcgttaccncggtaactacggtaccgttacgttacccctaccgtgggtaaccgtcggacccggtgaacgtagcgaacctacgtacaaccgtgcggtagtccgtacgtacctaacgtctccgttacacgtttaccgtcctaaccg

SEQ ID NO: 243294 - DNA, 665 bp, Homo sapiens
  misc_feature: GYAE6OF02FS2C7.23.24.C02.1.454.CMB.1.raw
  modified_base (198)..(198): a, c, t, g, unknown or other
  misc_feature (198)..(198): n is a, c, g, or t
  modified_base (444)..(444): a, c, t, g, unknown or other
  misc_feature (444)..(444): n is a, c, g, or t
tcagacgcgagtatcacgaccggtgctcgatttagtacagatcgttagggaaagggggagtcagtctcagtcaggacacagcatggacatgagggtccccgctcagctcctggggctcctgctactctggctcgaggtggcagatgtgacatccagatgacccagtctccactccctccctgtctgcatctgtggganacacacgtcaccatcacgttcgccgggacacgtcagactaattacgactaaattaatttaaattaggtactcggaccacggaacggaacccgggaaaccgtccccctaccgacccttccgtagtacctcgtaactcgctcggtacctcctaacgtttaacgtaagggttccgggtaccctagtccgtacggttctaacgggtcggtcgggtgtacgtggtagggtacagtacgttactaccttacnccgtaaccataccgtacgccgtaacgtcgtagacgtcgacgtcgtaaagttcgtttacgacttacttacttacgtactactaacgtacgttaaccgtttacccgttacccgacgttacggtccggacgtacgggtaacgacggtacacgtacgtaacgaacgtacgtacggtacgtacttaccgacgtactcgttaccttcggtaccttactccgttaccg

SEQ ID NO: 243295 - DNA, 845 bp, Homo sapiens
  misc_feature: GYAE6OF02JJ7TP.23.24.C02.1.454.CMB.1.raw
tcagacgcgagtatcacgaccggtgctcgatttagtacagatcgttagggaaaggggagtcagtctcagtcaggacacagcatggacatcgagggtccccgctcagctcctgggctcctgctactctggcctccggaggtcggacagatgtgacatccagactgacccagttcctccatcctcctgtctgcatctgtggacacacagtcacctagtccacgttcggccggacaagtcaacgactacgttcgactaacttaactttaaagttggtactaccgaccgaggaaccggaacccggtaaacgccccctacgtacccttccgtagacttactaacgtcggtctacggaccgttaccgtaaccgttttaaccgaaagggttccgggttaccccgtaagttaccgtaccgggtttaccgacgggttacggggtacgggttacggtacgttaccggtacgggtaacgtacggttaccgttaccgaaccttccgtacccgaaccgtacgtaccgtaacggtacgtaacgttccgtacgtaccgtacgtacgttacggtaaacgttacgttttacgaccttaaacgtttactacgttacgtacctaacgtacggtttaccgtttacccgttaaccccgtaaacggttacccgggtttaccgggaacccggtaacgggggtaaacccgtaacgggttacgggtaaacccttaacggttaaccgaaacccggttaaaccggtttacgggtaacccgggttaccgttaccgggaacccttacccggttaaaccgtttcccggtttaaccggttttacccgtttacccgtacccggttttaaccccccgg

SEQ ID NO: 243296 - DNA, 522 bp, Homo sapiens
  misc_feature: GYAE6OF01AQUF5.10.25.C03.1.454.CMB.1.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaacctggccagcctcccaggctcctcgtctatggtgcatccacaagggccactggtatcccagccaggttcagtggcagtgggtctgggacagagttcgctctcaccatcagcagtctgcagtctgaagtatttgctagtttattactgtcaggaatatgatggctggcctcgtactacttttggacctaagggacctaaggttcggacagtacgaaaacgtaacttaggtaggcttgcctaacccg

SEQ ID NO: 243297 - DNA, 509 bp, Homo sapiens
  misc_feature: GYAE6OF01C211C.10.25.C03.1.454.CMB.1.raw
  modified_base (407)..(407): a, c, t, g, unknown or other
  misc_feature (407)..(407): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtactccagccaggttcagtggcagtgggtctgggacagagttcgctctcaccatcagcagtctgcagtctgaagtntttgctagtttatactgtcagaattagtgagtgctggcctcgtactcgtttggcaacgggtacaggttcggacagtacgaaacgtactagtggctgctaccg

SEQ ID NO: 243298 - DNA, 536 bp, Homo sapiens
  misc_feature: GYAE6OF01DAEE5.10.25.C03.1.454.CMB.1.raw
  modified_base (215)..(215): a, c, t, g, unknown or other
  misc_feature (215)..(215): n is a, c, g, or t
  modified_base (417)..(417): a, c, t, g, unknown or other
  misc_feature (417)..(417): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngccaccctctcctgctgggccagtccgagtgtggcagccgcttagcctggtaccagacaaaaacctggccacgcctcccaggcctcctcgtctatggtgcatccacaagggccacgtggtactcccagccaggttcagtggcaggtgggtctggggacaggtagttcgctctcaccatcagcagtctgctagtctagaagtntttgcttagttttatactgtcaggtaatagtgtatggctcggtcctccgtacttcgtttcggaccgtaagggacctaagggttcggactacgtacgaaacgtactagtggctgctaccg

SEQ ID NO: 243299 - DNA, 523 bp, Homo sapiens
  misc_feature: GYAE6OF01CJTLL.10.25.C03.1.454.CMB.1.raw
  modified_base (215)..(215): a, c, t, g, unknown or other
  misc_feature (215)..(215): n is a, c, g, or t
  modified_base (437)..(437): a, c, t, g, unknown or other
  misc_feature (437)..(437): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngccaccctctcctgctgggccagtccgagtgttggcagccgcttagcccggtaccagcaaaacctggccagcctcccaggctcctcgtctatggtgcatccacaagggccactggtactcccagccaggttcagtggcagtgggtctgggacagagttcgctctcaccatcagcagtctgcagtctgaagtattttgctagttttattactgtacaggaatntagatggctggccttccgtactacgttttggccgaagggtacctaggttggacatacgaaaacgtactggtaggctcgctcgtacg

SEQ ID NO: 243300 - DNA, 586 bp, Homo sapiens
  misc_feature: GYAE6OF01C022R.10.25.C03.1.454.CMB.1.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgtggcagccgcttagcctggtaccagacaaaaacctggccagcctccaggctcctcgtctatggtgcatccacaagggccactggtactccagccaggttcagtggcagtggtcgtgggacagtacgttcgctctcactatcagcagtctgctagtctagtaagttagtttgacttaagttttattacgttgtacgtaaggtaattagtgtagttggtcgttacggtccttacccgttacttacgttttacgggaaccgtaacggggtaacctaagggttacggaactaacgtaaaccgtaaacggtaacgttacgggtacggtcgtacgtccgtaaaccg

SEQ ID NO: 243301 - DNA, 638 bp, Homo sapiens
  misc_feature: GYAE6OF01CSZ0B.10.25.C03.1.454.CMB.1.raw
  modified_base (176)..(176): a, c, t, g, unknown or other
  misc_feature (176)..(176): n is a, c, g, or t
  modified_base (453)..(453): a, c, t, g, unknown or other
  misc_feature (453)..(453): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacncagtctccacgccaccctgtctgccgtctccagggcaaactgccacctctacctgctggccagtccgagtgtggcagccgcttagctggtaccagtacaaaacctcggaccacgacctccacggcctccgtcgtccgtagtcggtcgacactccgaacgacgggccacgtcggtacctccgacgcccgtaggttcgagtcggcgtacggtcgggtcgtggggacaggtacgttcgctactcaacctatcagtcacgtctagcacgtcgtagtacgtntttcgattacgtttattacgttagtacgtaagtaacttagttagtagttcggtcgttaccgtaccgtaccggttacttaccggttttacgggaccgtaaacggggttaaccgttaaaggttaccggtaacgtaacgttaacggtaaaccgtaacgtttacggaggttacctcggtacttaacccg

SEQ ID NO: 243302 - DNA, 534 bp, Homo sapiens
  misc_feature: GYAE6OF01CPMM8.10.25.C03.1.454.CMB.1.raw
  modified_base (526)..(526): a, c, t, g, unknown or other
  misc_feature (526)..(526): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaacctgccagcctcccaggctcctcgtctatggtgcatccacaacgggccactggtatcccagccaggttcagtggcagtgggtctgggcagacgttcgctctcaccatcagcagccctggagcctgagatattgctagtttattattgtctagcagtcgtagcgaggtcggtcctttcgacgtttccgggaccccggggtaacaaacggtcggaaataccgaaaacggactggtcggacctaggccaccngtccttcg

SEQ ID NO: 243303 - DNA, 577 bp, Homo sapiens
  misc_feature: GYAE6OF01BDQ0Z.10.25.C03.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
  modified_base (427)..(427): a, c, t, g, unknown or other
  misc_feature (427)..(427): n is a, c, g, or t
tcagcatagtagtgcacgaccggtgctcgatttagtagtgtagatttgggtttggggagagctctggggaggaactgctcagttaggacccagagggaaccatggaagccccagctcagcttctcttcctcctgctactctggctcccagattccaccggagaagttgtgttgacacagtctccagccacctgtcttgtctccgaggggaaancgccaccctctcctgcagggccagtcagagtcttagganctccttagcctggtatcaacagaaacctggccaggctcccaggctcctcatctatgatgcatccaacgacgggccacgtggcactcccgagccgtaggttcaggtggcaggtggtctagggacaggtacttcgactctacaccatcgagcagtactagacgtcctagtaacgttnttttagacttaaggttttaacttactgtacagtctaggtacgtagacctaacgtcggtacccgtcgggtacgtccggaccggtaaacgggaaccgtaaaggtcggaacacgtacgaaaggaccgtaacgtggtaggcttcgccgtaaccg

SEQ ID NO: 243304 - DNA, 565 bp, Homo sapiens
  misc_feature: GYAE6OF01DT8VH.10.25.C03.1.454.CMB.1.raw
  modified_base (216)..(216): a, c, t, g, unknown or other
  misc_feature (216)..(216): n is a, c, g, or t
  modified_base (432)..(432): a, c, t, g, unknown or other
  misc_feature (432)..(432): n is a, c, g, or t
tcagcatagtagtgcacgaccggtgctcgatttagtagtgtagatttgggtttgggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngccaccctctcctgctgggccagtccgagtgttggcagccgcttagcctggtaccagacaaaaacctggccagcctccaggcctcctcgtctagtggtcgcactcccacgaacgggcccacgtggtactcccgacgccgtaggttcgaggtcggctaggtgggtcgtgggacaggtagttcgctctcaccatcagcagtctgcagtctagtaagtntttgcttagtttattactgtacaaggtaatagtgtatggtctcggtccttcgtacttacgtttacggaccgtaaggggtacctaaggttcggactaacgtaacgaaaccgtacgtggtaggctcgcctaaccg

SEQ ID NO: 243305 - DNA, 579 bp, Homo sapiens
  misc_feature: GYAE6OF01CD2D0.10.25.C03.1.454.CMB.1.raw
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngccaccctntcctgctgggccagtccgagtgttggcagccgcttagcctggtaccagcaaaaacctggaccagcctccacggcctcctcgtctactggtgcatccacaacgggccactcggtactcccagccaggttcagtggcgagtggtcgtgggacagagttcgctctcaccacgtcagcagtctgcagtcgtgaagttatttgacttagtttacttacgtgtcgaaggtaatagtgtaagttcgggtcttcgggtcccttaccggtaacttaccgttttacggaccgtaacggggtaacctaaggttacggtaccaagttacaaaacggttaactacggttagacctggtacgtaaaccg

SEQ ID NO: 243306 - DNA, 714 bp, Homo sapiens
  misc_feature: GYAE6OF01D4X6L.10.25.C03.1.454.CMB.1.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctcgggccagtccgagtgttggcagccgcttagcctggtaccagaccaaaaaccgtcgaccaccgtcccctaccggacgtcctccgtccgttacgtacggttcggtcgactcctaaccgaaacggaccggacctacggttacggtacctacccgacgaccggttacggtacgtacgggtcggacgtagggttcggtcgggtacggacgtaggtacggttccgtcttccgtacccaacctactacgacgtacgtacgtcgtcgacgttacgtacgtaaggtaacgttttagttcgttaacgttttattttaacgtttacggttacgtaacggtaagttaagttagtagttacggtcgggtcgtccggttacccgttaccgttaccgtttacggttaccggaaacggtaaccgggtaacgttagggtacggtaactaaccgtaaacgtaaaccgtagttacgggtactcggtaccgtcccgtaaccg

SEQ ID NO: 243307 - DNA, 520 bp, Homo sapiens
  misc_feature: GYAE6OF01BBBWL.10.25.C03.1.454.CMB.1.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtatcccagccaggttcagtggcagtgggtctggggacaggagttcgctctccaccatcagcagtctgcagtctgaagtattttgctagttttattactgtcaggtaatatgattggctggcctccgtactcgttttggcctaagggccaaggttcggacatacgaaacgtaactgtaggctgctacccg

SEQ ID NO: 243308 - DNA, 817 bp, Homo sapiens
  misc_feature: GYAE6OF01B82SX.10.25.C03.1.454.CMB.1.raw
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
tcagcatagtagtgcacgaccggtgctcgatttagtagtgtagattttggggtttggggagagctctgggggaggaactgctcagttaggacccagacggaaccatggaagccccagcgcagcttctcttcctcctgctactcaggctcccagaaaccactggagaaatcgtgatgacgcagtctccagcccaccctgtctgcgtctccagggcaaacngccaccctctccngctcgggccagtccgagtgtggcagccgcttagccgtggtaccagacaaaaccgtgaccacgcctccgaggctcctcgtctagtggtcgcacgtccaacgaacggggccctacgtacgggtaccttacccgacggtaccgtaacggtttcgaagggtcggaccgtaaggggttcggggtccgtacggggggaactagggtacggtttaccggtccctttaccgtaccgaaccgtacgttccgaacgtacccgtaacgttcccgttacgggcgttaacggtacctttagggtaaacgttttcgtttttaacgggtaccgttttaacggttttttaacgttttaaccgttagggtttaaccggtaaaggttaaactttagggttaacgggttacggttccggggttccgtttaccgggttcccctttaaccgggtttaacctttaccgggttttacgggtaaaccccgggtaaaaccgggggttaaccgttaacggggtttaacgggaaaccgttaaaccgtttaaacggaaaacccggtttacgggttaccgggttaggttcccggtacggtaacccgttaaccgg

SEQ ID NO: 243309 - DNA, 541 bp, Homo sapiens
  misc_feature: GYAE6OF01ATXRM.10.25.C03.1.454.CMB.1.raw
  modified_base (215)..(215): a, c, t, g, unknown or other
  misc_feature (215)..(215): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngccaccctctcctgctgggccagtccgagtgttggcagccgctagcctggtaccagcaaaaacctggccagcctcccaggctcctcgtctatggtgcatccacaagggccactggtatcccagccaggttcagtggcagtgggtcgtgggacagagttcgctctcaccatcagcagtctgctagtctagaagtatttgacttagtttattactgtacgaaggtaatatgtagtggctcggcctccgtactcttttcggaccgtaacgggtaccgtaaggttaggactaacgtacgaaaccgtaacgttacgtggctggcctaaccg

SEQ ID NO: 243310 - DNA, 533 bp, Homo sapiens
  misc_feature: GYAE6OF01AY6SP.10.25.C03.1.454.CMB.1.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtactcccagccaggttcagtggcagtgggtctggggcagagttcgctctcaccatcagcagtctgcagtctgaagtatttgctagtttattactgtcagcagcgtgcctacgtttcgggcggtaggtcgtcctcgtttcgggacgggtacgggaacccaaaagtcggaaggtacaaacggtactaggtaggctggctaaccg

SEQ ID NO: 243311 - DNA, 670 bp, Homo sapiens
  misc_feature: GYAE6OF01EKN6V.10.25.C03.1.454.CMB.1.raw
  modified_base (215)..(215): a, c, t, g, unknown or other
  misc_feature (215)..(215): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacncgccaccctctcctgcgtcggccagtccgagttggttcggcacgccgtcttacgccgtacggtaccacgaacctaaaaaccgtcggaccacgcccctcccgacggtccttccgtccgtctagtcggtcgactactccgaacgaacgggcctacgtacggtacctacccgacgccgtacggttacacggttcggacgtagggttcgggtcggtcgggaacgtaggtacggttccgtcttaccgtaccaacgtactaccgagtcgacgttcgtcgacgtacgtctaggtaagttattttcgactttagtttacttacgttgtacgaaggtaacttagtagtacgtggtcgtcggtcccttacgtacttacggtttcggaaccgtaacggggtaccttaaggtacggaactaacgtaaccgaaacggttacgttacggtacgtcgtcgaccttaaccg

SEQ ID NO: 243312 - DNA, 667 bp, Homo sapiens
  misc_feature: GYAE6OF01DHVYU.10.25.C03.1.454.CMB.1.raw
  modified_base (230)..(230): a, c, t, g, unknown or other
  misc_feature (230)..(230): n is a, c, g, or t
tcagcatagtagtgcacgaccggtgctcgatttagtagtgtagatttgggtttggggaggagctctggggaggaactgctcagttaggacccagacggaaccatggaagccccagcgcagcttctcttcctcctgctactcaggctcccagaaaccacgttggagaaatcgtgatgacgcagtctcagccacctgtctgcgtctccgaggcaaacgcgccaccctctccngcgtgggccagtccgagtgtggcagccgcttacgcctggtaccagacaaaaaccgtcgccacgcctcccgaggcctcctcgtctagtcggtgcatccacgaacgggccactgtactccagcgtgtcagtggactaggtggtcgtagggaagtacgttcgctcgctacctactacacgtctacgtctacgtcaagttctagtaatagtttttcggacttagttttattaacgtcgttacgtaaggtaaacgttagtacggttacgtcgggtacgttcggtacccttaccgggttaacgttaccggtttttacgggaaccccgttaaggggtaacccgttaaagggtttaccgggtaaacgttaaacgttaaacccgtaaaaaccgggtaaccgtttagggtacggtacccgttacgggtacccgtaacccgtttaacg

SEQ ID NO: 243313 - DNA, 617 bp, Homo sapiens
  misc_feature: GYAE6OF01BAGP6.10.25.C03.1.454.CMB.1.raw
  modified_base (214)..(214): a, c, t, g, unknown or other
  misc_feature (214)..(214): n is a, c, g, or t
  modified_base (426)..(426): a, c, t, g, unknown or other
  misc_feature (426)..(426): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctcagccaccctgtctgcgtctccagggcaaacngccaccctctcctgctcgggccagtccgagtgttggcagccgtcttagcctggtaccagaccaaaacctggccacgcctacccgaggcctcctcgtctacgtggtcgcactccacgaacgggcctacgtcggtactcccgagccgtaggttcaggtgcgtaggtcgggtcgtggggactaggtacgttccgcttccgtacaccgactacganccgtacgtctgtcgtagtctagtaagttacgtttcgtactttacgttttaactacgttcgttacgtaagttaacgtgtacggttagtcggtcgtccggtaccgttccgtaacgttccgttttaggaacccggtaagggtacctaaggttcggaactacgtagaaaccgtagtcggacgtcgtcgctaaccg

SEQ ID NO: 243314 - DNA, 742 bp, Homo sapiens
  misc_feature: GYAE6OF01BT9YZ.10.25.C03.1.454.CMB.1.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaatcgtgatgacgcagtctccagccacctgtctgccgtctccagggacaaacacgccaccctctcctgctcggccagtccgagtgtcgcagccgtctacgcctggtaccacgaccaaaaccgtcggaccacgccctacccgacggccttaccgtcgttctaacgttcgggtcgactactaccgaacgaacgggtaccctacgttacgggttaactcccgacggtaccgtacgggttcaagggtcggacgtagggtcggggttacgtagggggactagggtacggtttccgccttacgtacctaacccacttaccgaacgtcgtaacgttcgtacggacgtaacggttctagggtaaacgtttagtttttcggtactttaagtttttactttaaccgtgttactacggtacgttaagttaagttaacgtacgttaccgtccgggtaccccgggtacggttaccgggttccgggaaccggtaaaccggggggtaccggtaacggggtacggttaaacgttaccggaaaaccggttacgtttacggggtacggtccgtacggaccctaccgttacgttaccgg

SEQ ID NO: 243315 - DNA, 619 bp, Homo sapiens
  misc_feature: GYAE6OF01CGKOP.10.25.C03.1.454.CMB.1.raw
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (323)..(323): a, c, t, g, unknown or other
  misc_feature (323)..(323): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactctggctcccagacaacactgcagaaatagttatgacgcagtctccagcccaccctgtctgtgtctccgaggggganagacgcccaccctctcctgccgaggggccgtnagaatnttgactaccaacttagcctggtatacaaacaaagcctggccaggcctcccagacctcctcatctctggtnctatctcggacggcctacgtggtcgtcccagccgtaggttcaggtggcgaggttcgggtactagggaacaggtacgttcaacttctacaccatccacggccggcctgacctaggtcctaggtaaagttcgttttgactttaagttttacttacgtgtcaagtctaagttattaagttgtaacgtttgggttttacttacgttaccgtttccgggacccgttagggtaaacccgtaaaggttcggttaactttacgaacggtaaccgtaacgttcgggtacgtcgttgccgtaaccg

SEQ ID NO: 243316 - DNA, 637 bp, Homo sapiens
  misc_feature: GYAE6OF01A9PKC.10.25.C03.1.454.CMB.1.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccgagggcaaacagcccaccctctcctgctgggccagtccgagttgttgcagccgctagcctgaccagacaaaacctgccacgcctccgacggcctccgtcgtctagtcggtcgctacgtccaacgaacgggccacgttacgggtacctacccgacgaccgtaggttcgacggtcggacgtaggttcgggtcgtaggggtacgaggtacggttccggaccttccgtacctaccgtacgtccgacgcgtacgttacgtcgtacgtaggttacgtaggtaacgtttagtttgtacgttagttttactacgttgtacgtagtaatagtgtagtcggtacgtcgtcccgttacggtacttacgtttacggacgtaacgggtacctagggttacgactacgtaaccgaaacgtacgttaggtacgtctcgtacctaccg

SEQ ID NO: 243317 - DNA, 713 bp, Homo sapiens
  misc_feature: GYAE6OF01A4L0K.10.25.C03.1.454.CMB.1.raw
  modified_base (163)..(163): a, c, t, g, unknown or other
  misc_feature (163)..(163): n is a, c, g, or t
  modified_base (219)..(219): a, c, t, g, unknown or other
  misc_feature (219)..(219): n is a, c, g, or t
  modified_base (338)..(338): a, c, t, g, unknown or other
  misc_feature (338)..(338): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggaanaaatcgtgatgacgcagtctccagcccacctgtctgccgtctccgagggacaaacncgcccaccctctctgcgcggccacgtccgagttgtcgcacgccgtctacgccgtacggtaccacgaaccaaaaccgtggaccacgccctaccgacggtcctccgtcgtactagtggtcncacgtccaacgacggcctacgtgtactacccgacgaccgtacggttcgaggtcggtcgtacgggtcggtacgtagggacgtaggtaccggttcgccgttacctccgaaccgtacgtaccgagtccgtagttaccgtcgtacgtaggttacctagggttaaacgtttacgtttcgtaacttttaacggttttactttacgtacggtacgtaacggtaacttaacggttaaattaagttacggttttacggttttacggttttacttaccgttaccggtttcccgggtaaccgttaaccgggtaaacgttaacggttacgttacgttacggaacggtaacgttacgttcggtacggtacctcgtaccgtcgtttacg

SEQ ID NO: 243318 - DNA, 868 bp, Homo sapiens
  misc_feature: GYAE6OF01CRB36.10.25.C03.1.454.CMB.1.raw
  modified_base (167)..(167): a, c, t, g, unknown or other
  misc_feature (167)..(167): n is a, c, g, or t
tcagcatagtagtgcacgaccggtgctcgatttagtagtgtagatttgggtttggggagagctctgggggaggaactgctcagttaggacccagacggaaccagtggaagccccagcgcagcttctcttcctcctgctactcaggcctcccaagaaaccactggaanaatcgtgatgacgcagtcctccgagcccaccttgtcctgtccgtccgtccgaagggaccaaaccgacaccctacccttctcctcggccgtcggggacctacggtcccggtagtcgggttcggaccgtacggtcccggtccgtttaacggtcccgttaacgggtaacccgtaaacgaaacccgtaaaaaaaccgttcccggggaaccctaaccggtccccgttaccccgaccgggtcccttaccccgttcggttacctacggttcggtacgtccgtaaaccgtacccgaaaggaacccgggtaccctaccggttacggttaaccctacccggtaccggtacccggtacggttccgtaaggggttcggacgtaaggggttcgggtacggtacggggacgtaagggttcggttcgaccgtacttccgaacctacgtcgacgtacgtacgttactcgggtacttaggtacgtacggttaaagtttgtttacgtacgtttagttttaacgttacgttgtaacggtaagtaacggttaatcgggtaagttccgggtcgttaccggttacccgttaaccgttaaccgtttaccggttacgggttaaaaccgtaacggggttaaacgggttaaccggttacggaaaccgttaacgttaacggtaaaaccggtacggttggttaaccggtctacggttaaccctaaccgg

SEQ ID NO: 243319 - DNA, 537 bp, Homo sapiens
  misc_feature: GYAE6OF01BBKQ7.10.25.C03.1.454.CMB.1.raw
  modified_base (215)..(215): a, c, t, g, unknown or other
  misc_feature (215)..(215): n is a, c, g, or t
  modified_base (395)..(395): a, c, t, g, unknown or other
  misc_feature (395)..(395): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngcccaccctctcctgctgggccagtccgagtgttggcagccgcttagcctggtaccagacaaaaacctggccagcctcccaggctcctcgtctatggtgcatccacaagggccactggtactcccgagccaggttcaggtggcaggtgggtcgtgggacaggagttcgctctacacatcngcagtctgctagtctgaagtntttgntagtttattactgtcaaggtatagtgtagtggctggtcctacgtacttacgtttggaccgaagggtacctaaggttcggactacgtacgaaacgtacgtggtaggctcgctaaccg

SEQ ID NO: 243320 - DNA, 724 bp, Homo sapiens
  misc_feature: GYAE6OF01EMIFV.10.25.C03.1.454.CMB.1.raw
  modified_base (344)..(344): a, c, t, g, unknown or other
  misc_feature (344)..(344): n is a, c, g, or t
tcagcatagtagtgcacgaccggtgctcgatttagtagtgtagatttgggtttgggggagagctctggggaggaactgctcagttaggacccagacggaaccatggaagccccagcgcagcttctcttcctcctgctactcaggctcccagaaaccactggagaaatcgtgatgacgcagtctccagccacctgtctgcgtctccgaggacaatacgccacctctcctgcgtcgggccagtccgtagttgttggacacgccgtcttagccgttacggaaccaacgaaccaaaaccgtcggaccaacgcccctcccgacggtccttccgttcgtcgtagtggtcnctactccgaacgaacgggtcctacgtacggtacctcccgacgtaccgtaggttcacggtcggacggtaggtcggggttaccgaggggaccgtaggtaccggttccgacttacccgtcctaaccgtagtccgacggtacgtagttcgtacggcgttaacggttacgttaagtaaaggtttacttttcgggtaacttttaacggtttttaacttacgtttacggtacgtaaaggttaagttagtaggttaacgttcgggttacttccgggtacccttcgggttaaccgtttacggtttaccgggaaccggttaaacgggtaccgttaaggttacggaacgtaacgtaaccgtaaacgtacgtcggtacgtctcgactaaccg

SEQ ID NO: 243321 - DNA, 666 bp, Homo sapiens
  misc_feature: GYAE6OF01AUVVE.10.25.C03.1.454.CMB.1.raw
  modified_base (222)..(222): a, c, t, g, unknown or other
  misc_feature (222)..(222): n is a, c, g, or t
  modified_base (374)..(374): a, c, t, g, unknown or other
  misc_feature (374)..(374): n is a, c, g, or t
tcagcatagtagtgcacgaccggtgctcgatttagtagtgtagatttgggtttgggggagagctctggggaggaactgctcagttaggacccagacggaaccatggaagccccagcgcagcttctcttcctcctgctactcaggcctcccaagaaaccactggagaaatcgtgatgacgcagtctccacgccacccttgtctgcgtctccgagggacaaacncgcccaccctctcctgcgtggccagtccgagtggttggcagccgcgttacgcctcggtaccagaaccaaaaaccgtcggaccacgccctaccgacggtcctccgtcgtctagtggtcgacgactccgaacgaacgggcctacgtcggttacncccgacggcctaggttcaggttggcgtaggtgggtcgtagggacgtagtacgttcggtactccgtactaccgtatccgagccgacgttcgtcgacgtagttctagtaagtttacgttttgacgtttagtttaacttacgttgtacgtaagtaattagtagtacggttcgttcgtcgtacccgttacgttaccgttaccggtttacggaacccggtaaacgggtacgttaaggttaacggtaacctaacgtaaccgtaaaacgtacggtagtaccggtcgtacgccgttaacc

SEQ ID NO: 243322 - DNA, 743 bp, Homo sapiens
  misc_feature: GYAE6OF01AUSRA.10.25.C03.1.454.CMB.1.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccaagaaaccaccggagaaatcgtgatgacgcagtctccagcccacctgtctgcgtctccgagggacaaacacgcccaccctctcctgcgtgggccagtccgagtgttcggcacgccgcgtagccgtggtaccagaccaaaaaccgtcggaccacgccctcccgacggccttacccgttcgtaccttagtcggtacgcctaactacccgaacgaacgggccctaacgtggtacctacccgacgtccgtacggttcaggtgggacgtagggttacgggttcggtagggaacgtaggtacggtttacgccgttacctacctaaccagttccgacgtacgtacggttctcgaacgtacggtactaggtaagttacgtttttagaccgtttaagttttaactttacgttcggttaacgtaaaggttaagttaagttacggtaaggttaccgggttccgttaccgggttacccgttacccggtttaacgtttaccggttttcgggaaacccggtaaacgggtaacccgtaaggttacggaacctaaacgttaacgaaacgttaacggttacggacggtacgtaccgtacccgtacgttaccg

SEQ ID NO: 243323 - DNA, 583 bp, Homo sapiens
  misc_feature: GYAE6OF01D68MZ.10.25.C03.1.454.CMB.1.raw
  modified_base (218)..(218): a, c, t, g, unknown or other
  misc_feature (218)..(218): n is a, c, g, or t
tcagcatagtagtgcacgaccggtgctcgatttagtagtgtagatttgggtttggggagagctctgggggaggaactgctcagttaggacccagacggaaccatggaagccccagcgcagctttctcttcctcctgctactcaggctcccagaaaccactggagaaatcgtgatgacgcagtctccacgccaccctgtctgcgtctccagggcaaacncgccaccctctcctgctgggccagtccgagtgttggcagccgcttagcctcggtaccagacaaaaacctcggccacgccctcccacggctcctcgtctatggtcgacactccaacgaacgggccacgtcggtactcccgagccgtacggttcaggtcggctaggtcgggtcgtgggacaggagttcgctctcaccatcgagtcacgtctgactagtctagaagttatttgacttagtttattactgtacgagtaatagtagtagtggtctcggtaccttccgtactacgtttacggaccgtaacgggtacctaaggtacggactaacgtactaaaccggtacgttcggtagaccgtcgctaaccg

SEQ ID NO: 243324 - DNA, 934 bp, Homo sapiens
  misc_feature: GYAE6OF01CPQD1.10.25.C03.1.454.CMB.1.raw
  modified_base (785)..(785): a, c, t, g, unknown or other
  misc_feature (785)..(785): n is a, c, g, or t
  modified_base (898)..(898): a, c, t, g, unknown or other
  misc_feature (898)..(898): n is a, c, g, or t
  modified_base (908)..(908): a, c, t, g, unknown or other
  misc_feature (908)..(908): n is a, c, g, or t
  modified_base (919)..(919): a, c, t, g, unknown or other
  misc_feature (919)..(919): n is a, c, g, or t
tcagcatagtagtgcacgaccggtgctcgatttagtagtgtagatttggggtttgggggagagctcgtgggggaggaactgctcagttaggacccagacggaaccagtggaacgccccaggccgcagtcttctccttcctccgtcgctacctcgacgggtccctaccccaagaaaaccctacgtagggaagaaaacgtccggtagacgtacggacgcgtaacgttccaccgaccgtaccctacccgttgtcgtcggtccgtccgaccggaaggggaaccaaaccgccgtaccctacccttcgtccgttcggcgtaccggggacctacggtccggtaggttcggtacggacgtaccggttacccggtacgtttaccgggacccgtttacgggaaacccgtaaacggtaaaacccgtaaaaacccggtccgggaccctaaccccggccccgttacccggtaacccgggttccccttacccggtttcggtttaaccgtaggttaccgggtaccctaaccgttacccggtaacccggtaaaacggaacccgggtacccttacggttaaccggtacccgaccgtaccggggtaaccgtacggggttaccggtacggggtaccggtaaggttaccgggggttccggggttacggttaaccggggggaaacttccggtttaaaccggggtttcccgtaccttaccccggtaaccacccggtacgttaaccgccgaccggttaacggtccgttaacgaccgttacgggtttacgaaggttttaaccgggtttnttttaacaacgtttaaggtttttacgactagggttaactaggaattcggtacggattccggtacgttccgtcgtaacgttccgttacgtacggaaggtaccggattaggtacntaaccggtanacggtgtacgntacccgagtcctacg

SEQ ID NO: 243325 - DNA, 854 bp, Homo sapiens
  misc_feature: GYAE6OF01A0740.10.25.C03.1.454.CMB.1.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgctctccgagggcaaacgcgcccaccctctcctgcgtcgggccagtccgagttgttggcacgccgtcttacgcctacggtaccacgaaccaaaacctcgggaccacgtccctaccgacggccttcccgtcgttccgtaagttcggtcgacctacgtacccgaacggtaacgggccctaacggttcgggtaacctccccgacggtacccgttaggttaccggtagggttccgggacgtacgggttcggggtcgtacggggtaaccgtagggttaccggtttcccgacttcccgttaccgaacccgtaacgttccgaacgtaccgtacggttacccgtcggtaccgttaaacggttcgttaaggttaaacggttacgttttttacggtaaccgttttaacggtttttaacgtttacgttacggttaacggtaaacggttaaacgttagggtacgggtaaggttcggtaacccggttcgggttacccccgttaccggtttaaaccggtaccggtttttaacccgggaacccgggttaaaccggggttaaacccgtttaaaggggttacccggaaaccgttaaaacggttaacccggttaaaacccggtaacggtttaccgggtacgggttaacccgttaccgggtaaccccttaaaccgg

SEQ ID NO: 243326 - DNA, 734 bp, Homo sapiens
  misc_feature: GYAE6OF01AM5Z8.10.25.C03.1.454.CMB.1.raw
  modified_base (205)..(205): a, c, t, g, unknown or other
  misc_feature (205)..(205): n is a, c, g, or t
  modified_base (337)..(337): a, c, t, g, unknown or other
  misc_feature (337)..(337): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgagtgacgcagtctccagccaccctgtctgccgtcncgaggacaacacgccctacctctcctgctgggccaggtccgagtcgtggcacgccgtatacgccgtacggtacccagaccaaaaccgtgacccacgccctacccgacggtctccgttccgtctagtcggacncctactccgaacgacgggtccctacgtcgtaacgtcccacgtccgtaggtcgaggttcggacgtaggtcgggtcggtacgggacctagggttaacggttccgtaccgtttccgaaccgtaccgtacgtaccgtaacgccgttaaacggtcccgttagggaacttaaccgttaacgtaggtttaaaacgttgtttttaacccgtacgtttaaacgtttttacgtaccgttcgggttaacgtaaacgggtaccttaagggttagtaccgttggtacgtttccggtacctttacccgtaacgtttacgttacccgggacgtaaacccgggtacgtaagggtaccggtaaactacggtaaacctaaacgtaccggttagaccgtttcaaccgtataccccg

SEQ ID NO: 243327 - DNA, 833 bp, Homo sapiens
  misc_feature: GYAE6OF01CLCCP.10.25.C03.1.454.CMB.1.raw
tcagcatagtagtgcacgaccggtgctcgatttagtagtgtagatttggggtttggggagagctcgtgggggaggaactgctcagttaggacccagacggaaccatggaacgccccagcgcacgtcttctccttcctcctgctactcgacggccctacccaagaaaaccacgtagggaagtaaacgtcgtgagtcgacgctacgtcctccgacgccctacccgttgtcgtcggtccgtccgtccgaacgggaaccaaaaccgaccgaccctaccccttcgtccgtcgccggtccgggaccgtacggtccggagttggtcggaccgacgtccgtacgtacgtccgtacggtaaccaacgaaccgaaaaccgtccggacctaccgaccctccgaccggtcccgttacctcggtacgtacgtcggtacgaccacctacgaacggaaccggtaccacggttacgtaccaccgacgtacggtacgtacggtaggcggtacgttacgggcgggtacgtcgggaacgtcggtacgttcgcctaccgtaccacctgtacgtaccgacgttaacggtccgtacggtaacctaggttacgtaaacgttacgggttttacttacgttaacggtttaacgtttaccgttttaaggtaaccggttaacgggttaactttaaaggttccgttaggtaaccgggttcgggttacccgttccggttaccggttacccggttaggttaacccggttacggggtaaccgtaaacgggtaaccggtacggttaacctaacgtaaaccgttaaagaaaccgttgtacgggtagtaccgtaccgtccggttacg

SEQ ID NO: 243328 - DNA, 504 bp, Homo sapiens
  misc_feature: GYAE6OF02HWCDT.10.25.C03.1.454.CMB.1.raw
  modified_base (457)..(457): a, c, t, g, unknown or other
  misc_feature (457)..(457): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtatcccagccaggttcagtggcagtgggtctggggacagagttcgctctcaccatcagcagtctgcagtcctgaagtattttgctagtttattactgtcaggtaatatgatggctggcctcgtacncttttgccaagggcctaagttggacatacaacgactgtgctgctacc

SEQ ID NO: 243329 - DNA, 646 bp, Homo sapiens
  misc_feature: GYAE6OF02H6QEA.10.25.C03.1.454.CMB.1.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccacctctcctgctgggccagtccgagtgttggcagccgcttagcctggtaccagcaaaaacctggaccacgcctcccaggctcctcgtctatggtgcatccacgaacgggccactggtactcccagcctaggttcagtcggcaggtcggtacgtgggacagagttcgactcgtcacatcagcagtctgtcgtaagtcgtagaaggtaagttttcgtacgttaagttttactttaaaaacgttcgttaacgtaaggtaaagttaagtagtaagttacggtacgttcgggtacccgttacccgttaaccgttaccgttttacgggtaccggttaaaccgggtaacccggttaaacggttacggtaacgtaacgttaaccgtaaaccggtaaacgttacggttacgggtaccggttacgtaccgtaaacccg

SEQ ID NO: 243330 - DNA, 573 bp, Homo sapiens
  misc_feature: GYAE6OF02I4AZA.10.25.C03.1.454.CMB.1.raw
  modified_base (385)..(385): a, c, t, g, unknown or other
  misc_feature (385)..(385): n is a, c, g, or t
  modified_base (405)..(405): a, c, t, g, unknown or other
  misc_feature (405)..(405): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgtggcagccgcttagcctggtaccagcaaaaacctggccagcctcccaggctcctcgtctatggtgcactccaacaagggccactggtactcccagccaggttcagtggcaggtggtcgtgggacagagttcgctctacnccatcagcagtctgcacgtntaggaagtattttgacttagtttacttacgtgtactaggtaattagtgtagttggcgttggtcccgttccgtaacttccgttttacggaccgtaacgggtaacccgttaaggttacggtaacctaagttaccaaaacggtaacctggtacggccgttagacctaaccg

SEQ ID NO: 243331 - DNA, 547 bp, Homo sapiens
  misc_feature: GYAE6OF02GHZ48.10.25.C03.1.454.CMB.1.raw
  modified_base (410)..(410): a, c, t, g, unknown or other
  misc_feature (410)..(410): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaacctggccagcctcccaggcctcctcgtctatggtgcatcccacaacgggccacgtggtactcccagccaggttcagtgcagtggtctgggacagagttcgctctcaccatcagcagtctgcagtctgaagttnttttgctagtttattactgtacaggtaatagtgatggctcggccttaccgtactaccgttttggacccgtaacgggtaaccgtaaggttcggaactacgtaccgaaacggtacttggtacggtctaggacctaaccg

SEQ ID NO: 243332 - DNA, 506 bp, Homo sapiens
  misc_feature: GYAE6OF02HDQ2G.10.25.C03.1.454.CMB.1.raw
  modified_base (454)..(454): a, c, t, g, unknown or other
  misc_feature (454)..(454): n is a, c, g, or t
  modified_base (495)..(495): a, c, t, g, unknown or other
  misc_feature (495)..(495): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacagggccactggtactcccagccaggttcagtggcagtgggtctgggacagagttcgctctcaccatcagcagtctgcagtctgaagtattttgctagtttattctgtcaggaatatgatgtctggtcctcgtacnctttgacctaagggctaaggttggacagtacaaacgactgnggctgctaccg

SEQ ID NO: 243333 - DNA, 582 bp, Homo sapiens
  misc_feature: GYAE6OF02HRTYM.10.25.C03.1.454.CMB.1.raw
tcagcatagtagtgcacgaccggtgctcgatttagtagtgtagatttgggtttgggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagacaaaaacctggccagcctcccaggcctcctcgtctagtggtgcatccacgaaggccactggtatcccagccaggttcagtggcaggtgggtcgtgggacagaggttcgctctcaccatcagcagtctgcagtctagaagtattttgactagtttatactgtacaaggtaattagtagtagtggcgttcgggtccctaccggttacttacgttttccgggaccgtaacgggtaacccttaaggttacgggaactaacgtaaccgaaacggtaaccgttagggttacgggtaccttacggacctaacccg

SEQ ID NO: 243334 - DNA, 526 bp, Homo sapiens
  misc_feature: GYAE6OF02IJVLR.10.25.C03.1.454.CMB.1.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagacaaaaacctggccagcctcccaggcctcctcgtctatggtgcatccacaagggccactggtatcccagccaggttcagtggcagtgggtctgggacagagttcgctctcacatcagcagtctgctagtctagaagtattttgctagtttattactgtcaggaattatgagtggctgcctccgtactacgtttcggaccgtaagggaccaagttcgaacatacgaaacgaacgttggacggtctcgactaaccg

SEQ ID NO: 243335 - DNA, 653 bp, Homo sapiens
  misc_feature: GYAE6OF02IFIHN.10.25.C03.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccacctgtctgcgtcnccagggacaaacngccacctctcctgctgggccagtccgagtgttggcagccgcttagcctggtaccacgacaaaaaccgtcggccacgcctacccgaggtcctcctcgtctagtcggtcgctactccgaacgacgggcctacgtggtactacccagaccgtacggttacacggtggccgtaggtcggtcgtgggactaggacgttcgctcgtaccactacgtacgacgcgtacgtcgtacgacgtacgtacgtacggtaagttacgttttgtacgttaacggttttacttacgtacggttacgaaagggttaactagttacggtagttacggtacgtcggtccgttaaccggttacgtttaccgtttacgggaccgttaacgggaaccttacggttacggaacttaacgtaacgtaaacgtacgtcggtacggtcttacggaccctaacg

SEQ ID NO: 243336 - DNA, 659 bp, Homo sapiens
  misc_feature: GYAE6OF02H0916.10.25.C03.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
tcagcatagtagtgcacgaccggtgctcgatttagtagtgtagatttgggtttgggggagagctctggggaggaactgctcagttaggacccagacggaaccatggaagccccagcgcagcttctcttcctcctgctactcaggcctcccagaaaccactggagaaatcgtgatgacgcagtctccagccacctgtctgcgtctcgaggcaaacncgccaccctctcctgctgggccagtccgagtgtgcagcnctagcctgaccagacaaaacgtggcacgcctccaggcctcctcgtctatggtcgacactccacgaacgggccacgtacggtacctacccgacgtaccgtacggttcgacggtggacgtagggtgggtacgtagggacgtaggtacggttcgctacctaccacactacgacgtcgacgttcgtgaccgtagtcgttagtaagttagtttacgactttagtttactttacgttaggtacgtaaagttaattagtacgtagttcggtacgttccggtacccgttaccgttacgtttacggttttaccggaaccggtaaaccgggtaaccggttaaggttaacggtaaccgttaacgtaaccgtaaacggtacgttacgggtacggtaccgtaccggtaccttaacccg

SEQ ID NO: 243337 - DNA, 531 bp, Homo sapiens
  misc_feature: GYAE6OF02FUERM.10.25.C03.1.454.CMB.1.raw
  modified_base (215)..(215): a, c, t, g, unknown or other
  misc_feature (215)..(215): n is a, c, g, or t
  modified_base (414)..(414): a, c, t, g, unknown or other
  misc_feature (414)..(414): n is a, c, g, or t
  modified_base (441)..(441): a, c, t, g, unknown or other
  misc_feature (441)..(441): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngccaccctctcctgctgggccagtccgagtgttggcagccgcttagcctggtaccagcaaaaacctggccagcctcccaggctcctcgtctatggtgcatccacaacgggccactggtactcccagcctaggttcagtcggcaggtcggtctgggacaggagttcgctctcaccatcagcagtctcgcagtctgaacgntgttgactagtttatacttgtacaatntccgtaccgagtcgccgtcgggcctacgttccggccgtcggaccgtaaggtcggtactacgtacaaacgactggtaggctcgctactacg

SEQ ID NO: 243338 - DNA, 597 bp, Homo sapiens
  misc_feature: GYAE6OF02H61F6.10.25.C03.1.454.CMB.1.raw
  modified_base (436)..(436): a, c, t, g, unknown or other
  misc_feature (436)..(436): n is a, c, g, or t
tcagcatagtagtgcacgaccggtgctcgatttagtagtgtagatttgggtttgggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagacaaaaacctggaccacgcctcccaggcctcctcgtctagtggtgcactccaacgaacgggccacgtcggtactcccagcctaggttcaggtcggccgtaggtcgggtcgtggggactaggtagttcgctctcacactcagcagtctgctagtctagtaagtnttttgacttagtttaacttacgtgtactaagggtaattagtagtagtcggtcgttcggtcccttaccggttacgttacgttttacggaccggtaacgggtaactaaggttacggaactaacgtaccgtaaacgtacgtaggtacggcttacgacctaaccg

SEQ ID NO: 243339 - DNA, 608 bp, Homo sapiens
  misc_feature: GYAE6OF02I2JQ7.10.25.C03.1.454.CMB.1.raw
  modified_base (215)..(215): a, c, t, g, unknown or other
  misc_feature (215)..(215): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngccaccctctcctgctgggccagtccgagtgttggcagccgcttagcctggtaccagacaaaaacctggccagcctcccaggctcctcgtctatggtgcactccacgaacgggccacgtggtactcccagccaggttcaggtggcaggtgggtcgtgggacgaggtacggttcgcttcctccaacctatccgacgcacgtctgctagtctagtaagttattttgacgttagttttaattacgtgtacaaggtaattacgtgtagttcggcgttcggtcccgttaccgttaaccgttaccgttttacgggacccggtaacgggtaaccgttaaggttacggaacctacgtaaccgtaaacgtaccgttggtacggtacgtacgtaccgtaaccg

SEQ ID NO: 243340 - DNA, 532 bp, Homo sapiens
  misc_feature: GYAE6OF02G34B8.10.25.C03.1.454.CMB.1.raw
  modified_base (216)..(216): a, c, t, g, unknown or other
  misc_feature (216)..(216): n is a, c, g, or t
  modified_base (393)..(393): a, c, t, g, unknown or other
  misc_feature (393)..(393): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
tcagcatagtagtgcacgaccggtgctcgatttagtagtgtagatttgggtttgggggagagctctggggaggaactgctcagttaggacccagacggaaccatggaagccccagcgcagcttctcttcctcctgctactctggctcccagataccactggagaagtagtgatgacgcagtctccggccaccctgtctgtgtctccagggggaaangtcaccctctcctgcagggccagtcagactattagtacaaacttggcctggtaccagcataaacctggccaggctcccaggctcctcatccatggtgcatcctccagggccactaatactcccagcccaggttcagtggcaggtgggtcgggtcagagttcactctcaccatcagcngcctgcagtctagaagtatttgacttagtttatacgtntacagtntagttatacgtataccgtgtccttcgtacgtcgtttcgggaccgggtacacggcgtaggaactcgaacgtacgaactcggtagctagcactacg

SEQ ID NO: 243341 - DNA, 578 bp, Homo sapiens
  misc_feature: GYAE6OF02HLCBZ.10.25.C03.1.454.CMB.1.raw
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccacctgtctgactctccagggcaaacagccaccctctcctgctgggcagtccgagtgtgcagccgctagctgtaccagcaaaactgcagctccagctctcgtcatggtgcatccgacaacggccactggtactccagcctaggtcagtggcaggtggtctgggacagacgttcnctctcacctancgacgcgagtcngctagtctagaattagttttcgacttacgtttaactttactcggttactaagggtaaactagttggtaatacgggtctaccggtccgttaccgtaacgtaccgttttacggaccgttaaagggaacctaagggttacgaactaacgtaaccaaacggtaaccgttaggttaccggtacgtacgtacctaacccg

SEQ ID NO: 243342 - DNA, 670 bp, Homo sapiens
  misc_feature: GYAE6OF02JDO5A.10.25.C03.1.454.CMB.1.raw
  modified_base (156)..(156): a, c, t, g, unknown or other
  misc_feature (156)..(156): n is a, c, g, or t
  modified_base (217)..(217): a, c, t, g, unknown or other
  misc_feature (217)..(217): n is a, c, g, or t
  modified_base (353)..(353): a, c, t, g, unknown or other
  misc_feature (353)..(353): n is a, c, g, or t
  modified_base (572)..(572): a, c, t, g, unknown or other
  misc_feature (572)..(572): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccnctggagaaatcgtgatgacgcagtctccagccaccctgtctgcgtctccgagggcaaacgngcccaccctctcctgcgtcggccaggtccgagttggtcggacacgccgtcttacgccgtacggtaccaacgaccaaaaaccgtcggaccgaccgtcccctacccgacggtccttacccgtcgttcgtagtcggtcncacgtaccgaaccgacgggccctacgtacgtacctcccgacgtccgtaggtccgaggtcggacgtagggttcgggtcggtacgggacgtacggtacgttccgtctccgtaccaccgtaactcgacgtaccgacgttcgtggacgttacgttaccgtaagtacgtttacgttttagtacgtttaacgtttaacgtttacgtacgtaacgtaagtattagngttagtcgtcgtccgtccgtaccgttacgttccgttacggacgtaacggtcgtaaggtcgacgtaactacgtaacgtgttacgagactcgacgtaccg

SEQ ID NO: 243343 - DNA, 809 bp, Homo sapiens
  misc_feature: GYAE6OF02JDNWY.10.25.C03.1.454.CMB.1.raw
  modified_base (216)..(216): a, c, t, g, unknown or other
  misc_feature (216)..(216): n is a, c, g, or t
  modified_base (330)..(330): a, c, t, g, unknown or other
  misc_feature (330)..(330): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactctggcctcccagactaccactggagaagtagtgatgacgcagtctccggccaccctgtctgtgtcctcgaggggaanacgtccacctctcctgccgaggccagtcaagtactaattacgaacaaacgttggccgtaggtaccagactaagtaaacctcggaccaggtacctcccgaacggtctacccgtanactaccgagttgggtcacctacgtcccgtacggacgggtaaccctaacgttaactaccgcccgacgtaccgtacggttaccaggtcggtacggtagggttcgggggggtccggtacgaaggtttccgttaaccgaccgttacccgtaccgtaaccgtacgtaccgtaaacggtcccgaacggtccgttcggtaaccgttaaaggttaccggtttaaggaaacttttacggttttacggaaccctttagtttttaaccgtacgttcggaactaacggtacgttaacgttacgtacgtaaccgtttaacccgtcggtaaccctttaccgggttaaccggtttacggtttaccccggggggaacccggttaacggtaaaccggtcgggttaaaaccgttaacggtacccggtaaaacccgttaggttaacccggtttaagggtccgggtccgtttaaaaccggcccgttaaaccggtttacg

SEQ ID NO: 243344 - DNA, 606 bp, Homo sapiens
  misc_feature: GYAE6OF02FWO2M.10.25.C03.1.454.CMB.1.raw
  modified_base (216)..(216): a, c, t, g, unknown or other
  misc_feature (216)..(216): n is a, c, g, or t
tcagcatagtagtgcacgaccggtgctcgatttagtagtgtagattttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngccaccctctcctgctgggccagtccgagtgttgcagccgctagcctggtaccagcaaaacctggaccagcctcccaggcctcctcgtctagtggtgcactcccaacgaacgggcccacgtggtactcccacgcctaggttcagtcggctaggtcgggtctaggggactaggacgttcgcttctcaccaagtaacgctagtctgcagtctagaagttatttgcttagtttattacttgtacaaggtaatagttagtagttcggtcgttcggtaccttaccgttacgtaccgttttcggaccgtaacgggtaccgttaacgggttcgtaaccgtaacgtaaccgtaaaccggtaacgttcggtaccggtactaccggtaccgtaccttacg

SEQ ID NO: 243345 - DNA, 638 bp, Homo sapiens
  misc_feature: GYAE6OF02GIS48.10.25.C03.1.454.CMB.1.raw
  modified_base (216)..(216): a, c, t, g, unknown or other
  misc_feature (216)..(216): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagcccacctgtctgcgtctccagggacaaacngcccaccctctcctgcgtgggccagtccgagttgtgcagccgcttagcctggtaccagcaaaaacctcggccagccctcccacggcctccgtcgtctacgtggtcgcactccacgacggccacgtgtactccacgcctaggttcagtgcgtggtggtcgtggacagtagttcgctctccactactcgagccgtagtctcgtcgtacgttacgtaggtaaggtttattttcggtactttagttttaacttaccgttggttaacgtaacggttaatttacgtggttaacggttcgggtacgttccggttacccttccggttaaccgttaccggttttacgggaccggtaaacgggtaccggttaagttacgggaacttacgtaaccgtaacgtacgttacggtacgtacgtacgtacctaaccg

SEQ ID NO: 243346 - DNA, 740 bp, Homo sapiens
  misc_feature: GYAE6OF02JIBAT.10.25.C03.1.454.CMB.1.raw
  modified_base (105)..(106): a, c, t, g, unknown or other
  misc_feature (105)..(106): n is a, c, g, or t
  modified_base (299)..(299): a, c, t, g, unknown or other
  misc_feature (299)..(299): n is a, c, g, or t
  modified_base (690)..(690): a, c, t, g, unknown or other
  misc_feature (690)..(690): n is a, c, g, or t
tcagcatagtagtgcacgaccggtgctcgatttagtagtgtagatttgggtttggggagagctctgggaggaactgctcagttaggacccagacggaaccagtcnncgacgaccgccgcgcgcgtcgtcttcttccttccgtcgtacgtactacgtacgacgtaccgtaaccgtaacgtaaccgtacgtaacggtaacgtaacgtacgtagtacgtacgacgtacgtacgtaccgtaccgtaccgtaccgtaccgtacgttacgtacgtaccgtaccgtacggtaacgaacgaccgtanaccgtacccgtaccgtaccgtacgtacgtcgacggtacgtaccgtacgtacggtacggtacgtcaggaccgtacgttacgtacgttacggtaaccgtacggtaaccgtaaaaccgtaccggtaaccgtaaccgtacccgtaccgtacggtaccgtaccgtaccgtacgtacgtacggtacgtacgtacgtaccgaacgtaacggtaccgtacgtacgtaccgtaccgtacgtaccgtacgtacgtacggtacggtacgtacggtacggtacggtacggtaacgtaacgtaacgtacgtacgtacgtacgtaacgtacgtacgtaacgtacgtacgtacgtacgtacgtacgtacgtacgtaacgtagttacgtacgttaagttacgttacngtaacgttaacgtaagtaacgtaacgtagtacggtacgtacgtacgtacg

SEQ ID NO: 243347 - DNA, 559 bp, Homo sapiens
  misc_feature: GYAE6OF02GOBUU.10.25.C03.1.454.CMB.1.raw
  modified_base (420)..(420): a, c, t, g, unknown or other
  misc_feature (420)..(420): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgctagcctggtaccagacaaaaacctggaccagcctcccacggcctcctcgtctagtggtgcactccacgaacggccacgtcggtactcccagccgacggttcagtggcgagtgggtcgtgggacaggtagttcgcgtctcaccatcgagcagtctgcagtacgngtaagtatttgacgtagtttattacgtgtacgtaagtaattagtgtagtgtcgtcgtcctacgtacgtcgtttagaccgtaaggacctaaggttacggaactagtaccgaacgtacgtcggtagtctacgacgtaaccg

SEQ ID NO: 243348 - DNA, 628 bp, Homo sapiens
  misc_feature: GYAE6OF02FQCLN.10.25.C03.1.454.CMB.1.raw
  modified_base (216)..(216): a, c, t, g, unknown or other
  misc_feature (216)..(216): n is a, c, g, or t
  modified_base (304)..(304): a, c, t, g, unknown or other
  misc_feature (304)..(304): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggacaaacncgcccaccctctccctgccgtcgggccagtccgagtgttggccagccgcttagccgtggtaccagaaccaaaaaccgtcggacctacnccctcccgaggtcctccgtcgtcgtagtcggtcgcactccacgacggccacgtcggtacctccacggtccgtaggtcgaggtcggcgtaggttcgggtacgtgggacgtgtacggtcgtcctactcacctgtacgagcgtacgtctcgacgtagtcgtagttaagtttcgtttagtcgtttaacgtttattacgttacggtacgtaagtagttacgtggtacgtcggtcgttcgtaccgttcgttacttaggtttaccgacgtaacggtacgtaaggttacgaacgtagtaacgaacgttcgtacggtacggctacgacctacg

SEQ ID NO: 243349 - DNA, 654 bp, Homo sapiens
  misc_feature: GYAE6OF02GOPOH.10.25.C03.1.454.CMB.1.raw
  modified_base (224)..(224): a, c, t, g, unknown or other
  misc_feature (224)..(224): n is a, c, g, or t
  modified_base (287)..(287): a, c, t, g, unknown or other
  misc_feature (287)..(287): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgccgtctcagggcaaacagccacctcnctgctgggccagtccgagtgtgcagccgcttagcctggtaccagacaaaacctggccacgccncccaggctcctcgtctacgttggtcgcactcctacgaacgggccacgtggtactcccgagccgaggttcacgttcggcgtaaggtcggggtctacgggacgaggtacggttacgccttctaccgacctacgtaccgacgccgtaggtccgttcggacgtacgttcgtaggtaacgttaacgttttcgctaacgtttttattaaccgtgtacgtaggtaattacgtagtaagttcggtcgttacggtccgttaaccggtaccttcgttttacggtacccgtaacgggtaaccgttaaggttaccggtaaccgtacgttaaccgaaacggtaaccgttagggtaccggtcgttaccggacctaacccgg

SEQ ID NO: 243350 - DNA, 551 bp, Homo sapiens
  misc_feature: GYAE6OF02FJN4V.10.25.C03.1.454.CMB.1.raw
  modified_base (216)..(216): a, c, t, g, unknown or other
  misc_feature (216)..(216): n is a, c, g, or t
  modified_base (432)..(432): a, c, t, g, unknown or other
  misc_feature (432)..(432): n is a, c, g, or t
  modified_base (546)..(546): a, c, t, g, unknown or other
  misc_feature (546)..(546): n is a, c, g, or t
tcagcatagtagtgcacgaccggtgctcgatttagtagtgtagatttgggtttgggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngccaccctctcctgctgggccagtccgagtgttggcagccgcttagcctggtaccagaccaaaaacctggaccacgccctcccaggcctcctcgtctagtggtgcactccacgaacgggccacgtggtactcccagccgaggttcaggtggcgaggttgggtctggagacgagtacgttcgctctccacatcagcagtctgacagtctagtaagtnttttgacttagttttacttacttcgtacgtaaggtattagtagtagttcggtcgtcgtcctcgtacttacgttcgacgtaaggactagtgactagtacaacgtacgtggcgtcngtacc

SEQ ID NO: 243351 - DNA, 636 bp, Homo sapiens
  misc_feature: GYAE6OF02GQA7Q.10.25.C03.1.454.CMB.1.raw
  modified_base (216)..(216): a, c, t, g, unknown or other
  misc_feature (216)..(216): n is a, c, g, or t
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagcccaccctgtctgcgtctccagggcaaacncgccaccctctcctgctcgggccacgtccgagtgttggcagccncttagcctcgtaccagacaaaaccgtgcccanccctccgacgcctccgtcgtctagtggtcgctactccaacgaacgggccctacgtcggttactccccgtactccgtaggttcaggtcggcgtaggtcgggtcgtacgggactaaggtcggttccgctctccactatccgagtcgtagtctcgtacgtaggtactagtaagttattttcgagtttagtttaacgttacgttgttacgaacggttaattacgtgtaggttcgtacgtcgttacccgtacgttaccgttacgttttacggaaccgtaacggggtaacctaaggttcgaacgtaacgtaacgaaaccgtattaccggtcgtacgtacgtaccgtaccg

SEQ ID NO: 243352 - DNA, 741 bp, Homo sapiens
  misc_feature: GYAE6OF02G0DFA.10.25.C03.1.454.CMB.1.raw
  modified_base (218)..(218): a, c, t, g, unknown or other
  misc_feature (218)..(218): n is a, c, g, or t
tcagcatagtagtgcacgaccggtgctcgatttagtagtgtagatttgggtttgggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccgagggccaaacncgcccaccctctcctgccgtgggccacgtccgagtgttggcagccgcgtagcctggtaccagaaccaaaaaccgtggacccacgccctcccgacggcctcccgtcgtctagtggtcgcactcccacgaacggccacgttcggtacctcccgacggtccgtaggttcaaggtcggccgtagggttcgggtacgtacggggaactacggtacggttccgtcctaccttaccgacctacgtaccgacggtacctagttcgtcgtaccgtacggttacgtaacggttaagtttacgttttcgtactttaagttttacgttaacgtttggtaacgttaagggttaacttaggttacgtaggtttacgtccgttccggtcccgttaaccgttaccggttaaccggtttttccgggaacccgggttaaacggggtaaccggttaaacgggttacgggtaaacccgtaaccgttaaccggtaaaaccgttacggttaacgggtccggtaacggttccgaacccgtaacccg

SEQ ID NO: 243353 - DNA, 668 bp, Homo sapiens
  misc_feature: GYAE6OF02GQ8IW.10.25.C03.1.454.CMB.1.raw
  modified_base (215)..(215): a, c, t, g, unknown or other
  misc_feature (215)..(215): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacngccaccctctcctgctgggccagtccgagtgtggcagccgcttagcctggtaccagacaaaaaccgtgccagcctcccaggcctccgtcgtctagtggtgcatccgacacgggcctacgtcggtactccccgagccctagggttcaggtcggcgtaggtcgggttcgtggggaactaggtacggtttccgcctttccgtaccgaacctacttccgaaggccgtacgttcgtcgcctaaggttccgtagtaaagtttcgtttttacgacgttaacgtttttaactttacgtagttacgtaaaggttaattaagtgtagttcggtctacggtcccgttaccgttacgtttacggttttcggaaccggtaacgggtaccgttaacggttacggtaacctaacgttaacccgaaaaccgttacgttacgggtacggaccgttacgacccgtaacccg

SEQ ID NO: 243354 - DNA, 909 bp, Homo sapiens
  misc_feature: GYAE6OF02G6B6G.10.25.C03.1.454.CMB.1.raw
  modified_base (172)..(172): a, c, t, g, unknown or other
  misc_feature (172)..(172): n is a, c, g, or t
  modified_base (222)..(222): a, c, t, g, unknown or other
  misc_feature (222)..(222): n is a, c, g, or t
tcagcatagtagtgcacgaccggtgctcgatttagtagtgtagatttgggtttgggggagagctctgggggaggaactgctcagttaggacccagacggaaccatggaagccccagcgcagcttctcttcctcctgctactcaggctcccagaaaccactggagaaatcgtnatgacgcagtctccacgcccacctgtctgcgttctccgagggaccaaacncgccctaccctctcctgctcgggccaggtccgagtgtcgctcgccgtcgttacgcgtcggtaccaacgaccaaaaccgtcgaccacgtcccgtacccgacggtccctcccgttcgttcgttaacgtcggtcgaccgtacgtaccaaccggaaacgggtccctacggttaggttaacctccccgaccggtaccgttaacgggttacaacgggttcggacgtaacgggtttcggggtacgtacggggtaaccgtacgggtagtttcccggctttaccgtaccgaacccgtacttaccggaacgtccgtacgtttccgtacgggtaccgtaacgggttaccgtaagggttaaacgtttcggtttttaacggttaaggttttaacgtttttaaacgtttaccgttagggtttaaacgtaaaacgggtttaaccttaagggttaacgttaacggggttaccggttaaccgggtttcccggttacccggtttaaaacccgttttacccgggtttaaacccgggttttacccggggaaacccgggttaaaacggggtaaccccggttttaaacggggttaaccggggtaaacccgttaaaacccgggtttaaacccgtaaaacccggggtttaacccggtttacgggttaaccccgggtaacccggtttaacgggtacccccgtttaaacccgg

SEQ ID NO: 243355 - DNA, 860 bp, Homo sapiens
  misc_feature: GYAE6OF02IH7WS.10.25.C03.1.454.CMB.1.raw
  modified_base (237)..(237): a, c, t, g, unknown or other
  misc_feature (237)..(237): n is a, c, g, or t
tcagcatagtagtgcacgaccggtgctcgatttagtagtgtagatttgggtttgggggagagctctggggaggaactgctcagttaggacccagacggaaccatggaagccccagcgcagcttctcttcctcctgctactcaggtcctcccgaagaaaccactgggaagaaatcgtgatgacgcagtctcagccacctgtctgcgtactccgaggactaaatcgccaccctctccgngccgtcgggccacgtccgaggttggttcggcagccgtcttacgccgtaggtaccaagaaccgaaaaacccgtcggaccctaacgcccttacccgacggttcccttccgttaccgttacgttacgttcgggttacacgtacctccgaaacggaccgggtccgtaacgttacggtacctacccgacgtaccgtacggttacgtacggtcggtacgtacgggtcggtaccgtaggggtacgtaacggtaccggttccgtacgtttcccgtaccgtaaccctaacgtacccgacggtaccgttacggttaccgtcggaacgtttaaccggtacgtttaaacgggttaacgtttacgtttttaaccgtaacggtttaaacctttttaacggttaccgttaacggtaccgtaagggttaaacttaggttacgtacgggtttacggttcccggtttaccgggtacccgtttaacccggttaaacgtttacccgggttttaccggaaacccgggttaaacgggtacccgtttaaacgggttaacccggtaaacgttaacccggttaaacccgggtaaaccggttaccggtaccgggttaccggtaccgttaccggtacccgttaaacccgg

SEQ ID NO: 243356 - DNA, 799 bp, Homo sapiens
  misc_feature: GYAE6OF02IJHXA.10.25.C03.1.454.CMB.1.raw
  modified_base (320)..(320): a, c, t, g, unknown or other
  misc_feature (320)..(320): n is a, c, g, or t
tcagcatagtagtgcacgaccggtgctcgatttagtagtgtagatttggggtttggggagagctctgggggaggaactgctcagttaggacccagacggaaccatggaagccccagcgcagcttctcttcctctgctactcaggctcccagaaaccacgtggagaaatcgtagataggacgcacgtctccacgcctacctgtctcgtcgtcctccgacgggacaaacgacgccacccttctcctcgccgtcgggccacggtccgagtggttcggcgagtccgcttacgccgtcgtacacgaacaaacgtcgccacgcccnccgagccttcctcgtactacgtcggcactacaccgaacgacgggacctacgtacgtctaccgacgtcgtacggtcgacggtcggtacggtacggtcgggtacgacggaacgtcgtactcctactaccgacctaaccgtagttcccgacgggtaccggtcccgttacgaccgtacggtaacgttacgggtaaacgttttaacgtttcgtaaaccggttttagtttttaaacccgttacgttacggtaaccgtaagtaccgttaaaggttaacgttaaaggtttccggttaaccgggtttttacggtttttaaaccgttaaccggtttacccgggtttaacccggttaccggggttaaaccgggttaaaccggttaaacgggttaacggttttaaccgtttaaccggtaaacggttacgttaacccgggttcggttaccgggttaaccctaacgggttccctaccggtttacgttacccgg

SEQ ID NO: 243357 - DNA, 762 bp, Homo sapiens
  misc_feature: GYAE6OF02HWIL8.10.25.C03.1.454.CMB.1.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggcctcccagaaaccactggagaaatcgtgatgacgcagtcctccacgcccaccctgtctgccgtcctccgacgggaccaacacgacccaccctctccctgtccgtcgggcccacggtccggtagtgttcgggcgacgccgtcgttacgccttacggtaccgacgaacctaaaaaccgtcggacccgacgcccctacccgacggtcccttcccgtccgttacttacgttcgggtcgtcctacctaccctaacggaaccggggcctaccgtacgggtacctaccccgtacgaccgtacgttccggaggttcggacggtaggttcgggtcggttaggggacgtagtacggttccgtccttccgtaccacctactacgacgctacggtcgtgtcgtacgttcgtaggttaagttacgtttttgtaccgtttaagtttactttacggtacggttaacgtaacggtaagttacgttagtaggttccggttaccgttccggttacccgttaccggttaccgtttaccggttttaccggtaaccggtaacgggttaaccgtttaacgggtacgtaaccttaacgtaacgtaaaccggtacggttgtaccggtacgtaccgaccttacg

SEQ ID NO: 243358 - DNA, 789 bp, Homo sapiens
  misc_feature: GYAE6OF02HJTHV.10.25.C03.1.454.CMB.1.raw
  modified_base (125)..(125): a, c, t, g, unknown or other
  misc_feature (125)..(125): n is a, c, g, or t
  modified_base (179)..(179): a, c, t, g, unknown or other
  misc_feature (179)..(179): n is a, c, g, or t
  modified_base (224)..(224): a, c, t, g, unknown or other
  misc_feature (224)..(224): n is a, c, g, or t
  modified_base (299)..(299): a, c, t, g, unknown or other
  misc_feature (299)..(299): n is a, c, g, or t
tcagcatagtagtgcacgaccggtgctcgatttagtagtgtagatttgggtttggggtagagctctggggaggaactgctcagttaggacccagacggaaccatggaagccccagcgcagcttcncttcctcctgctactcaggcctccagaaaccactaggagaaatcgtgatgacgnagtctccacgccaccctgtctcgtccgtctccgagggaccaaacncggccctaccctcctccgtcgccgtccggggacctaaggtcccgaggttgttacgggacacgtccgtacgttacnccgtaggtaccagtaaccgaaaacctgggaccacggtccctacccgacggtccctccgttcgtaccgttacgtcggtcgtccatacccgaacggtagggaccctacggttataccgaccccgacgtaccggacgttacgtacggtcggacggtaagggttcggtacgggtacggacgaacggtcggtttcgcctttcgtctacccgaaggtcgtaaacggtcgtcgtacggtcgtaccgtacgtacggttagtaaacgttacgttttacgtaacgttacgtttttaacgttacgaccgggtttagtaaaccgggttaaattccgaaggttagtttaccgggactttcccgggaccgtttaccggttacccgttttagtttacccggtaccgggtaaaccgggttaccgttaaagggtacccggtaaataccggtaaaccgttaaaccggtaccggtttaggtaacggccgtttacgaccccgtttaaacg

SEQ ID NO: 243359 - DNA, 764 bp, Homo sapiens
  misc_feature: GYAE6OF02JWWX5.10.25.C03.1.454.CMB.1.raw
  modified_base (159)..(159): a, c, t, g, unknown or other
  misc_feature (159)..(159): n is a, c, g, or t
  modified_base (266)..(266): a, c, t, g, unknown or other
  misc_feature (266)..(266): n is a, c, g, or t
  modified_base (402)..(402): a, c, t, g, unknown or other
  misc_feature (402)..(402): n is a, c, g, or t
tcagcatagtagtgcacgaccggtgctcgatttagtagtgtagatttgggtttgggagagctctgggagaactgctcagttaggacccagacggaaccagtggaacgccccagccgcagtcctttctcttcctctgctactcgaggctcccagtaaccncgtcggagaactcgtgactgacgctacgttccacgacgccctacccgtgtcgtacgtccgtaccgtaccgacgggacctaaaaccgcgccccaacccgttctcccgngtccgttccgggacctacggtccggtagttacggttcgaccgtacgtccgtcgttaacgccgtaacggtaaccgtacgaacctaaacgcgaccgacgacctccgacgtcctcgttaccgtatacgtagtcgtaccnctaccgacgtacggcctacgtacgtactccgagccgtagtacgtacgtacgaccgtaggtcgtacgtacggtacacggttacgtccgtaccgttcgtaccgactacgtaccgtaagccgttaaccgtcgttacggaccgtacgttaacgttaccgggttaatttaaccgtttgttaacccggtttagtttaacccgtcgtttaacgtaacgttaaggtactaggtttcgaaccgtcggttaacgttacccggtaccgttaccgtttaacgttcggttacccgaacggttacgggtaaactaaccggttgaaccgttacggtaaccgtagtaccgttcggactcccggtagtacccgtaacgg

SEQ ID NO: 243360 - DNA, 634 bp, Homo sapiens
  misc_feature: GYAE6OF02IVWP5.10.25.C03.1.454.CMB.1.raw
  modified_base (214)..(214): a, c, t, g, unknown or other
  misc_feature (214)..(214): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccacctgtctgcgtctccagggcaaacncgccaccctctcctgctcgggccagtccgagtgttggcacgccgctacgcctggtacccagacaaaaacctcggaccacgcctccaggcctcctcgtctatggtcgcactccacaacgggccacgtgtactccagccgtagttcacggtggcgaggttcgggtctagggacaggtacgttcgcttctacgactactcacgcgtagtctcgctagtactaggtaacgttattttcgcgttaagttttacgttacgtcgttacgtaaggtaagttaagtcggtaagttacggtcgttaccggtacccttaccggttacttacgttttacgggaaccgtaacggggtaaccttaagggtttacgaacgttaacgtaaccgtaaaacggtaccgttcggtacgggtactacggtacctaacccg

SEQ ID NO: 243361 - DNA, 734 bp, Homo sapiens
  misc_feature: GYAE6OF02IH37E.10.25.C03.1.454.CMB.1.raw
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgccgtctccgagggaccaaacgacgcccaccccgtcctcccgtgaccgttcggggccctacggtaccggtagtcgggtttcgggaccgtacggcccgtccgttacggccggttcggtaacccgtaagaaccgaaaaaacccgttcggaccctaagcccccgtccccgtaggtccctcccgttccgtcttaacggtggtcgcctactaccacgtaacgggcctacgtacggtactccgacggtcctagggttcgagtcggacgtaggttggggacgtgggaacgtaggttacgtacgtcgtccgtacgacctacgtactacgacgtacgtctcggtactacgttacgtacggtaacgttaagttttcgtacgtttaagttttacgttactagttacggtaacgtaagtacgttaggagttcggcgttacgtccgttaccgttaccttacgttttacggaccggtaacgggaaccgttacgtacggtaaccgtacgtaaccgtaacgtacggttacggtaccggtctcgtacgtaaccg

SEQ ID NO: 243362 - DNA, 665 bp, Homo sapiens
  misc_feature: GYAE6OF02JZ0W1.10.25.C03.1.454.CMB.1.raw
  modified_base (156)..(156): a, c, t, g, unknown or other
  misc_feature (156)..(156): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccnctggagaatcgtgatgacgcagtctccagccaccctgtctgcgtctccgagggcaaacgcgcccacctctccgtgcgtcgggccacggtccgagttggttgctacgccgtcgttacgccgtcggtaccacgaaccaaaaccgtggacccacgccctaccgacggtaccttccgtccgtcgtacgtcggtcgcactaccgacgtaacggcctacgtacggtactccgacgccgtaggttcgacggtcgcgtaggtcggtcgtacgggacgtaggtacgttcgtacctccgtacaccgtactcgacgtcgacgttcgtacgcgtagtcgtaggtaagtttacgtttagcgtttaacgtttacgttacgttaggtacgtaacggtattaggtcgtaggttcgtcgttacggtacccttaccgttaaccgttcgttacggacggtaacggtaacgtacgttacgaactacgtaacgtaacgtacgtaggtacggtaccgtacggaccttacgg

SEQ ID NO: 243363 - DNA, 706 bp, Homo sapiens
  misc_feature: GYAE6OF02IEUJE.10.25.C03.1.454.CMB.1.raw
  modified_base (219)..(219): a, c, t, g, unknown or other
  misc_feature (219)..(219): n is a, c, g, or t
  modified_base (555)..(555): a, c, t, g, unknown or other
  misc_feature (555)..(555): n is a, c, g, or t
tcagcatagtagtgcacgaccggtgctcgatttagtagtgtagatttgggtttggggagagctctggggaggaactgctcagttaggacccagacggaaccatggaagccccagcgcagcttctcttcctcctgctactcaggcctcccagaaaccactggaagaaatcgtgatcgagcagtctccagccacctgtctgcgtctccgagggacaaaccncgacctacccgtctccgtgccgtcggaccacggttccgaggttggttcggctacggccgtcttacgccgtacggtaccacgaacctaaaaccgtcggaccacgccctcccgagtcccgtcctacgtcgttagcggttacgctacgaccgtaacgaacgggcctacggtacgtacctccgacgtaccgtacggttacgacggtcggactacgggttcggtacggtcgggtaacgtacgggttacgttccgtacttccgtaccaaccgtctaccgacgtccgtagttcgtcgacgttagtacgtagttaagtttacgtttgtaacgtttaacgttttnttacgtagtacgtaaagggttattggtaagtcgtacgtacgtcgttcgttaaccgttagttacgttaccggtaaccgtaacgggtaccgttagtacggtaaccgttaacgtacggtaaacgttacgtcgggtaccgtcgtacgacttaccg

SEQ ID NO: 243364 - DNA, 422 bp, Homo sapiens
  misc_feature: GYAE6OF01EE89J.37.60.F05.1.454.CMB.1.raw
  modified_base (420)..(422): a, c, t, g, unknown or other
  misc_feature (420)..(422): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctgggggcacagcggccctggggctgcctggtcaaggactacttccatctacactactgagcgggctggcaaggcgcatagnnn

SEQ ID NO: 243365 - DNA, 420 bp, Homo sapiens
  misc_feature: GYAE6OF01APFQL.37.60.F05.1.454.CMB.1.raw
  modified_base (416)..(420): a, c, t, g, unknown or other
  misc_feature (416)..(420): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctggggcacagcggccctgggctgcctggtcaaggctacttccatctacactactgagcgggctggcaaggcgcatagnnnnn

SEQ ID NO: 243366 - DNA, 421 bp, Homo sapiens
  misc_feature: GYAE6OF01EKDRX.37.60.F05.1.454.CMB.1.raw
  modified_base (416)..(421): a, c, t, g, unknown or other
  misc_feature (416)..(421): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctggggcacagcggccctgggctgcctggtcaaggactacttccatcacactactgagcgggctggcaaggcgcatagnnnnnn

SEQ ID NO: 243367 - DNA, 421 bp, Homo sapiens
  misc_feature: GYAE6OF01C2CE0.37.60.F05.1.454.CMB.1.raw
  modified_base (419)..(421): a, c, t, g, unknown or other
  misc_feature (419)..(421): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctcccaagagcacctctgggggcacagcggccctgggctgcctggtcaaggactactccatctacactactgagcgggctggcaaggcgcatagnnn

SEQ ID NO: 243368 - DNA, 420 bp, Homo sapiens
  misc_feature: GYAE6OF01DQO61.37.60.F05.1.454.CMB.1.raw
  modified_base (417)..(420): a, c, t, g, unknown or other
  misc_feature (417)..(420): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccaggatccctggtcaccgtctcctcagcctccaccaagggcccatcggtcttccccctggccaccctcctccaagacgcacctctggggcacagcggcctgggctgcctggtcaaggactactccatctacactactgagcgggctggcaaggcgcatagnnnn

SEQ ID NO: 243369 - DNA, 418 bp, Homo sapiens
  misc_feature: GYAE6OF01ARJ9U.37.60.F05.1.454.CMB.1.raw
  modified_base (415)..(418): a, c, t, g, unknown or other
  misc_feature (415)..(418): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagtttacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtctcctcctggcaccctcctccaagagcacctctggggcacagcggccctgggctgcctggtcaaggctacttccatctacactactgagcgggctggcaaggcgcatagnnnn

SEQ ID NO: 243370 - DNA, 426 bp, Homo sapiens
  misc_feature: GYAE6OF01DQZ4Y.37.60.F05.1.454.CMB.1.raw
  modified_base (423)..(426): a, c, t, g, unknown or other
  misc_feature (423)..(426): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcaggggtcccgaacagtagttgttccagctgcgattgactactggggccacggatccctggtcaccgtctcctcagcctccaccaagggtccatcggtcttcccccctggcaccctcctcccaagagcacctctgggggcacagcggccctggggctgcctggtcaaggactacttccatctacactactgagcgggctggcaaggcgcatagnnnn

SEQ ID NO: 243371 - DNA, 432 bp, Homo sapiens
  misc_feature: GYAE6OF01DNVZV.37.60.F05.1.454.CMB.1.raw
  modified_base (222)..(222): a, c, t, g, unknown or other
  misc_feature (222)..(222): n is a, c, g, or t
  modified_base (425)..(432): a, c, t, g, unknown or other
  misc_feature (425)..(432): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaanagtagttgttccagctgcgattgactacgtggggccaggatccctggtcaccgtctcctcagcctccaccaacgggcccatcggtccttccccctggccaccctcctccaagagccacctcgtggggcacgagcggcccgtgggctgccgtggtcaaggactactccatctacactactgagcgggctggcaaggcgcatagnnnnnnnn

SEQ ID NO: 243372 - DNA, 424 bp, Homo sapiens
  misc_feature: GYAE6OF01DODZ6.37.60.F05.1.454.CMB.1.raw
  modified_base (419)..(424): a, c, t, g, unknown or other
  misc_feature (419)..(424): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctgggggcacagcggccctggggctgcctggtcaaggactactccatctacactactgagcgggctggcaaggcgcatagnnnnnn

SEQ ID NO: 243373 - DNA, 423 bp, Homo sapiens
  misc_feature: GYAE6OF01B2MU0.37.60.F05.1.454.CMB.1.raw
  modified_base (418)..(423): a, c, t, g, unknown or other
  misc_feature (418)..(423): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcaggggtcccgaacagtagttgttccagctgcgattgactactggggccacggatccctggtcaccgtctcctcagcctccaccaagggcccatcggtcttccccctggcaccctcctccaagagcacctctgggggcacagcggccctgggctgcctggtcaaggctacttccatctacactactgagcgggctggcaaggcgcatagnnnnnn

SEQ ID NO: 243374 - DNA, 427 bp, Homo sapiens
  misc_feature: GYAE6OF01CO5AD.37.60.F05.1.454.CMB.1.raw
  modified_base (424)..(427): a, c, t, g, unknown or other
  misc_feature (424)..(427): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggccccatcggtcttccccctggccgccctgcctccaggagcacctccgagagcacagcggccctgggctgcctggtcaaggactacttccatctacactactgagcgggctgggcaagggcgcatagnnnn

SEQ ID NO: 243375 - DNA, 453 bp, Homo sapiens
  misc_feature: GYAE6OF01DS4B6.37.60.F05.1.454.CMB.1.raw
  modified_base (344)..(344): a, c, t, g, unknown or other
  misc_feature (344)..(344): n is a, c, g, or t
  modified_base (430)..(430): a, c, t, g, unknown or other
  misc_feature (430)..(430): n is a, c, g, or t
  modified_base (432)..(453): a, c, t, g, unknown or other
  misc_feature (432)..(453): n is a, c, g, or t
tcagtagtgtagatcacgaccggtgctcgatttagtacgtcatcagggaagggcctggaaggtggattggatacgtcttattatagtggtagcacctactaccaacccgtccctcaagagtcgagttttcccatgtcagttgacacgtctaagaaccaaatcctccctacaggctgacctctgtgactgccgcggacacggtccgtctagttattgtgccagggtccccgaacagtagttgttccagctgcgattgactactggggccacggatccctggtcaccgtctcctcacgcctccaccaagggccatcggtcttccccctggcaccctcctccaacgngcacctctgggggcacagcggccctggctgcctggtcaaggactacttccatctacactactgagcgggctggcaaggcgcatagntnnnnnnnnnnnnnnnnnnnnnn

SEQ ID NO: 243376 - DNA, 422 bp, Homo sapiens
  misc_feature: GYAE6OF01DCQ6V.37.60.F05.1.454.CMB.1.raw
  modified_base (222)..(222): a, c, t, g, unknown or other
  misc_feature (222)..(222): n is a, c, g, or t
  modified_base (260)..(260): a, c, t, g, unknown or other
  misc_feature (260)..(260): n is a, c, g, or t
  modified_base (412)..(422): a, c, t, g, unknown or other
  misc_feature (412)..(422): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaanagtagttgtccagctgcgattgactactggggccaggntccctggtcaccgtctcctcagcctccaccaagggcccatcggtcttccccctggcaccctcctccaagagcacctctggggcacagcgcctggctgcctggtcaaggactcttccatctacactactgagcgggctggcaaggcgcatagnnnnnnnnnnn

SEQ ID NO: 243377 - DNA, 423 bp, Homo sapiens
  misc_feature: GYAE6OF01B6B0N.37.60.F05.1.454.CMB.1.raw
  modified_base (418)..(423): a, c, t, g, unknown or other
  misc_feature (418)..(423): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctgggggcacagcggcctgggctgcctggtcaaggactacttccatctacactactgagcgggctggcaaggcgcatagnnnnnn

SEQ ID NO: 243378 - DNA, 421 bp, Homo sapiens
  misc_feature: GYAE6OF01DTJ82.37.60.F05.1.454.CMB.1.raw
  modified_base (417)..(421): a, c, t, g, unknown or other
  misc_feature (417)..(421): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcaggggtcccgaacagtagttgttccagctgcgattgactactggggccacggatccctggtcaccgtctcctcagcctcaccaaggccatcggtcttccccctggcaccctcctccaagagcacctctgggggcacagcggccctgggctgcctggtcaaggactacttccatctacactactgagcgggctggcaaggcgcatagnnnnn

SEQ ID NO: 243379 - DNA, 433 bp, Homo sapiens
  misc_feature: GYAE6OF01ATRJP.37.60.F05.1.454.CMB.1.raw
  modified_base (420)..(433): a, c, t, g, unknown or other
  misc_feature (420)..(433): n is a, c, g, or t
tcagtagtgtagatcacgaccggtgctcgatttagtacgtcatcagggaaaggggcctggagtggattggatacgtctattatagtgggagcacctactacaaccccgtccctcaagagtcgagtttccatgtcagttgacacgtctaagaaccaaatctccctcaggctgacctctgtgactgccgcggacacggccgtctattatgtgcagggtcccgaacagtagttgttccagctgcgattgactactggggccacggatccctggtcaccgtctcctcacgcctccacctaagggcccatcggtcttccccctggcaccctcctccagtagcacctctggggcacagcggccctgggctgcctggtcaaggctactccatctacactactgagcgggtctggcaaggcgcatagnnnnnnnnnnnnnn

SEQ ID NO: 243380 - DNA, 423 bp, Homo sapiens
  misc_feature: GYAE6OF01D6RYG.37.60.F05.1.454.CMB.1.raw
  modified_base (330)..(330): a, c, t, g, unknown or other
  misc_feature (330)..(330): n is a, c, g, or t
  modified_base (416)..(423): a, c, t, g, unknown or other
  misc_feature (416)..(423): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtggggccacggatccctggtcaccgtctcctcagcctccaccaaggcccatcggtctcccctggcaccctcctccaagngcactcgtggggcacagcggccctggctgccgtggtcaaggactacttccatctacactactgagcgggctggcaaggcgcatagnnnnnnnn

SEQ ID NO: 243381 - DNA, 421 bp, Homo sapiens
  misc_feature: GYAE6OF01EGFYV.37.60.F05.1.454.CMB.1.raw
  modified_base (417)..(421): a, c, t, g, unknown or other
  misc_feature (417)..(421): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaaggcccatcggtcttccccctggcaccctcctccaagagcacctctggggcacagcggccctgggctgcctggtcaaggactacttccatctacactactgagcgggctggcaaggcgcatagnnnnn

SEQ ID NO: 243382 - DNA, 424 bp, Homo sapiens
  misc_feature: GYAE6OF01AS30Q.37.60.F05.1.454.CMB.1.raw
  modified_base (418)..(424): a, c, t, g, unknown or other
  misc_feature (418)..(424): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctgggggcacagcggccctgggctgcctggtcaaggactacttccatctacactactgagcgggctggcaggcgcatagnnnnnnn

SEQ ID NO: 243383 - DNA, 420 bp, Homo sapiens
  misc_feature: GYAE6OF01BBLT4.37.60.F05.1.454.CMB.1.raw
  modified_base (416)..(420): a, c, t, g, unknown or other
  misc_feature (416)..(420): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccaggatccctggtcaccgtctcctcagcctccaccaagggcccatcggtcttccccctggcaccctcctccaagagcacctctgggggcacagcggcctgggctgcctggtcaaggactacttccatctacactactgagcgggctggcaaggcgcatagnnnnn

SEQ ID NO: 243384 - DNA, 454 bp, Homo sapiens
  misc_feature: GYAE6OF01AYPMK.37.60.F05.1.454.CMB.1.raw
  modified_base (425)..(454): a, c, t, g, unknown or other
  misc_feature (425)..(454): n is a, c, g, or t
tcagtagtgtagatcacgaccggtgctcgatttagtacgtcatcagggaaagggggcctggagtggattggatacgtctattatagtgggagcacctactacaaccccgtcccgtcaagagtcgagtttcccatgtccagttgacacgtcgtaagaaccaaagtctcccgtcaggctgaccctctgtgactgccgcggacacggccgtcgtattattgtgcaggggtcccgaacagtagttgttccagctgcgattgactactggggccacgggatccctggtcaccgtctcctcagcctcaccaaggcccatcggtcttccccctggccacccctcctccaagagcacctctggggcacagcgcctgggctgctggtcaggactacgtccatctacactactgagcgggctggcagcgcatagnnnnnnnnnnnnnnnnnnnnnnnnnnnnnn

SEQ ID NO: 243385 - DNA, 423 bp, Homo sapiens
  misc_feature: GYAE6OF01DALC4.37.60.F05.1.454.CMB.1.raw
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
  modified_base (406)..(423): a, c, t, g, unknown or other
  misc_feature (406)..(423): n is a, c, g, or t
tcagtagtgtagatcacgaccggtgctcgatttagtacgtcatcagggaaagggccgtggagtggattggatacgtctattatagtgggagcacctactacaacccgtccctcaagagtcgagtttccatgtcagttgacacgtctaagaccaaatctccctcaggctgacctctgtgactgccgcggacacggccgtctattattgtgcagggtcccgaacagtagttgttccagctgcgattgactatggggccacggatccaatggtcaccgtctcctcagcctcaccaaggcccatcggtctcccctggcacctcctccagncacctgnggggcacagcgcctggctgctggcaaggactactcatcacactactgagccgggctggcaaggcgacagtagnnnnnnnnnnnnnnnnnn

SEQ ID NO: 243386 - DNA, 438 bp, Homo sapiens
  misc_feature: GYAE6OF01EJGRC.37.60.F05.1.454.CMB.1.raw
  modified_base (339)..(339): a, c, t, g, unknown or other
  misc_feature (339)..(339): n is a, c, g, or t
  modified_base (421)..(438): a, c, t, g, unknown or other
  misc_feature (421)..(438): n is a, c, g, or t
tcagtagtgtagatcacgaccggtgctcgattttagtacgtcatcagggaaaggggccgtggagtggattggatacgtctattatagtgggagcacctactacaacccgtccctcaagagtcgagttttcccatgtcagttgacacgtctaagaaccaaatctccctcaggctgacctctgtgactgccgcggacacggccgtctattattgtgcagggtcccaacagtagttgttccagctgcgattgactacgtggggaccacggatccatggtcaccgtctcctcagcctccaccaaggcccatcggtcttccccgtggccaccctcctccaagcncacctctggggcacagcgcctggctgcctggcaggactacgtcatctacactactgacgcggactggacaaggcgcagtagnnnnnnnnnnnnnnnnnn

SEQ ID NO: 243387 - DNA, 460 bp, Homo sapiens
  misc_feature: GYAE6OF01DIJUN.37.60.F05.1.454.CMB.1.raw
  modified_base (225)..(225): a, c, t, g, unknown or other
  misc_feature (225)..(225): n is a, c, g, or t
  modified_base (416)..(416): a, c, t, g, unknown or other
  misc_feature (416)..(416): n is a, c, g, or t
  modified_base (421)..(442): a, c, t, g, unknown or other
  misc_feature (421)..(442): n is a, c, g, or t
  modified_base (444)..(445): a, c, t, g, unknown or other
  misc_feature (444)..(445): n is a, c, g, or t
  modified_base (447)..(460): a, c, t, g, unknown or other
  misc_feature (447)..(460): n is a, c, g, or t
tcagtagtgtagatcacgaccggtgctcgatttagtacgtcatcagggaaagggcctggagtggattggatacgtctattatagtgggagcacctactacaacccgtccctcaaggagtcgagtttccatgtcagttgacacgtctaagaaccaaatctccctcaggctgacctctgtgactgccgcggacacggccgtctattattgtgcgaggggtcccgaanagtagttgttccagctgcgattgactacgtggggccacggatccctggtcaccggctcctcagcctccaccaagggcccatcggtctccccctaggcaccctcctccagacgcaactctggggcacagcgcctgggctgcctggcaaggctactcatctacactactgagcggctggcaaggcgcagtagnatgannnnnnnnnnnnnnnnnnnnnncnngnnnnnnnnnnnnnn

SEQ ID NO: 243388 - DNA, 424 bp, Homo sapiens
  misc_feature: GYAE6OF01DSG0C.37.60.F05.1.454.CMB.1.raw
  modified_base (420)..(424): a, c, t, g, unknown or other
  misc_feature (420)..(424): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtggggccacggatccctggtcaccgtctcctcagcctccaccaaggccatcggtcttccccctggccaccctcctccaagacgcacctcgtgggggcacagccggcctggctgcctggtcaaggactacttccatctacactactgagcgggctggcaaggcgcatagnnnnn

SEQ ID NO: 243389 - DNA, 441 bp, Homo sapiens
  misc_feature: GYAE6OF01DR6G1.37.60.F05.1.454.CMB.1.raw
  modified_base (434)..(441): a, c, t, g, unknown or other
  misc_feature (434)..(441): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtggggccacggactccctggtccaccgtctcctcagccctccaccaacgggcccatccggtccttccccctggccacccctcctcccaacgacgccacctcgtggggcacgagcggccctgggctgcctggtcaaggactactccatctacactactgagcgggctggacaagggcgcatagnnnnnnnn

SEQ ID NO: 243390 - DNA, 533 bp, Homo sapiens
  misc_feature: GYAE6OF01CLAIK.37.60.F05.1.454.CMB.1.raw
  modified_base (426)..(427): a, c, t, g, unknown or other
  misc_feature (426)..(427): n is a, c, g, or t
  modified_base (430)..(432): a, c, t, g, unknown or other
  misc_feature (430)..(432): n is a, c, g, or t
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
  modified_base (467)..(467): a, c, t, g, unknown or other
  misc_feature (467)..(467): n is a, c, g, or t
  modified_base (476)..(476): a, c, t, g, unknown or other
  misc_feature (476)..(476): n is a, c, g, or t
  modified_base (495)..(495): a, c, t, g, unknown or other
  misc_feature (495)..(495): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaccaaatctcctcaggctgacctctgtgactgcctcggacacggccgtctattattgtgcagggtcccgaacagtagttgtccagctgcgattggactactggggccacggatcctggtcaccgtctcctcagcctccaccaagggcccatcggtcttccccctggccaccctcctcccaacgacgcaacctctcgggggtcacgagcggccctcgggctcgcctggtcaaggctactcatctacactactgacgtcgggctggcaacggcgcatagnngannnacncatcatcgatcgntacgcatctgcncgtacgncgtcgtacnccgtagtcctgacgttacncgtttaacgcgtaacgtaccgtgttacggctcgtccgg

SEQ ID NO: 243391 - DNA, 419 bp, Homo sapiens
  misc_feature: GYAE6OF01CJLV0.37.60.F05.1.454.CMB.1.raw
  modified_base (223)..(223): a, c, t, g, unknown or other
  misc_feature (223)..(223): n is a, c, g, or t
  modified_base (417)..(419): a, c, t, g, unknown or other
  misc_feature (417)..(419): n is a, c, g, or t
tcagtagtgtagatcacgaccggtgctcgatttagtacgtcatcagggaaagggcctggagtggattggatacgtctattatagtgggagcacctactacaaccccgtccctcaagagtcgagtttccatgtcagttgacacgtctaagaaccaaatctccctcaggctgacctctgtgactgccgcggacacggccgtctattattgtgcagggtcccgaanagtagttgttccagctgcgattgactactggggccacggatccctggtcaccgtctcctcagcctccaccaagggcccatcggtcttccccctggcaccctcctccaagagcacctctggggcacagcggcctgggctgcctggtcaaggactacttccatctacactactgagcggctggcaaggcgcatagnnn

SEQ ID NO: 243392 - DNA, 431 bp, Homo sapiens
  misc_feature: GYAE6OF01DE7W8.37.60.F05.1.454.CMB.1.raw
  modified_base (417)..(417): a, c, t, g, unknown or other
  misc_feature (417)..(417): n is a, c, g, or t
  modified_base (423)..(431): a, c, t, g, unknown or other
  misc_feature (423)..(431): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcgagggtcccgaacagtagttgtccagctgcgattgactacgtggggcccacggatccctggtcaccgtctcctcagcctccaccaacggccatcggtcttccccctggccaccctcctccaagagccacctcgtcggggcacagccggcctgggctgcctggtcaaggactactccatctacactacgtgagcgggctggcaaggcncatagnnnnnnnnn

SEQ ID NO: 243393 - DNA, 480 bp, Homo sapiens
  misc_feature: GYAE6OF01BW88S.37.60.F05.1.454.CMB.1.raw
  modified_base (225)..(225): a, c, t, g, unknown or other
  misc_feature (225)..(225): n is a, c, g, or t
  modified_base (311)..(311): a, c, t, g, unknown or other
  misc_feature (311)..(311): n is a, c, g, or t
  modified_base (425)..(425): a, c, t, g, unknown or other
  misc_feature (425)..(425): n is a, c, g, or t
  modified_base (444)..(447): a, c, t, g, unknown or other
  misc_feature (444)..(447): n is a, c, g, or t
  modified_base (449)..(450): a, c, t, g, unknown or other
  misc_feature (449)..(450): n is a, c, g, or t
  modified_base (452)..(452): a, c, t, g, unknown or other
  misc_feature (452)..(452): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (459)..(462): a, c, t, g, unknown or other
  misc_feature (459)..(462): n is a, c, g, or t
  modified_base (464)..(464): a, c, t, g, unknown or other
  misc_feature (464)..(464): n is a, c, g, or t
  modified_base (466)..(471): a, c, t, g, unknown or other
  misc_feature (466)..(471): n is a, c, g, or t
  modified_base (473)..(475): a, c, t, g, unknown or other
  misc_feature (473)..(475): n is a, c, g, or t
  modified_base (477)..(478): a, c, t, g, unknown or other
  misc_feature (477)..(478): n is a, c, g, or t
  modified_base (480)..(480): a, c, t, g, unknown or other
  misc_feature (480)..(480): n is a, c, g, or t
tcagtagtgtagatcacgaccggtgctcgatttagtacgtcatcagggaaagggccgtggagtggattggatacgtctattatagtgggagcacctactacaacccgtccctcaagagtcgagttttccatgtcagttgacacgtctaagaccaaatctccctcaggctgacctctgtgactgcccgcggacacggccgtctattattgtgcagggtcccgaacngtagttgttccagctgcgattgactactggggccaggatccatggtcaccgtctcctcagcctccaccaggcccatcgtctccccnggcacctcctcaagcgcacctcgtggggcacgacggcggcccgtgggctcgccgtggtcaacggctacttccatctacactactgacgcggctcggcaaggcgacacgtagagnagctgcgtatcatgcagtnnnntnngngcngngnnnngngnnnnnncnnncnngn

SEQ ID NO: 243394 - DNA, 469 bp, Homo sapiens
  misc_feature: GYAE6OF01A8PLH.37.60.F05.1.454.CMB.1.raw
  modified_base (223)..(223): a, c, t, g, unknown or other
  misc_feature (223)..(223): n is a, c, g, or t
  modified_base (353)..(353): a, c, t, g, unknown or other
  misc_feature (353)..(353): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
  modified_base (428)..(428): a, c, t, g, unknown or other
  misc_feature (428)..(428): n is a, c, g, or t
  modified_base (434)..(469): a, c, t, g, unknown or other
  misc_feature (434)..(469): n is a, c, g, or t
tcagtagtgtagatcacgaccggtgctcgatttagtacgtcatcagggaaagggccgtggagtggattggatacgtctattatagtgggagcacctactacaacccgtcctcaagagtcgagtttccatgtcagttgacacgtctaagaccaaatctcctcaggctgacctctgtgactgccgcggacacgggccgtctattattgtgcgagggtcccgaacngtagttgttccagctgcgattggactacgtggggccaggatccattggtcacgtctcctcagcctccacacgggcccagtccggcttccccgtggccaccctccgtcaagacgcacctgtcggggcaacngccgccgtggcagcctggtcaacggtctacgttccatcgtacnctatgaacncgggactgaccagcgcaagtgcngatcgnnnnnnnnnnnnnnnnnnnnnnnnnnnnnnnnnnnn

SEQ ID NO: 243395 - DNA, 436 bp, Homo sapiens
  misc_feature: GYAE6OF01ER4QJ.37.60.F05.1.454.CMB.1.raw
  modified_base (427)..(436): a, c, t, g, unknown or other
  misc_feature (427)..(436): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtggggccacggatccctggtcaccgtctcctcagcctccaccaagggcccatcggtcttccccctggccaccctcctccaagacgcacctcgtgggggcacacgcggccctggggctgcctggtcaaggactacttccatcctacactactgagcggggctggcaaggcgacatagnnnnnnnnnn

SEQ ID NO: 243396 - DNA, 548 bp, Homo sapiens
  misc_feature: GYAE6OF01EXDEQ.37.60.F05.1.454.CMB.1.raw
  modified_base (257)..(257): a, c, t, g, unknown or other
  misc_feature (257)..(257): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
  modified_base (516)..(529): a, c, t, g, unknown or other
  misc_feature (516)..(529): n is a, c, g, or t
  modified_base (531)..(540): a, c, t, g, unknown or other
  misc_feature (531)..(540): n is a, c, g, or t
  modified_base (542)..(548): a, c, t, g, unknown or other
  misc_feature (542)..(548): n is a, c, g, or t
tcagtagtgtagatcacgaccggtgctcgatttagtacgtcatcagggaaagggcctggagtggattggatacgtctattatagtgggagcacctactacaacccgtccctcaagagtcgagttttcccatgtcagttgacacgtctaagaccaaatctccctcaggctgacctctgtgactgcccgcggacacggccgtctattagttgtgcagggtcccgaacagtagttgttccagctgccgtattgactacgngggccacggatccagtggtcaccgtctcctcgacgcctccaccgaacgggcccagttccggtccttcccccgtggccctacccctcccttacccgaacgtacgcctacctcggtcggggcacgacgccggccgtcggcgtcggccgtcggttacgaacggtactaccgttacctactaccgtaaccacttaccgtcggaacggccgggaccgttacggcgaaacgggccgaacgtaacttaggctagngcngcancgtnnnnnnnnnnnnnngnnnnnnnnnncnnnnnnn

SEQ ID NO: 243397 - DNA, 486 bp, Homo sapiens
  misc_feature: GYAE6OF01AVFBI.37.60.F05.1.454.CMB.1.raw
  modified_base (225)..(225): a, c, t, g, unknown or other
  misc_feature (225)..(225): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (449)..(449): a, c, t, g, unknown or other
  misc_feature (449)..(449): n is a, c, g, or t
  modified_base (452)..(486): a, c, t, g, unknown or other
  misc_feature (452)..(486): n is a, c, g, or t
tcagtagtgtagatcacgaccggtgctcgatttagtacgtcatcagggaaaggggccgtgggagtggattgggatacgtctattatagtgggagcacctactacaacccgtccctcaagagtcgagtttcccatgtcagttgacacgtctaagaaccaaatctccctcaggctgacctctgtgactgccgcggacacggccgtctattatgtgcagggtcccaangtagttgttccagctgcgtattgacttacgtgggggaccacggtatccatggtcaccgtctcctcgacgcctccaccgaacgggcccactcgggtcctacccccgtggcctaccctcctccaagacggcacctcgtcgggggcacgacggcggccctggcgtgccgtggtcaagggactaccgttcntcctacnctacgtgagcggctggcaggcaccagtagntcnnnnnnnnnnnnnnnnnnnnnnnnnnnnnnnnnnn

SEQ ID NO: 243398 - DNA, 614 bp, Homo sapiens
  misc_feature: GYAE6OF01AEJPL.37.60.F05.1.454.CMB.1.raw
  modified_base (589)..(614): a, c, t, g, unknown or other
  misc_feature (589)..(614): n is a, c, g, or t
tcagtagtgtagatcacgaccggtgctcgatttagtacgtcatcagggaaagggcctggagtggattggatacgtctattatagtggggagcacctactacaaccccgtccctcaagagtcgtacgtttccatgtcagttgacacgtactaaagaaaccaaatcctccctcaggctcgacctctgtgactcgccgcggacgaccggccgtcttattattgtgacgacggggtacccgaacgtaggttagtttcgttaccgagtcgtgcgtattcgactacggtcggggcccacggacttcccgtcggtccaccgtcctcctcacgtccctccaaccgaacggccctacgtccggtcccttcccccgtcggcccctacccctccctacccgaacggaccgcctacccgtcgggtcgggggaccaccgaccgggcccgggtcccgtcggggccgttccggcccgttacggggtaccgaaaacgggtacccttacccgtttaccctaacttacccttaaaccctaaccgttaaccgtcgggaacggggtccggggtcggtacgggaccgtaacgggccgaccgtaagtacgnnnnnnnnnnnnnnnnnnnnnnnnnn

SEQ ID NO: 243399 - DNA, 494 bp, Homo sapiens
  misc_feature: GYAE6OF01C75U4.37.60.F05.1.454.CMB.1.raw
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
  modified_base (410)..(410): a, c, t, g, unknown or other
  misc_feature (410)..(410): n is a, c, g, or t
  modified_base (457)..(494): a, c, t, g, unknown or other
  misc_feature (457)..(494): n is a, c, g, or t
tcagtagtgtagatcacgaccggtgctcgattttagtacgtcatcagggaaaggggccgtggagtggattggatacgtctattatagtgggagcacctactacaacccgtccctcaagagtcgagtttccatgtcagttgacacgtctaagaaccaaatctcctcaggctgacctctgtgactgccgnggactacggctctattattgngcagggtccaangtagttgtcagctgcgattgacttangggccaggntccatggtcacgctcctnacgcnccacaacgggccccagcggtccttccccncggacaccctcctccaagacgcaccttcgcggggcacgacgcgcccgttagggctgcccgtgggtacaaggctactttccaatccgtttaacaacctttacnggaacggccggtacgcgggacttaaacggcggacctaagttaagcannnnnnnnnnnnnnnnnnnnnnnnnnnnnnnnnnnnnn

SEQ ID NO: 243400 - DNA, 431 bp, Homo sapiens
  misc_feature: GYAE6OF01BH1BY.37.60.F05.1.454.CMB.1.raw
  modified_base (427)..(431): a, c, t, g, unknown or other
  misc_feature (427)..(431): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttcccccctggccaccctccctcccaagacgcaccctctcgggggcacagcggccctggggctgcctggtcaaggactacttccatctacactactgagcgggctggcaaggcgcatacgnnnnn

SEQ ID NO: 243401 - DNA, 541 bp, Homo sapiens
  misc_feature: GYAE6OF01A26ZH.37.60.F05.1.454.CMB.1.raw
  modified_base (489)..(489): a, c, t, g, unknown or other
  misc_feature (489)..(489): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (507)..(508): a, c, t, g, unknown or other
  misc_feature (507)..(508): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (519)..(520): a, c, t, g, unknown or other
  misc_feature (519)..(520): n is a, c, g, or t
  modified_base (522)..(524): a, c, t, g, unknown or other
  misc_feature (522)..(524): n is a, c, g, or t
  modified_base (526)..(531): a, c, t, g, unknown or other
  misc_feature (526)..(531): n is a, c, g, or t
  modified_base (534)..(536): a, c, t, g, unknown or other
  misc_feature (534)..(536): n is a, c, g, or t
  modified_base (538)..(538): a, c, t, g, unknown or other
  misc_feature (538)..(538): n is a, c, g, or t
  modified_base (540)..(541): a, c, t, g, unknown or other
  misc_feature (540)..(541): n is a, c, g, or t
tcagtagtgtagatcacgaccggtgctcgatttagtacgtcatcagggaaaggggccgtggagtggattggatacgtctattatagtgggagcacctactacaacccgtccctcaagagtcgagtttccatgtcagttgacacgtctaagaccaaatctccctcaggctgacctctgtcgactgccgcggacacggccgtctattattgtgcagggtcccaacagtagttgtccagcctgcgattgactacgtggggccaggatccatcggtctaccgtctcctcacgcctaccaccgaacggcccatccggtcctccccgtggccaccctcctccgaagcgcaccgtcgtcggggcacgacggccggcccgtaggcctacggccgttacggtccaaacgggtacctaccgttcctaacgttacctaacgtacctacgtacggacggtaccggtcgtacggaccgaagggcctaccgaagtacgcagtncgacatcatgctancnannctgncntngtnngnnngnnnnnntcnnncngnn

SEQ ID NO: 243402 - DNA, 670 bp, Homo sapiens
  misc_feature: GYAE6OF01EYSWM.37.60.F05.1.454.CMB.1.raw
  modified_base (161)..(161): a, c, t, g, unknown or other
  misc_feature (161)..(161): n is a, c, g, or t
  modified_base (579)..(579): a, c, t, g, unknown or other
  misc_feature (579)..(579): n is a, c, g, or t
  modified_base (586)..(586): a, c, t, g, unknown or other
  misc_feature (586)..(586): n is a, c, g, or t
  modified_base (596)..(597): a, c, t, g, unknown or other
  misc_feature (596)..(597): n is a, c, g, or t
  modified_base (599)..(600): a, c, t, g, unknown or other
  misc_feature (599)..(600): n is a, c, g, or t
  modified_base (605)..(605): a, c, t, g, unknown or other
  misc_feature (605)..(605): n is a, c, g, or t
  modified_base (609)..(609): a, c, t, g, unknown or other
  misc_feature (609)..(609): n is a, c, g, or t
  modified_base (644)..(644): a, c, t, g, unknown or other
  misc_feature (644)..(644): n is a, c, g, or t
  modified_base (648)..(648): a, c, t, g, unknown or other
  misc_feature (648)..(648): n is a, c, g, or t
tcagtagtgtagatcacgaccggtgctcgatttagtacgtcatcagggaaagggccgtggagtggattggatacgtctattatagtgggagcacctactacaacccgtccctcaagagtcgagtttccatgtcagttgacacgtctaagaccaatctcctnaggctgacctctgtgactcgccgtacggacacggtccgtctagttattggtgccgtaggggtcccgaaactaggttacgtttcgttacccgagtcctggacgtatttcgaaccttacgtggggaccctacggtatacccgtaatcggtaccaccggtctcctacgacgtccctaccaccgaacgggcccctaacgtccggttccttcccccgtcgggtaccctaacccctccgttacccaaggaccgtaccgtaccctacggtcgggggacctaacgacgggtcccgtccggttacggcttcggaccgtcgggtaccgtaaacgggtacctaccggttacctacgttactacccgtaacttacgtacggaccggtacgggtaccgttagggaccaacgggtacgacggtaactacggntaggctntacctggacnncnncgagnactnagtactgactgacagacctgagtgagactagcgtnacgntacgactctactcgtcgtcgcg

SEQ ID NO: 243403 - DNA, 712 bp, Homo sapiens
  misc_feature: GYAE6OF01EAAER.37.60.F05.1.454.CMB.1.raw
  modified_base (644)..(644): a, c, t, g, unknown or other
  misc_feature (644)..(644): n is a, c, g, or t
  modified_base (652)..(652): a, c, t, g, unknown or other
  misc_feature (652)..(652): n is a, c, g, or t
  modified_base (663)..(663): a, c, t, g, unknown or other
  misc_feature (663)..(663): n is a, c, g, or t
  modified_base (667)..(667): a, c, t, g, unknown or other
  misc_feature (667)..(667): n is a, c, g, or t
  modified_base (669)..(669): a, c, t, g, unknown or other
  misc_feature (669)..(669): n is a, c, g, or t
  modified_base (674)..(674): a, c, t, g, unknown or other
  misc_feature (674)..(674): n is a, c, g, or t
  modified_base (680)..(680): a, c, t, g, unknown or other
  misc_feature (680)..(680): n is a, c, g, or t
  modified_base (685)..(685): a, c, t, g, unknown or other
  misc_feature (685)..(685): n is a, c, g, or t
  modified_base (690)..(690): a, c, t, g, unknown or other
  misc_feature (690)..(690): n is a, c, g, or t
  modified_base (698)..(698): a, c, t, g, unknown or other
  misc_feature (698)..(698): n is a, c, g, or t
tcagtagtgtagatcacgaccggtgctcgatttagtacgtcatcagggaaaggggccgtggagtggattggatacgtctattatagtgggagcacctactacaacccgtcctcaagagtcgacgtttccatgtcagttgacacgtctaacgaaccaaatctcctcaggctcgacctctgtcgactcgccgcggacacggccgtcgtattattcggtcgccgtacgggtacccgaactaggttacgttcgttccaagctcggacgtacttacgactacgtcggggaccacggtactccacgtcggtacctaccggttctcctacgaaccgtcccgtacccgtaacccgaacggggtacccctaacgttcccgggttacccttcccccggtacggtacccgtaccccttccgtaacccgaacgacggcccgttaaccgtccgggttacggggacctaacggaccggtccgggtacccggtgggtcctcggtccggttacggtacccggtaaacgggttaccttaccttaaccgtacgttaccttaaaccgtacgttaaccgtacggaaccgggtcgggtaccgttacgggaaccgtacgggtacgtaccgtaagtacgtagtactactagctagtctatgtactgntaagctancgtatcgattncgtnancagtnaggtcncggtntacgnttgaactntcgatcgatccgtg

SEQ ID NO: 243404 - DNA, 560 bp, Homo sapiens
  misc_feature: GYAE6OF01C6OV1.37.60.F05.1.454.CMB.1.raw
  modified_base (163)..(163): a, c, t, g, unknown or other
  misc_feature (163)..(163): n is a, c, g, or t
  modified_base (256)..(256): a, c, t, g, unknown or other
  misc_feature (256)..(256): n is a, c, g, or t
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (450)..(450): a, c, t, g, unknown or other
  misc_feature (450)..(450): n is a, c, g, or t
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
  modified_base (519)..(520): a, c, t, g, unknown or other
  misc_feature (519)..(520): n is a, c, g, or t
  modified_base (523)..(523): a, c, t, g, unknown or other
  misc_feature (523)..(523): n is a, c, g, or t
  modified_base (526)..(527): a, c, t, g, unknown or other
  misc_feature (526)..(527): n is a, c, g, or t
  modified_base (531)..(534): a, c, t, g, unknown or other
  misc_feature (531)..(534): n is a, c, g, or t
  modified_base (536)..(540): a, c, t, g, unknown or other
  misc_feature (536)..(540): n is a, c, g, or t
  modified_base (542)..(542): a, c, t, g, unknown or other
  misc_feature (542)..(542): n is a, c, g, or t
  modified_base (544)..(549): a, c, t, g, unknown or other
  misc_feature (544)..(549): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (555)..(556): a, c, t, g, unknown or other
  misc_feature (555)..(556): n is a, c, g, or t
  modified_base (558)..(560): a, c, t, g, unknown or other
  misc_feature (558)..(560): n is a, c, g, or t
tcagtagtgtagatcacgaccggtgctcgatttagtacgtcatcagggaaaggggccgtggagtggattggatacgtctattatagtgggagcacctactacaacccgtcctcaagagtcgagtttccatgtcagttgacacgtctaagaccaaatctccctnaggctgacctctgtcgactcgccgcggacacggccgtctattatgtcgacgacgggtcccaactgtagttcgtccagctgctattgactacgngggccaggcttcacgttaggtccaaccgtctccgtagcgcctaccgaacaacggcctaggtccggtcccttaccccgggccctacccgtntacccgaaggcncctaaccgttggccggggacacgacggccggtcccgtagggtctacggccctaggttaccgaaaggttacctacgtttccaacttcctaacncgtaaacctggaaccggtcgggcaggaccgaagggtccctagaatcggatgagctagccttnaccgntnntancgnnatcnnnngnnnnngngnnnnnncncncnncnnn

SEQ ID NO: 243405 - DNA, 842 bp, Homo sapiens
  misc_feature: GYAE6OF01CZRTR.37.60.F05.1.454.CMB.1.raw
tcagtagtgtagatcacgaccggtgctcgatttagtacgtcatcagggaaagggccgtggagtggattggatacgtctattatagtgggagcacctactacaacccgtcctcaagagtcgagtttccatgtcagttgacacgtctaagaccaaatctccctcaggctgacctctgtcgctgccgcggacacggccgttctaattgtgtcgcgacggggtacccaatagtacgttcgtccagcctgacgtattcgactacgtcggggacctacggattaccgaagttcggtacctaaccggtcttcccttacgaacggtccctaccgaacccaaacggggaccccctaaggtcccgggttaaccttttacccccccgttgggaccccgtaacccccgttccccttaaccccgtaaaggtaccggaccctaaaccccgttaccggttcgggggacccgtaacgtaaacccgggcgggttacccccggttaggggtacccgttacgggtccccgttacggggttacccgaaaaaacggggtccctttaaaccggtttaccccaacggtttaacccgttaaccgtaaacctttaaaccccgtagggtaaccggccggggttacctaccgggtaaccgaaaccggggggttgtaaaccccaaaacggtttaacggacccgggacgttaacgtacgtacgtaacgtacgtaacgtacgtacgtacgtacgtacgtacgtacgtacgtacgtacgtacgtacgtacgtacgtacgtaacgtacgtacgtacgtacgtacgtacgtacgtacgtacgtacgtaccgacgttacgtacgtcgtccgtaccg

SEQ ID NO: 243406 - DNA, 856 bp, Homo sapiens
  misc_feature: GYAE6OF01EBTPH.37.60.F05.1.454.CMB.1.raw
  modified_base (754)..(754): a, c, t, g, unknown or other
  misc_feature (754)..(754): n is a, c, g, or t
tcagtagtgtagatcacgaccggtgctcgatttagtacgtcatcagggtaaagggtccgtggagtggattgggatacgtctattatagtgggagcaccgtacctacaacccgtcctcaacgaggtcgagtttccatgtcagttgacgacgtctaagaccaaatctcctcaggctgacctcgtagtgacctcgccgtcggacctacgggccgtctaattagttggtacgctacggggtcccgaacaggttagtttcggttaccaggtccgtgaccgtagttacgaacttacggtcggggaccctaacgggtacttcccgttagggttaccaaacccggttccttacccgtacgtaaccgggtccccttacccgaaacccgaaaccggggtaccccctaaagttccccggggtttaccctttacccccccggttcgggtaccctaacccccgtttcccgttacccgaaaggtacgtacccgtaaacccggtttccgggttcgggggacctaaccggtaacgggtcccgggtacccccggtttgggggaccttacgggtaccccgtttgggtaccggtaaaggggtaaccctttaacccgtttacctaacgttacccttaacctaaccgttaacccgtggttaaccgggccggggtaccttagggaccccgaaagggggtcctaccgtaagtttaacggtactacgtacttacgtgtaccttagtacattactaggtcctaggtacacgttaacggntaacgtaacctaaggaccttaggacgttcgagtacgaaccgttgacggtctaacctgttaacccggtcgtaccgttaccgtacgaccttcgcgttagtaccg

SEQ ID NO: 243407 - DNA, 473 bp, Homo sapiens
  misc_feature: GYAE6OF01CXFQO.37.60.F05.1.454.CMB.1.raw
  modified_base (442)..(473): a, c, t, g, unknown or other
  misc_feature (442)..(473): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattagttgtggcagggtcccgaacgaggtagttgttccagctgcgattgactacgtggggccacggatccctggtcaccgtctcctcagcctccaccaacgggcccactccggtcttcccccgtggccaccctcctccaagacgcacctctgggggcacgaggcggccctggggctcgcctggtcaaggtactacttcactcgtacactactgacggcgggctaggcaaggccgacatagcnnnnnnnnnnnnnnnnnnnnnnnnnnnnnnnn

SEQ ID NO: 243408 - DNA, 611 bp, Homo sapiens
  misc_feature: GYAE6OF01BC0Q5.37.60.F05.1.454.CMB.1.raw
  modified_base (179)..(179): a, c, t, g, unknown or other
  misc_feature (179)..(179): n is a, c, g, or t
  modified_base (226)..(226): a, c, t, g, unknown or other
  misc_feature (226)..(226): n is a, c, g, or t
  modified_base (513)..(513): a, c, t, g, unknown or other
  misc_feature (513)..(513): n is a, c, g, or t
  modified_base (525)..(525): a, c, t, g, unknown or other
  misc_feature (525)..(525): n is a, c, g, or t
  modified_base (532)..(532): a, c, t, g, unknown or other
  misc_feature (532)..(532): n is a, c, g, or t
tcagtagtgtagatcacgaccggtgctcgatttagtacgtcatcagggaaagggccgtggagtggattggatacgtctattatagtgggagcacctactacaacccgtccctcaagagtcgagtttccatgtcagttgacacgtctaagaaccaaatctccctcaggctgacctctgtnactgccgcgacaccggccgtctattagttgtgcgagggtcccgaacngtagttgtccagctgcgattcgactagtcgggccacggatccatggtcctaccgtctcctcgacgcctccaccgaacgggtccccagtccggtccttccccgtgggcctaccccgtcctaccgaaaggacgcctaaccgtcgtcggggctacgacggtccggtcccgtggaccgttcgccgtcggtacgaaacggtaccgttactaccgtataccctactacgtacgtcggaacgtcgggtactggacgtaaccggcgacctaagtacggatcgactgtctacgtancgtactagcacncgtacgntacgtcgtactcgacgtactacgctacgacgtagtcgtcgacgtacgcacgtcgacgtacgtacgtatcgtcgtcgtcg

SEQ ID NO: 243409 - DNA, 437 bp, Homo sapiens
  misc_feature: GYAE6OF01DACDS.37.60.F05.1.454.CMB.1.raw
  modified_base (420)..(437): a, c, t, g, unknown or other
  misc_feature (420)..(437): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaaagaaccaaatctccctcaggctgacctctgtgactgcccgcggacacggccgtctattattgtgcagggtcccgaacagtagttgttccagctgcgattgactacgtggggccacggatccctggtcaccgtctcctcagcctccaccaagggcccatcggtcttcccccctggcaccctcctccaagagcacctctgggggcacagcggccctggctgcctggtcaaggactactcatctacactactgagcgggctggcaaggcgcatagnnnnnnnnnnnnnnnnnn

SEQ ID NO: 243410 - DNA, 482 bp, Homo sapiens
  misc_feature: GYAE6OF01D0HQO.37.60.F05.1.454.CMB.1.raw
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
  modified_base (439)..(439): a, c, t, g, unknown or other
  misc_feature (439)..(439): n is a, c, g, or t
  modified_base (444)..(445): a, c, t, g, unknown or other
  misc_feature (444)..(445): n is a, c, g, or t
  modified_base (447)..(467): a, c, t, g, unknown or other
  misc_feature (447)..(467): n is a, c, g, or t
  modified_base (469)..(482): a, c, t, g, unknown or other
  misc_feature (469)..(482): n is a, c, g, or t
tcagtagtgtagatcacgaccggtgctcgatttagtacgtcatcagggaaagggcctggagtggattggatacgtctattatagtgggagcacctactacaaccccgtccctcaagagtcgagtttcccatgtcagttgacacgtctaagaccaaatctccctcaggctgacctctgtgactgcccgcggacacggccgtctattatgtgccgagggtcccgaacagtagtttgttcccagcctgcgtatgactagtggggccaggatccgatggtccaccgtcctcctcagcctaccaccaggccccagtcggtcttcccccgnggcnccctcgtccaagnccacctgtggggcacgagccgccctgggctcgcgtgtacgaaggtctctccatctacactctagagcgggtactggaccgaaggtcgacagtaagcngtagnncnnnnnnnnnnnnnnnnnnnnngnnnnnnnnnnnnnn

SEQ ID NO: 243411 - DNA, 444 bp, Homo sapiens
  misc_feature: GYAE6OF01DV3V5.37.60.F05.1.454.CMB.1.raw
  modified_base (434)..(444): a, c, t, g, unknown or other
  misc_feature (434)..(444): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtggggccacggatccctggtcaccgtctcctcacgcctccaccaacgggccatccggtccttccccctggccacccctcctccaagacgccacctcgtcgggggcacgacgccggcccgtgggctcgcctggtcaaggactactccatctacactactgagcgggctggacaaggcacatagnnnnnnnnnnn

SEQ ID NO: 243412 - DNA, 567 bp, Homo sapiens
  misc_feature: GYAE6OF01AN99L.37.60.F05.1.454.CMB.1.raw
  modified_base (525)..(525): a, c, t, g, unknown or other
  misc_feature (525)..(525): n is a, c, g, or t
  modified_base (529)..(567): a, c, t, g, unknown or other
  misc_feature (529)..(567): n is a, c, g, or t
tcagtagtgtagatcacgaccggtgctcgatttagtacgtcatcagggaaagggcctggagtggattggatacgtctattatagtgggagcacctactacaacccgtccctcaagagtcgagttttccatgtcagttgacacgtctaagaaccaaatctccctcaggctgacctctgtgactgccgcggacacggccgtctattattgtgcagggtcccgaacagtagttgttccagctgcgattgactacgtggggccacgggactcccgtggtccaccgtctccctcagccctaccaccgaacgggcccacgtccggttcctttccccccgtcggcccacccctccctacccgaacgacgccgaacccgtcggtcggggggcctaaccgacgggcccggccccgtggggtcctcggcccgttcgggtaccgaacgggtaccttaccttcccgacttacctacctaaccttaccgtggacgggccggggtcgtcgggacgaacgggtccgactaacgtacggcngacnnnnnnnnnnnnnnnnnnnnnnnnnnnnnnnnnnnnnnn

SEQ ID NO: 243413 - DNA, 526 bp, Homo sapiens
  misc_feature: GYAE6OF01CFCMB.37.60.F05.1.454.CMB.1.raw
  modified_base (452)..(452): a, c, t, g, unknown or other
  misc_feature (452)..(452): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
  modified_base (484)..(485): a, c, t, g, unknown or other
  misc_feature (484)..(485): n is a, c, g, or t
  modified_base (489)..(499): a, c, t, g, unknown or other
  misc_feature (489)..(499): n is a, c, g, or t
  modified_base (501)..(510): a, c, t, g, unknown or other
  misc_feature (501)..(510): n is a, c, g, or t
  modified_base (513)..(526): a, c, t, g, unknown or other
  misc_feature (513)..(526): n is a, c, g, or t
tcagtagtgtagatcacgaccggtgctcgatttagtacgtcatcagggtaaaggggccgtggagtggattggatacgtctattatagtgggagcacctactacaacccgtcccttcaagagtcgagttttccatgtcagttgacacgtctaagaccaaatctccctcaggctgacctctgtgactgccgcggacacggccgtctatacttgtgcagggtcccacagtagttgttcccagcctgcgattgactacgtggggccacggatccatggtcaacgtccgtcctcacggccctaccgaccaacggggccccatcccggtctttaccccctgggccctaaccctccgtccaacggagtcccgaaccgtccgtcgggggaccctacgacggtccggccccgtggccgtcgtcgtcggtcgaacggtcgactttccgatcctaacactacngacgcggctcgggacaacggcntacgcgnagnngtannnnnnnnnnntnnnnnnnnnngtnnnnnnnnnnnnnn

SEQ ID NO: 243414 - DNA, 621 bp, Homo sapiens
  misc_feature: GYAE6OF01BCR3P.37.60.F05.1.454.CMB.1.raw
  modified_base (166)..(166): a, c, t, g, unknown or other
  misc_feature (166)..(166): n is a, c, g, or t
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (189)..(189): a, c, t, g, unknown or other
  misc_feature (189)..(189): n is a, c, g, or t
  modified_base (193)..(193): a, c, t, g, unknown or other
  misc_feature (193)..(193): n is a, c, g, or t
  modified_base (524)..(525): a, c, t, g, unknown or other
  misc_feature (524)..(525): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
  modified_base (544)..(544): a, c, t, g, unknown or other
  misc_feature (544)..(544): n is a, c, g, or t
  modified_base (549)..(550): a, c, t, g, unknown or other
  misc_feature (549)..(550): n is a, c, g, or t
  modified_base (558)..(558): a, c, t, g, unknown or other
  misc_feature (558)..(558): n is a, c, g, or t
  modified_base (566)..(566): a, c, t, g, unknown or other
  misc_feature (566)..(566): n is a, c, g, or t
  modified_base (596)..(596): a, c, t, g, unknown or other
  misc_feature (596)..(596): n is a, c, g, or t
tcagtagtgtagatcacgaccggtgctcgattttagtacgtcatcagggaaagggcctggagtggattggatacgtctattatagtgggagcacctactacaacccgtccctcaagagtcgagttttccatgtcagttcgacacgtctaagaaccaaatctccctnaggctgacctntgtnactgccgngacncggctctatatgtgcgagggtccaactagtgttcgtccagctgcgtattcgactacggtgggaccaggactcctagtcggtcctaacgtcctacctcgacgcctccgaccgaacggccctagtccgttcctttacccccgtggccctaccccgtacctacgaacgacgccgtacccgttcggtacggggacctaaccgcggtcccggtccggtcgggtcctcggtccgtacggtacgaaccggtaccttaccgttaccacttaccgtaacctaaccgtttacgacggtacgtacgggcgttacggaccgaacgggtcccgtataacgtagnntacagtgnacngatcagtnacgtnncgtctcgntacgtcgncgctacgtagtgaccgtgactgtaccgganacgtacttcgacgtcgtcgtcgtcg

SEQ ID NO: 243415 - DNA, 852 bp, Homo sapiens
  misc_feature: GYAE6OF01EHTEC.37.60.F05.1.454.CMB.1.raw
  modified_base (117)..(117): a, c, t, g, unknown or other
  misc_feature (117)..(117): n is a, c, g, or t
tcagtagtgtagatcacgaccggtgctcgatttagtacgtcatcagggaaagggccgtggagtggattggatacgtctagttatagtgggagcacctactacaacccgtcctcaagngtcgagtttccatgtcagttgacacgtctaagaaccaatctccctcaggctgacctctgtcgactgccgcggacaccggccgtctattacgttgtcgacgacgggtcccgaactagttacgttcggttcccaaggtccttggacgtaactttcggaaccttacggtcgggggaccctacggggacttcccgaagttccgggtacctacccggtcctaccgtacgaaccgtcccgtaccgaaaccggaaccggggtccccaacggtttacccggtccctttccccccggtagggtacccctacccccgttaccgttacccgaaacgggtaaccgcccgttaaccccgtttccggggtacgggggaaccccaaccggtaacgggtcccgggtccccggttaaggggttaccctccggtacccgggtttaccggaaacggtaaacccggggttaccctttaaacgttccctaaacgttaccctaaaccgttaaccgttacgtacgggacccggttacggggacccgtttacggaccgtaaacgggccgtaaacctaaggggttacaccgtagacgttctccgaattgtctacaagcgattccgaggaaccttccgaaggttcaaccggttcgaggtacccttcggtaagggcccgaaagttcccgggtaaagtacgggcccctacggtaagggtcccttttaaagtacgtacccggtacgtaccgtaccgtcgtaccg

SEQ ID NO: 243416 - DNA, 647 bp, Homo sapiens
  misc_feature: GYAE6OF01CH8SN.37.60.F05.1.454.CMB.1.raw
  modified_base (574)..(574): a, c, t, g, unknown or other
  misc_feature (574)..(574): n is a, c, g, or t
  modified_base (580)..(580): a, c, t, g, unknown or other
  misc_feature (580)..(580): n is a, c, g, or t
  modified_base (589)..(589): a, c, t, g, unknown or other
  misc_feature (589)..(589): n is a, c, g, or t
  modified_base (594)..(594): a, c, t, g, unknown or other
  misc_feature (594)..(594): n is a, c, g, or t
  modified_base (603)..(603): a, c, t, g, unknown or other
  misc_feature (603)..(603): n is a, c, g, or t
  modified_base (621)..(621): a, c, t, g, unknown or other
  misc_feature (621)..(621): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
  modified_base (630)..(632): a, c, t, g, unknown or other
  misc_feature (630)..(632): n is a, c, g, or t
  modified_base (634)..(635): a, c, t, g, unknown or other
  misc_feature (634)..(635): n is a, c, g, or t
  modified_base (639)..(639): a, c, t, g, unknown or other
  misc_feature (639)..(639): n is a, c, g, or t
  modified_base (641)..(642): a, c, t, g, unknown or other
  misc_feature (641)..(642): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtccaaacagtagttgtccagctgcgtattgaacttacgcggggaccacggtatccagtcggttcaccgttctcctacgacgtccctaccaccgtaacgggccccagtccgggttaccctttcccccgtagggtcccaccccgttcctacccgaaaggtcgtacccgacccgttacggtcgggggaccaccgtaacgggcccgggtcccgtcgggaccgttcggcccggtttcggtaccgtaaacggtacccttaaccgttcccgaacgtttaccctaaccgtaacccgtaacgtttcgggacgggtaccgggccgtacggggtaccgtaaccgggcggtacccgtaagtaggcgtacgtnacgtanacgtcagtncgtanacgtgactncgtcagcaggtcagtcgngangngcgnnncnnctcncnncngnc

SEQ ID NO: 243417 - DNA, 629 bp, Homo sapiens
  misc_feature: GYAE6OF01DB9PQ.37.60.F05.1.454.CMB.1.raw
  modified_base (416)..(416): a, c, t, g, unknown or other
  misc_feature (416)..(416): n is a, c, g, or t
  modified_base (532)..(532): a, c, t, g, unknown or other
  misc_feature (532)..(532): n is a, c, g, or t
  modified_base (619)..(619): a, c, t, g, unknown or other
  misc_feature (619)..(619): n is a, c, g, or t
  modified_base (622)..(622): a, c, t, g, unknown or other
  misc_feature (622)..(622): n is a, c, g, or t
tcagtagtgtagatcacgaccggtgctcgatttagtacgtcatcagggaaagggccgtggagtggattggatacgtctattatagtgggagcacctactacaacccgtccctcaagagtcgagtttcccatgtcagttgacacgtctaagaccaaatctccctcaggctgacctctgtgactcgccgcggtacacggccgtctattagtgtgcagggtcccacagtagtgtccagctgcgattgactacgtgggccaggtactccatggtacaccgtctcctcgagcctaccaccgaaggccctatcggtccttccccgtagccacccgtcctaccgagacgctacctcgtagggccaacgtcgcggtcccgtggtccgtcgaccgtggtaccgtaaaggtaccctacgttacccngtttaccaacccgtactttaacgcggaacggtacgggtccttacgggacctaaacggggccgaaccttaggtaaagacggtccaaggtactaccttaggtcccgaatttacccggntactacgtacgtactagtagtcgtatacgtagtacgtacgtacgtacgtacgtagtacgtcgtacacgcgcgacgacgtacgtacgnacncgtcgcg

SEQ ID NO: 243418 - DNA, 672 bp, Homo sapiens
  misc_feature: GYAE6OF01ARSKM.37.60.F05.1.454.CMB.1.raw
  modified_base (164)..(164): a, c, t, g, unknown or other
  misc_feature (164)..(164): n is a, c, g, or t
tcagtagtgtagatcacgaccggtgctcgatttagtacgtcatcagggaaagggccgtggagtggattggatacgtctattatagtggagcacctactacaacccgtccctcaagagtcgagtttccatgtcagttgacacgtctaagaaccaaatcctccctnaggctgacctctgtgactgccgcgacacggccgtctattatgtcgcgacgggtcccaacgtagtagttcgttccagctgcgtattgactacgtgggccacggatccgagtcggtccaccgtctcctcgacgcctccgaacgaccggccagtcccggtaccttccccgtcgcctaccccgtccgtaccgaacgaccgcctaccgtcggtggggacctacgacgccggccgtcggcctcgcgtcggacgtaacggtccttaccgtaccgtacgtaccctaacgtaccgtacgtacggtacggccggtcgtacggacgaacggtccgtacgtaacgtaagccgtagatcgtaagcctaggacgtatcgactaacggctacgtaccgttagccgttagttaccggaccttaaggtccgtaggtactaccggaacgttcgggaaaccttggaaggcccgttaccgagttaaacccggccgtaccgttaccggcctttacgggcttaacccggg

SEQ ID NO: 243419 - DNA, 461 bp, Homo sapiens
  misc_feature: GYAE6OF01EB8ZS.37.60.F05.1.454.CMB.1.raw
  modified_base (452)..(461): a, c, t, g, unknown or other
  misc_feature (452)..(461): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtggggccacggactccctggtcaccgtctcctcagcctccaccgaacgggccccatccggttcccttccccccgtggccacccctccctacccaacgacgccacctcgtcgggggcacgacggcggcccgtgggttcgccgtggtacaaggacctacttccatcctacactacgtgagcgggtcgtggcaaggcgcatagnnnnnnnnnn

SEQ ID NO: 243420 - DNA, 700 bp, Homo sapiens
  misc_feature: GYAE6OF01BXWN5.37.60.F05.1.454.CMB.1.raw
  modified_base (163)..(163): a, c, t, g, unknown or other
  misc_feature (163)..(163): n is a, c, g, or t
  modified_base (193)..(193): a, c, t, g, unknown or other
  misc_feature (193)..(193): n is a, c, g, or t
  modified_base (604)..(604): a, c, t, g, unknown or other
  misc_feature (604)..(604): n is a, c, g, or t
  modified_base (609)..(609): a, c, t, g, unknown or other
  misc_feature (609)..(609): n is a, c, g, or t
  modified_base (614)..(614): a, c, t, g, unknown or other
  misc_feature (614)..(614): n is a, c, g, or t
  modified_base (630)..(630): a, c, t, g, unknown or other
  misc_feature (630)..(630): n is a, c, g, or t
  modified_base (633)..(633): a, c, t, g, unknown or other
  misc_feature (633)..(633): n is a, c, g, or t
  modified_base (646)..(646): a, c, t, g, unknown or other
  misc_feature (646)..(646): n is a, c, g, or t
  modified_base (650)..(650): a, c, t, g, unknown or other
  misc_feature (650)..(650): n is a, c, g, or t
  modified_base (657)..(657): a, c, t, g, unknown or other
  misc_feature (657)..(657): n is a, c, g, or t
  modified_base (664)..(664): a, c, t, g, unknown or other
  misc_feature (664)..(664): n is a, c, g, or t
  modified_base (673)..(673): a, c, t, g, unknown or other
  misc_feature (673)..(673): n is a, c, g, or t
tcagtagtgtagatcacgaccggtgctcgatttagtacgtcatcagggaaagggcctggagtggattggatacgtctattatagtgggagcacctactacaacccgtcctcaagagtcgagtttccatcgtcagttgacacgtctaagaaccaaatctccctnaggctgacctctgtcgactcgccgcggacnccggtccgtactagttagttcggtgccggacgggttaccccaagtacggttacgttcgttccgaagtccgtggacgtacttacgaccgttacggtcggggacctaggactccgtaagttcggtaccaccggttcctaccgtacaaccggtccctacccgaaccggaaccgggtcccctacggttcccggttccccttaccccggtggaacccctccccgttacaccgaaagccacccgtacgttccgggacggggtacccacggtaccgggtccggttcccgcgggtaccgtggtaccccggttaggtaaccaaacgggttacccttacgtttacccaagttccctaaaccgtaccgtacggttacggaacggttcccgggagttacggaccgacggccgagtacgagcancgtcngacgntagcttcgaattacgnacngttcacgtctagngacngtagacngagttcncgagcacgngttcagtccgattcaacgcgttcgaag

SEQ ID NO: 243421 - DNA, 469 bp, Homo sapiens
  misc_feature: GYAE6OF01EUQ1L.37.60.F05.1.454.CMB.1.raw
  modified_base (454)..(469): a, c, t, g, unknown or other
  misc_feature (454)..(469): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcacggggtcccgaacagttagttgttccagctgcgattgactacgtggggccacggatccctggtcaccgtctcctcacgcctccaccgaacgggcccatccggtccttccccctggcccacccctcctacccaacgcgccaccgtcgtcgggggcacgacggccggccctggggcctcgccgtgggtaacggacctacttccatctaccactactgacgcgggctggacgaaggcgcagtacgnnnnnnnnnnnnnnnn

SEQ ID NO: 243422 - DNA, 474 bp, Homo sapiens
  misc_feature: GYAE6OF01AYFAV.37.60.F05.1.454.CMB.1.raw
  modified_base (464)..(474): a, c, t, g, unknown or other
  misc_feature (464)..(474): n is a, c, g, or t
tcagtagtgtagatcacgaccggtgctcgatttagtacgtcatcagggaaagggcctggagtggattggatacgtctattatagtgggagcacctactacaacccgtccctcaagagtcgagttttccatgtcagttgacacgtctaaagaaccaaaatctccctcaggctgacctctgtgactgccgcggacacggccgtctattattgtgcagggtcccgaacagtagttgttccagctgcgattgactactgggggccacggatccccgtggtccaccgtcctcctcagccctccaccaacgggcccatcggtccttccccctggccaccctcctccaagacgcacctcgtcgggggcacgacggccggccctggggcctggcctgggtccaagggtactacgttaccacttcctacacttactggaggccgggcgtcgggacaacgggcgacagtacggnnnnnnnnnnn

SEQ ID NO: 243423 - DNA, 585 bp, Homo sapiens
  misc_feature: GYAE6OF01AC2L2.37.60.F05.1.454.CMB.1.raw
  modified_base (196)..(196): a, c, t, g, unknown or other
  misc_feature (196)..(196): n is a, c, g, or t
  modified_base (452)..(452): a, c, t, g, unknown or other
  misc_feature (452)..(452): n is a, c, g, or t
  modified_base (517)..(521): a, c, t, g, unknown or other
  misc_feature (517)..(521): n is a, c, g, or t
  modified_base (545)..(545): a, c, t, g, unknown or other
  misc_feature (545)..(545): n is a, c, g, or t
  modified_base (552)..(552): a, c, t, g, unknown or other
  misc_feature (552)..(552): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
tcagtagtgtagatcacgaccggtgctcgatttagtacgtcatcagggaagggccgtggagtggattggatacgtctattactagtggagcacctactacaacccgtcctcaagagtcgagtttccatgtcagttgacagtctaagaccaagtctcctcaggctgacctctgtgactgccgtcggacacgtccgtntattactggtgcgacgggtccaacaggttcgtgtccagctgcgattgacctcgtcgggacctcggatccgatacggtctaccggtctctacacgtccgtacaccgaacggccctagtccggtacccttcccgtggaccctaccctaccgtaccgtaaagccgtaccgtaccgtcggtcgggaccaacgcggaccggtccgtagggtccacggtccgtacggtacgaacgttactcgtacacgtcaacgtcgtaccnggtaccgtcgggtactcggtcgaacgggccctaggtaagtacgagacctgtacgatcacttgctnnnnngactacgtacgtcgtagtatacgngtcgcgntgcganacgtcncgngcgtcacgncgngtcgcg

SEQ ID NO: 243424 - DNA, 819 bp, Homo sapiens
  misc_feature: GYAE6OF01BBDFL.37.60.F05.1.454.CMB.1.raw
tcagtagtgtagatcacgaccggtgctcgatttagtacgtcatcagggaaagggcctggagtggattggatacgtctattatagtggagcacctactacaacccgtccctcaagagtcgagttttccatgtcagttgacacgtctaagaaccaaatctccctcaggctgacctctgtgactgccgcggacacggccgtctattattgtgcagggtcccgaacagtagttgttccagctgcgtattcgactacgtggggccacggactccgatggtctaccgtctcctcacgtcctaccaccgtaaacgggccccagtaccggtccgtttaccccccgtcgggtaccctaccccgttcccgtacccgaacggacgacccgtaaccccgttccggtcgggggggtacctaaccggaacgggtcccgggtccccggttacgggggtccttaccgggtcccggttcgggttacccggtaaacgggtaacccgttaacccgttttaccccgtaaaccgtttacccgttaacccgaaccccgtttaaccgtacgggtaacggggtcccggggtaccggtttacggggacccggtaaacggggtcccgtaaccggtaaacgttacggggtaacacgggttacacccgttaagtccgtaagaccggtcgttcgggattaacccgggtacgttaaccgtacggttacgggtaccgtaccgggtacttaccgggtactcgtaacggtccgtacgtcggttaaccggtacggtaccgacggtaacggtccgacgttacgtacgtacggtaccgtaccgttcgtcggtacg

SEQ ID NO: 243425 - DNA, 816 bp, Homo sapiens
  misc_feature: GYAE6OF01B4GME.37.60.F05.1.454.CMB.1.raw
  modified_base (196)..(196): a, c, t, g, unknown or other
  misc_feature (196)..(196): n is a, c, g, or t
  modified_base (240)..(240): a, c, t, g, unknown or other
  misc_feature (240)..(240): n is a, c, g, or t
  modified_base (725)..(725): a, c, t, g, unknown or other
  misc_feature (725)..(725): n is a, c, g, or t
  modified_base (730)..(730): a, c, t, g, unknown or other
  misc_feature (730)..(730): n is a, c, g, or t
  modified_base (733)..(733): a, c, t, g, unknown or other
  misc_feature (733)..(733): n is a, c, g, or t
  modified_base (756)..(756): a, c, t, g, unknown or other
  misc_feature (756)..(756): n is a, c, g, or t
  modified_base (770)..(770): a, c, t, g, unknown or other
  misc_feature (770)..(770): n is a, c, g, or t
  modified_base (793)..(793): a, c, t, g, unknown or other
  misc_feature (793)..(793): n is a, c, g, or t
  modified_base (808)..(808): a, c, t, g, unknown or other
  misc_feature (808)..(808): n is a, c, g, or t
tcagtagtgtagatcacgaccggtgctcgatttagtacgtcatcagggaaagggccgtggagtggattggatacgtctattatagtgggagcacctactacaacccgtccctcaagagtcgagttttccatcgtcagttgacacgtctaagaccaaatctccctcaggctgacctgtgtcgactgcccgcggaccncggccgttctattagttgtcggaccgtacggggtccccaaacgnggttagtttcgttaccgaagtccgtgccgtaattcggaaccttacggtcgggggaccctacgggtaactttcccaagtttcgggttacccgtaacccggttacccgttaccccgtaccggtaaccggtccccgttaccccgaaaccccggaaaccggggtcccccgtaacggttccccggttccccgttttaccccccggttacggaccccgttacccccgttacccgtaacccgaacggtaccggtaccctaacccgttccgggtacgggggaccccacggttaaccggccccgggtacccggttcgggtacccgttcggtacccggttacggggtaccctaaacgggttacccggttaacccttacccgaaccgtttacctaaccggttaacctaaccggttcggtaacgggtaacccggggtcctacggggtaacccggtaagggccctcgtaacggtagccgtagcgtagtcgtacacgtntacgnacncgacacgtcgcgactgaacgtcncgtcgacgtcgtcncgtagtccgtagtcgtctacgtntacgtctacaccgtntcgtctac

SEQ ID NO: 243426 - DNA, 442 bp, Homo sapiens
  misc_feature: GYAE6OF01D2LBK.37.60.F05.1.454.CMB.1.raw
  modified_base (409)..(409): a, c, t, g, unknown or other
  misc_feature (409)..(409): n is a, c, g, or t
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
  modified_base (434)..(442): a, c, t, g, unknown or other
  misc_feature (434)..(442): n is a, c, g, or t
tcagtagtgtagatcacgaccggtgctcgatttagtacgtcatcagggaaagggcctcggagtggattggatacgtctattatagtgggagcacctactaccaacccgtccctcaagagtcgagtttccatgtcattgacacgtctaagaaccaaatctccctcaggctgacctctgtgactgccgcggacacggccgtctacttattgtgcagggtccccgaacagtagttgttccagctgccgattgactacgtggggaccacggatcccgtggtccaccgtcgtcctccacgcctccacaacggccctaatccggtcttccccctggccaccctcctccaagtacgccacctcgtggggcacgacgcgccctggctgcctggtcaacggactactcatcacactangacgcggctggcaaggccncanagnnnnnnnnn

SEQ ID NO: 243427 - DNA, 543 bp, Homo sapiens
  misc_feature: GYAE6OF01BGVHY.37.60.F05.1.454.CMB.1.raw
  modified_base (176)..(176): a, c, t, g, unknown or other
  misc_feature (176)..(176): n is a, c, g, or t
  modified_base (517)..(543): a, c, t, g, unknown or other
  misc_feature (517)..(543): n is a, c, g, or t
tcagtagtgtagatcacgaccggtgctcgatttagtacgtcatcagggaaagggcctggagtgggattggatacgtctattatagtggggagcacctactacaacccgtccctcaagagtcgagtttccatgtcagttgacacgtctaagaaccaaatctccctcaggctgacctntgtgactgccgcggaccacggccgtctattattgtgcaggggtcccgaacagttagttgttccagtctgcgtattggactacgtggggccacggtatcccgttggtccacccgttctcctcacgtccctccaaccgtaacgggcccctaagtcccgggttccttaccccccgtgggaccctaccccgtcccctaccgaaacgacgtccacccgttcggtagggggaccacgacggcccgggcccctgggggcctggtccctgggtaccgaaagggccttaaccgttccaattccaacactacgtagacggaccgggctcggacgaacgggcgacaagtagnnnnnnnnnnnnnnnnnnnnnnnnnnn

SEQ ID NO: 243428 - DNA, 821 bp, Homo sapiens
  misc_feature: GYAE6OF01EL9WT.37.60.F05.1.454.CMB.1.raw
  modified_base (163)..(163): a, c, t, g, unknown or other
  misc_feature (163)..(163): n is a, c, g, or t
  modified_base (191)..(191): a, c, t, g, unknown or other
  misc_feature (191)..(191): n is a, c, g, or t
  modified_base (703)..(703): a, c, t, g, unknown or other
  misc_feature (703)..(703): n is a, c, g, or t
  modified_base (708)..(708): a, c, t, g, unknown or other
  misc_feature (708)..(708): n is a, c, g, or t
  modified_base (717)..(717): a, c, t, g, unknown or other
  misc_feature (717)..(717): n is a, c, g, or t
  modified_base (723)..(723): a, c, t, g, unknown or other
  misc_feature (723)..(723): n is a, c, g, or t
tcagtagtgtagatcacgaccggtgctcgattttagtacgtcatcagggaaaggggccgtggagtggattggatacgtctagttatagtgggagcacctactacaacccgtcctcaagacgtcgagtttccatgtcagttgacacgtctagaccaatctcctnaggctgacctctgcactgccgcggtacncgggcctctattacgttgtgccggtacgggtcccgaacaggttacgttcgttccgagtctagccgtattacgacctacgttcgggggacctaacgggtacttcccgtagttacggtacccgtaacccggtttccttaccgttaccgaaccggtcccctacccgtaaacccgaaaccgggggtcccctaacggtttcccgggttaccccgttttacccccccggtagggtaccccgtaacccccgttttccgaaccccggtaaggaccggtaccctaacccggttccggttacgggggaccctaacggtaccggtcccgggtaccggttcgggtccttccgggtaccgttaccgggttacggaaacggttacccgtttaaccggttacccgtacttacccggttaacctaacccgttaacgttaccgggtaacggtcccggggtaccttccggggaaaccggaaccggtacccgtacgtaacggttagacggttcaggtatcgatcgggttcngtaancctacggtntacgtntacgtacgtacgtacgtacgtcgtacgtacgtacgtacgtacgtcgtacgtaggtacggtcgtacgtacgtacgtacgacgtacgtacgtcgtcgtcg

SEQ ID NO: 243429 - DNA, 717 bp, Homo sapiens
  misc_feature: GYAE6OF01A2V65.37.60.F05.1.454.CMB.1.raw
  modified_base (143)..(143): a, c, t, g, unknown or other
  misc_feature (143)..(143): n is a, c, g, or t
  modified_base (668)..(668): a, c, t, g, unknown or other
  misc_feature (668)..(668): n is a, c, g, or t
  modified_base (674)..(674): a, c, t, g, unknown or other
  misc_feature (674)..(674): n is a, c, g, or t
  modified_base (680)..(680): a, c, t, g, unknown or other
  misc_feature (680)..(680): n is a, c, g, or t
  modified_base (689)..(690): a, c, t, g, unknown or other
  misc_feature (689)..(690): n is a, c, g, or t
  modified_base (692)..(700): a, c, t, g, unknown or other
  misc_feature (692)..(700): n is a, c, g, or t
  modified_base (702)..(708): a, c, t, g, unknown or other
  misc_feature (702)..(708): n is a, c, g, or t
  modified_base (711)..(713): a, c, t, g, unknown or other
  misc_feature (711)..(713): n is a, c, g, or t
  modified_base (715)..(717): a, c, t, g, unknown or other
  misc_feature (715)..(717): n is a, c, g, or t
tcagtagtgtagatcacgaccggtgctcgatttagtacgtcatcagggaaagggcctggagtggattggatacgtctagttatagtgggagcacctactacaacccgtccctcaagagtcgagtttcccatgtccagttgacncgtctaagaaccaaatctcccgtcaggctgacctcgtgtgacctgccgtcggaccacggccgtctattagtgtgcagggtcccgaacaggtagttcgttccaggctgcgtacttgactacgttcgggggaccaacgggtacttcccgtaaagttcggggtaccaacccggtttccctcccgttaccgaaccggttcccctaacccgaaacccggaaccgggggtccccccaaacggttcccggggttaccccttttacccccccggttcggggtacccctccccccgttaaccccgtacccggtaaaaggtacccggtacccctaccccgttaccccgggtcgggggggtaacccaccggttaaccgggtcccgggtccccggttcggggaaccccgttcgggtaacccggttccgggttaaccgtaacggggtaccccttaccggttaacctaccgttacctacctaacccgtacgtacggacgtccggccgtacgacggtaccgacgtacaagtgacagtcancagctnactgcnctagccgtnntnnnnnnnnngnnnnnnnctnnncnnn

SEQ ID NO: 243430 - DNA, 805 bp, Homo sapiens
  misc_feature: GYAE6OF01EE793.37.60.F05.1.454.CMB.1.raw
  modified_base (159)..(159): a, c, t, g, unknown or other
  misc_feature (159)..(159): n is a, c, g, or t
  modified_base (235)..(235): a, c, t, g, unknown or other
  misc_feature (235)..(235): n is a, c, g, or t
  modified_base (689)..(689): a, c, t, g, unknown or other
  misc_feature (689)..(689): n is a, c, g, or t
  modified_base (696)..(696): a, c, t, g, unknown or other
  misc_feature (696)..(696): n is a, c, g, or t
  modified_base (713)..(713): a, c, t, g, unknown or other
  misc_feature (713)..(713): n is a, c, g, or t
  modified_base (722)..(722): a, c, t, g, unknown or other
  misc_feature (722)..(722): n is a, c, g, or t
tcagtagtgtagatcacgaccggtgctcgatttagtacgtcatcagggaagggccgtggagtggattggatacgtctattatagtgggagcacctactacaacccgtcctcaagagtcgagtttccatgtcagttgacacgtctaagacaaatctcctnaggctgactctgtcgactgccgcggacaccggccgttctaattacttggtacggtccgaacggggttaccccaaanacggttaaggtttcggttacccgaaacggtccgtttgaccgggtaacttttacggaaaccgttaaccggttcggggggacccctaaacggggtaactttccccgtaaagttccgggtacctaacccggtttccttaccgttaaccgaacgtcccgttaaccgaaccggaaaaccggggtcccctaaggttcccggtttaaccccgtttcccccgttggggtacccttaacccccggtaccgttaacccgaaaggaacccgtcccgtacccgttacgggttccgggggaccttaaccggacgggcccgggttcccctagggggtcctacgggtcccgtttacgggacgtaaacgggtaaccctttacgttacccgaaactttcccgtaaacaccgttttaacgcgggaggtaccggacgttcggaacggtaacggccgacgtagagtgagttacngtatcgntaccgatggactaacgntacgtacgngtcgtagcgacgtcgtacgtagtacgactacacggtcgacgttcgtacgtactaccgcgtaccgacgtaccgtcgtcgtcgtc

SEQ ID NO: 243431 - DNA, 787 bp, Homo sapiens
  misc_feature: GYAE6OF01BGANB.37.60.F05.1.454.CMB.1.raw
  modified_base (669)..(669): a, c, t, g, unknown or other
  misc_feature (669)..(669): n is a, c, g, or t
  modified_base (676)..(676): a, c, t, g, unknown or other
  misc_feature (676)..(676): n is a, c, g, or t
  modified_base (692)..(692): a, c, t, g, unknown or other
  misc_feature (692)..(692): n is a, c, g, or t
tcagtagtgtagatcacgaccggtgctcgatttagtacgtcatcagggaaagggccgtggagtggattggatacgtctattatagtggagcacctactacaacccgtccctcaagagtcgagtttccatgtcagttgacacgtctaagaaccaaatctccctcaggctgacctctgtgactgccgcggacacggccgtctattacgttgtgcgtacgggtacccgaactaggttacgtttcgttcccgaagtccgtggtaccgaatttcggaaccttaacggtcgggggacctaacgggtactacctagttcgggtaccgaacccggttcctacccgttacgaccggtacccttacccgaacccgtaaaccgggggcccctaacgttcccggggttaccctttacccccccggttgggaccccttaacccccggttcccgttacccgaaacggaaccggtacccctaacccggtcggttacggggggacctaccggtaacggcccgggtccccgtggggtcctacggtacccggttcgggtaccgaaacgggtacccgttaacttaccccgtaacttccgtaaacctaccgtaacgtacgggtaaccgggaccgggttccgttacggaaccggtaacgggcccgtaaccgtagtaaggctaacgcggtntaccggntactagacgtagtacncgcgactacgtacgtagtcgtacgtacgtacgtacgtcgtagtcgtacgacgacgtacacgtcgacgtacgtacgtactacgtagcgtgtgtacg

SEQ ID NO: 243432 - DNA, 564 bp, Homo sapiens
  misc_feature: GYAE6OF01ADRHD.37.60.F05.1.454.CMB.1.raw
  modified_base (298)..(298): a, c, t, g, unknown or other
  misc_feature (298)..(298): n is a, c, g, or t
  modified_base (377)..(377): a, c, t, g, unknown or other
  misc_feature (377)..(377): n is a, c, g, or t
  modified_base (454)..(454): a, c, t, g, unknown or other
  misc_feature (454)..(454): n is a, c, g, or t
  modified_base (471)..(471): a, c, t, g, unknown or other
  misc_feature (471)..(471): n is a, c, g, or t
  modified_base (487)..(487): a, c, t, g, unknown or other
  misc_feature (487)..(487): n is a, c, g, or t
  modified_base (492)..(493): a, c, t, g, unknown or other
  misc_feature (492)..(493): n is a, c, g, or t
  modified_base (506)..(506): a, c, t, g, unknown or other
  misc_feature (506)..(506): n is a, c, g, or t
  modified_base (509)..(509): a, c, t, g, unknown or other
  misc_feature (509)..(509): n is a, c, g, or t
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (537)..(537): a, c, t, g, unknown or other
  misc_feature (537)..(537): n is a, c, g, or t
  modified_base (542)..(542): a, c, t, g, unknown or other
  misc_feature (542)..(542): n is a, c, g, or t
  modified_base (558)..(558): a, c, t, g, unknown or other
  misc_feature (558)..(558): n is a, c, g, or t
tcagtagtgtagatcacgaccggtgctcgatttagtacgtcatcagggaaagggccgtggagtggattggatacgtctattatagtgggagcacctactacaacccgtcctcaacgagtcgagttttccatgtccagttcgacacgtctaagaaccaaagtctcctcaggctgacctctgtgactgccgcggtacacggccgtcgtattacgtcgtaggcaggggtcccaacgagtagttcgtccagcgtgcgattcgactacgtgggggccacggatccattcggtcaccggtctcncacgcctccgacacggccatcggtccttccccgtggccctacctcctccgaagcgccaccgtcgtcggggcctaaccgnggcccggtccgtcggccgtcgaccgtgggtaccaacgtcgtactccgactccgtacacctacgtcgacggcgggtcncgggacaacggccgtanaggttagcatcagtcncgtanngctacagtcgcgngcngacgtcgancgtcgtngacngngtcgangccgngcgtcactggactcgntacgcc

SEQ ID NO: 243433 - DNA, 711 bp, Homo sapiens
  misc_feature: GYAE6OF01ERFYQ.37.60.F05.1.454.CMB.1.raw
  modified_base (160)..(160): a, c, t, g, unknown or other
  misc_feature (160)..(160): n is a, c, g, or t
  modified_base (589)..(589): a, c, t, g, unknown or other
  misc_feature (589)..(589): n is a, c, g, or t
  modified_base (609)..(609): a, c, t, g, unknown or other
  misc_feature (609)..(609): n is a, c, g, or t
tcagtagtgtagatcacgaccggtgctcgatttagtacgtcatcagggaaagggccgtggagtggattggatacgtctattatagtggagcacctactacaacccgtcctcaagagtcgagtttccatgtcagttgacacgtctaagaccaatctccctnaggctgacctcgtgtgaccttgccgtcggacacggccgtctattacgttgtgcagggtcccgaacagttagttcgttccagctgccgatttcggactacgtcggggaccacggtactccgtagttcgtccgaacccgttctaccttaccgacggccctacccaaccgaacgggcccctaacgttccgggttccttcccccgtggacctaacccctccgtaccaaacggcgacctccgttcggtgggggtacctacgacgggtcccggtcccgtacggggtccttacgggcccgttacgggtaacaacgggtaccctttaaccgtcccgtaactaccttaaccggtacccttacgtcgggtaaccgcggggtacttacgggaccgaacgggttccgaacgtagttaccggattccggattcgaacggttnacgtagtcgataagtaccgngtacgtacgtcgtacgtacgtacgtacgtacgtacgtacgtcgacgtacgtacgtacgagtacggtcgtacgtacgtacgtacgtacgtacgctcgtcgtcg

SEQ ID NO: 243434 - DNA, 526 bp, Homo sapiens
  misc_feature: GYAE6OF01CJUYB.37.60.F05.1.454.CMB.1.raw
  modified_base (367)..(367): a, c, t, g, unknown or other
  misc_feature (367)..(367): n is a, c, g, or t
  modified_base (497)..(526): a, c, t, g, unknown or other
  misc_feature (497)..(526): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggcctgacctctgtgactgccgcggacacggccgtctattattgtgcgtacgggtcccgaaactaggttagtttgttcccagcgtgcgtattggaaccttacggtcgggggaccacggtacctccgtcggtcctaccgttcctcctacacgccctcccgaaccgtaacgggccctacgttccggtccctttcccccgcggcccncccctcctaccgaacgacgcctaccgtcggtcggggacacgacggccgccgtcggctcgcgtcggtacaaggtactacctctactacctactacctgaggcgcggtcgtcggacgacgggcacgtagcgnnnnnnnnnnnnnnnnnnnnnnnnnnnnnn

SEQ ID NO: 243435 - DNA, 492 bp, Homo sapiens
  misc_feature: GYAE6OF01AZ781.37.60.F05.1.454.CMB.1.raw
  modified_base (220)..(220): a, c, t, g, unknown or other
  misc_feature (220)..(220): n is a, c, g, or t
  modified_base (318)..(318): a, c, t, g, unknown or other
  misc_feature (318)..(318): n is a, c, g, or t
  modified_base (462)..(492): a, c, t, g, unknown or other
  misc_feature (462)..(492): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccaanagtagttgttccagctgcgattgactacgtggggccaggactccctggtccaccgtctcctcacgcctcaccaacggcccagtccggtccttcccccnggcccaccctcctaccaacgacgcctaacctcgtcgggggaccacgacgccggcccgtcggggctcgccgtggtacgaaggtacctaacgttccaatcctaactacctacgtgacggcgggctggacgaaggcacgactagcannnnnnnnnnnnnnnnnnnnnnnnnnnnnnn

SEQ ID NO: 243436 - DNA, 469 bp, Homo sapiens
  misc_feature: GYAE6OF01CY1EJ.37.60.F05.1.454.CMB.1.raw
  modified_base (279)..(279): a, c, t, g, unknown or other
  misc_feature (279)..(279): n is a, c, g, or t
  modified_base (455)..(469): a, c, t, g, unknown or other
  misc_feature (455)..(469): n is a, c, g, or t
tcagtagtgtagatcacgaccggtgctcgatttagtacgtcatcagggaagggcctggagtggattggatacgtctattatagtggtagcacctactacaacccgtccctcaagagtcgagttttccatgtcagttgacacgtctaagaaccaaatctccctcaggctgacctctgtgactgccgcggacacggccgtctattattgtgcaggggtcccaacagtagttgttccagctgcgattgactactggggccacggatccctggtccaccgtcncctcagcctccaccgaagggcccatcggtccttccccctggccaccccgtcctcccaagacgccaacctcgtcgggggccacgacggccggcccgtgggcctcgccgtggtacgaaacgggacctacttccaattctacgactacgtgacggcgggctggacaaggcacataagcnnnnnnnnnnnnnnn

SEQ ID NO: 243437 - DNA, 718 bp, Homo sapiens
  misc_feature: GYAE6OF01AKNA7.37.60.F05.1.454.CMB.1.raw
  modified_base (640)..(640): a, c, t, g, unknown or other
  misc_feature (640)..(640): n is a, c, g, or t
  modified_base (643)..(643): a, c, t, g, unknown or other
  misc_feature (643)..(643): n is a, c, g, or t
  modified_base (647)..(647): a, c, t, g, unknown or other
  misc_feature (647)..(647): n is a, c, g, or t
  modified_base (653)..(653): a, c, t, g, unknown or other
  misc_feature (653)..(653): n is a, c, g, or t
  modified_base (656)..(656): a, c, t, g, unknown or other
  misc_feature (656)..(656): n is a, c, g, or t
  modified_base (659)..(659): a, c, t, g, unknown or other
  misc_feature (659)..(659): n is a, c, g, or t
  modified_base (663)..(663): a, c, t, g, unknown or other
  misc_feature (663)..(663): n is a, c, g, or t
  modified_base (667)..(667): a, c, t, g, unknown or other
  misc_feature (667)..(667): n is a, c, g, or t
  modified_base (681)..(681): a, c, t, g, unknown or other
  misc_feature (681)..(681): n is a, c, g, or t
tcagtagtgtagatcacgaccggtgctcgatttagtacgtcatcagggaaagggccgtggagtggattggatacgtctattatagtggagcacctactacaacccgtccctcaacgagtcgacgtttccatcgtcagttgacacgtctaagaaccaattctccctcaggctgacctctgtgactcgaccgtcgacgcgaccgtctattacgttggtacgcgacgggtacccgaactaggttagtttcggttacccaggtccgttacggacgtaacgtttccgaaccgtttaaccggtccggggggacccttacgggtaacttccccgtaaggttccggtaccgtaccccgttccgtaccttaccgaccgtacccttacccgaaccgtacgggacccctacgttccgggttccccttcccccgtaggacccctaccccgttccgtaacccgagtaccggccgtaccccgttcgggtaccggggccaacggtaccggcccgggtccgtcgggtcctacggtcggtaccggttacgaaccgttaccgtacttacccgtagtacccaacgtaccgtaaccgtgtaccgggtcggtaccgtacggtacgaacggtcgacgtaaacgtcgagcgctgcgcacagtncgntacngatcgnatnacntacngacnacgattacgcgtancgacgtacgacgacgtacgacgtacgtcgtcgcgacg

SEQ ID NO: 243438 - DNA, 732 bp, Homo sapiens
  misc_feature: GYAE6OF01DYCQZ.37.60.F05.1.454.CMB.1.raw
  modified_base (125)..(125): a, c, t, g, unknown or other
  misc_feature (125)..(125): n is a, c, g, or t
  modified_base (133)..(133): a, c, t, g, unknown or other
  misc_feature (133)..(133): n is a, c, g, or t
  modified_base (157)..(157): a, c, t, g, unknown or other
  misc_feature (157)..(157): n is a, c, g, or t
  modified_base (171)..(171): a, c, t, g, unknown or other
  misc_feature (171)..(171): n is a, c, g, or t
  modified_base (469)..(469): a, c, t, g, unknown or other
  misc_feature (469)..(469): n is a, c, g, or t
  modified_base (575)..(575): a, c, t, g, unknown or other
  misc_feature (575)..(575): n is a, c, g, or t
  modified_base (589)..(589): a, c, t, g, unknown or other
  misc_feature (589)..(589): n is a, c, g, or t
  modified_base (599)..(599): a, c, t, g, unknown or other
  misc_feature (599)..(599): n is a, c, g, or t
tcagtagtgtagatcacgaccggtgctcgatttagtacgtcatcagggaaagggcgtggagtggattggatacgtctattatagtggagcacctactacgaacccgtcctcaagagtcgatttcntgtcagtnacacgtctaagaacaatctccgtnaggctgactctgtnacctgccgcgacgacgcgttactattagttgcgacgtaggacccgaagtagttacgttacgtaccggtacgtagacgtacgttgaaccttacggacgggaccaacggtcttaaccgagttccgggtaactaacccgtttctacccgtaacaccgtacccgaaccgaacccgggtaagtacccctaacggtttacccgttcccctacccggtagaccctaaaccctccctaacggaaaacgtcgtaaaccgtacccgttcgggacgggcaaacgggccgttccggtacggacgggttcncggtttccgaacgggtttaacaacggtttacctaacgtttaccacgtttacgtaaccaacgttacgacggacgtaacgccgtgaacgtacgacgtacgagtaacgngcttacgaattganaccgttaggntaataccgagttaccgaagtcgtactacgttcaggttacgtagacgttaacgtcggttaagtgaacggtacgtacgaacggttcaccgtaaggtttcgtaaccggttacttaccggcgtaccgtaacggttac

SEQ ID NO: 243439 - DNA, 509 bp, Homo sapiens
  misc_feature: GYAE6OF01D798Q.37.60.F05.1.454.CMB.1.raw
  modified_base (494)..(509): a, c, t, g, unknown or other
  misc_feature (494)..(509): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcgaggggtcccgaacagttagttcgttccagctgcgattgactacgtcggggccacggactccctggtccaccgtctcctcacgcctccaaccgaacgggcccatcccggttcccttcccccgtcggccctacccctccctacccgaagacgcctacccgtcgtcgggggacacgacggccggcccgtggctcgccgtgggtaccgaaaggtccttaccgttaccacttcctaacctaacttacgtggaccgggcgggtacgtcgggacgaacggcacgtatagnnnnnnnnnnnnnnnn

SEQ ID NO: 243440 - DNA, 554 bp, Homo sapiens
  misc_feature: GYAE6OF01C4DD2.37.60.F05.1.454.CMB.1.raw
  modified_base (533)..(554): a, c, t, g, unknown or other
  misc_feature (533)..(554): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaaagaaccaaatctccctcaggctgacctctgtgactgccgcggacacggccgtctattagttgtagcgacgggtcccgaacaggttagttgttacccaggtcgttggcgtattgactacggtgggggaccacggtactccgtcggtccaccgtcctcctcacgccctaccaccgacggccctagttcccgtcccttcccccgtcggccctaccccttccctaccgaacgacgccgaccgtcggtcggggacaccggcggcccggtccggtcgggccttccggtccgtcgggtaccgaaacggtacccttacctacccgtaacttccgtaacctaaccgtacggtacgggacgggccgggtacgtcgggaccgaacggccgactagtannnnnnnnnnnnnnnnnnnnnn

SEQ ID NO: 243441 - DNA, 787 bp, Homo sapiens
  misc_feature: GYAE6OF01C9275.37.60.F05.1.454.CMB.1.raw
  modified_base (669)..(669): a, c, t, g, unknown or other
  misc_feature (669)..(669): n is a, c, g, or t
  modified_base (698)..(698): a, c, t, g, unknown or other
  misc_feature (698)..(698): n is a, c, g, or t
  modified_base (705)..(705): a, c, t, g, unknown or other
  misc_feature (705)..(705): n is a, c, g, or t
  modified_base (736)..(736): a, c, t, g, unknown or other
  misc_feature (736)..(736): n is a, c, g, or t
tcagtagtgtagatcacgaccggtgctcgatttagtacgtcatcagggaaggggccgtggagtggattggatacgtctagttatagtgggagcacctactacaacccgtcctcaagacgtcgagtttccattgtcagttgacacgtctaaagaaccgaaatcctccctcaggctcgacctcgtgtcgactgccgtcggagaccggccgtacttagttagttcgtcgacgtacggggtacccgaacgtaggttacgttccggttacccaggtaccgtggacgttacgttcggtaaccttacgggttcggggaccctaacggtacttacccggtaacgttacggtacccgtaacccggttacctacccgtaccgtacccggtccctaacccggtaaccccggtaaaccggggtacccctaccggtttccggtaaccccgtttcccccggtaggtaacccctccccgttacccgtaccgaacgtaccgtaccgtacccgttcgggtacggggacctaaccggtacggtccccggtacgtcgggtacctcgtccgttacgggtaacgacggttacctaccgttaccacggttacctaaccgtaccgtcgtacgggtaccgggtcgggtaccgcgggtaaaccggcggtccgtaacgtaaggtcgtagctaggnacgtcgtacagtcgtagtcagtagaaccngttacgngttacgaccgtatcgggactacgtaggtacnggtacgagccgttaagccgtagcgtcgccggtaatcacgtgtcgtaaaccg

SEQ ID NO: 243442 - DNA, 529 bp, Homo sapiens
  misc_feature: GYAE6OF01D6N1T.37.60.F05.1.454.CMB.1.raw
  modified_base (493)..(529): a, c, t, g, unknown or other
  misc_feature (493)..(529): n is a, c, g, or t
tcagtagtgtagatcacgaccggtgctcgatttagtacgtcatcagggaaagggcctggagtggattggatacgtctattatagtgggagcacctactacaaccccgtccctcaagagtcgagtttccatgtcagttgacacgtctaaagaaccaaatctccctcaggctgacctctgtcgactggcccgcgggaacaccggccgtctaattagttgtacgcgtaacggggtacccgaaacgtaagttagttcgttaccaggtctgcgattcgaactacggtcggggaccacggtactcccgtgtccaccgtctcctcacgccctccaccgaaacgggtcccaagtccggtccttccccccgtggcccctaccctccctacaacggtacgcctaaccgtcgtagggggaccacgacggtccccggtaccgtcggggactccggccgttacgggacgaaaacgggtaccctcctttaacccaactttaacccgnnnnnnnnnnnnnnnnnnnnnnnnnnnnnnnnnnnnn

SEQ ID NO: 243443 - DNA, 501 bp, Homo sapiens
  misc_feature: GYAE6OF01BC8GO.37.60.F05.1.454.CMB.1.raw
  modified_base (483)..(501): a, c, t, g, unknown or other
  misc_feature (483)..(501): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcgacgggtcccgaacagtagtttcgttccagctgcgtattgactacgtggggccacggactcccgtggtcaccgtctcctcacgccctccaccgaacgggcccatccggtcccttcccccgtcggccctacccctccctaccaacggacgcccacccttcggtcgggggaccaccgacgccggccccgtgggctcgccgtggtacgaacggtaccttaccttccactacctactactcgtcgacggcgggtcgtggaccgaggcgacagtacgnnnnnnnnnnnnnnnnnnn

SEQ ID NO: 243444 - DNA, 675 bp, Homo sapiens
  misc_feature: GYAE6OF01AL62J.37.60.F05.1.454.CMB.1.raw
  modified_base (225)..(225): a, c, t, g, unknown or other
  misc_feature (225)..(225): n is a, c, g, or t
  modified_base (535)..(535): a, c, t, g, unknown or other
  misc_feature (535)..(535): n is a, c, g, or t
  modified_base (545)..(545): a, c, t, g, unknown or other
  misc_feature (545)..(545): n is a, c, g, or t
  modified_base (653)..(653): a, c, t, g, unknown or other
  misc_feature (653)..(653): n is a, c, g, or t
tcagtagtgtagatcacgaccggtgctcgatttagtacgtcatcagggaaagggccgtggagtggattggatacgtctattatagtggagcacctactacaacccgtccctcaagagtcgagtttccatgtcagttcgacacgtctaagaaccaaatctccctcagctgacctctgtcgactgccgcggacacggccgtctagttatgtcgcgagggtcccgaangtagttcgttccagctgcgtattcgactacggtggggccacggactcctagtcggtccaaccgtcctcctacgacgccctaccgaccgaacgggccccacgttacccgggttccttcccccggtagcctaaccccttccgtaccgaacgaccgccgtacccgtccggcgggggtaccacgtaacggccggtcccgtgggtacctccgtcgtacggtacgaacggtacctaccttcccgacgtaacctactacctacgtcgacggtccggcgtcggacgaaggccaaccgtagtagcatgacgtcgatcanacgtcacgtntacgagtacgtcgtaagttcgaaccgtcgtaacggtcaaggttgacgtacggtaccgagttacccggaattcggaaacgttaccggcgttaaccccggactttaaccnccgggtttacgaaccttcccgg

SEQ ID NO: 243445 - DNA, 816 bp, Homo sapiens
  misc_feature: GYAE6OF01A6JS5.37.60.F05.1.454.CMB.1.raw
  modified_base (705)..(705): a, c, t, g, unknown or other
  misc_feature (705)..(705): n is a, c, g, or t
  modified_base (711)..(711): a, c, t, g, unknown or other
  misc_feature (711)..(711): n is a, c, g, or t
  modified_base (717)..(717): a, c, t, g, unknown or other
  misc_feature (717)..(717): n is a, c, g, or t
  modified_base (740)..(740): a, c, t, g, unknown or other
  misc_feature (740)..(740): n is a, c, g, or t
  modified_base (776)..(776): a, c, t, g, unknown or other
  misc_feature (776)..(776): n is a, c, g, or t
  modified_base (810)..(810): a, c, t, g, unknown or other
  misc_feature (810)..(810): n is a, c, g, or t
tcagtagtgtagatcacgaccggtgctcgatttagtacgtcatcagggaaagggcgtggagtggattggatacgtctattatagtgggagcacctactacaacccgtcctcaagagtcgagtttccatgtcagttcgactacgtctaagaaccaaatctcccgtctaggctgacctcgtcgtgactcgccgcggtacacggccgtctacttagtggacgcgtacgggtcccgaacaggttacgttcgttaccgaggtcttcggacggtatttcgaccgtacgtacgggggccaacggtactaccgtagtcggtacctaccggttcgtacccttacgaaccgtccgttacccaaccggtaaccgggcccctaaggtcccggttccccgttttaccccggtcgggtaccctaccccgtttccccgtaaccgtaaaccggtccggtacccgtaaccggtaccgggtcggggggtacctaaacccggtcgggtccccgggtaccccggtttacgggggtccttaccgggtaccgggttaccggggttaccctaaacggggttaaccgttaaccctttaccgtaaccgttaccttaaacccgttaccgttaacgtaccgggttaaccggggaccgggtaacccggttacgggtaaccggtaaccggggacgttaacccggtaggtaacgtcgacgtacgtctagtacggntaacgngtaacncggacactagacgtacggtaacngttacgaccgttggattcgggacttccgtggaaccncggtactcgcgctcggtaacgacgtcacgtacgntcggtc

SEQ ID NO: 243446 - DNA, 680 bp, Homo sapiens
  misc_feature: GYAE6OF01B5EQR.37.60.F05.1.454.CMB.1.raw
  modified_base (202)..(202): a, c, t, g, unknown or other
  misc_feature (202)..(202): n is a, c, g, or t
  modified_base (586)..(586): a, c, t, g, unknown or other
  misc_feature (586)..(586): n is a, c, g, or t
  modified_base (591)..(591): a, c, t, g, unknown or other
  misc_feature (591)..(591): n is a, c, g, or t
  modified_base (594)..(594): a, c, t, g, unknown or other
  misc_feature (594)..(594): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (605)..(605): a, c, t, g, unknown or other
  misc_feature (605)..(605): n is a, c, g, or t
tcagtagtgtagatcacgaccggtgctcgatttagtacgtcatcagggaaagggcctggagtggattggatacgtctattatagtgggacgcgaccctactacaacccgtccctcaagagtcgagtttccatgtcagttgacacgtctaaagaaccaatctccctcaggctgacctctgtgactgccgcggacacggccgtntacttatcgtgcgaggtcccgaatgtacgttgttccagtcctgaccgtattacggacctacgtcgggggacctacggtacttcccgtcggtaccgtaccgtccgtaccctacgtaccggacccttacccgacccggaacggtaccccgtacgttcccggttcccgttcccccggtcggccctacccctacccgtaccgaacgtacgtccgtaccgtccggtcggggacctaccggaccgtccggtcccgtcgggtcgtcggtccgttacgggaccggtaaacggtccttaaccgttccacttacctaccgtactacggtacggtacggtccgggtcgtacggacggtaacggtccgacgtaacgttacgactagatcatcgctntacgntanacncncgtacncgtcgtacgtagcgagtcgagcgtgacgacgtcgtcgagacgtacgacgtcgacgtactactactcgtcgtcgcg

SEQ ID NO: 243447 - DNA, 525 bp, Homo sapiens
  misc_feature: GYAE6OF01DNAV2.37.60.F05.1.454.CMB.1.raw
  modified_base (178)..(178): a, c, t, g, unknown or other
  misc_feature (178)..(178): n is a, c, g, or t
  modified_base (296)..(296): a, c, t, g, unknown or other
  misc_feature (296)..(296): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (504)..(525): a, c, t, g, unknown or other
  misc_feature (504)..(525): n is a, c, g, or t
tcagtagtgtagatcacgaccggtgctcgatttagtacgtcatcagggaaagggcctggagtggattggatacgtctattatagtgggagcacctactacaaccccgtccctcaagagtcgagtttccatgtcagttgacacgtctaagaccaaatctccctcaggctgacctctgtnactgccgcggacacggccgtctattattgtgcacggggtccccaacaggttagttcgttcccagtcctgccgtattgacctacgtggggccacggctcccgtggtccaccgtctctcngcctccacgaacggccagtccgtcccttcccccgnggccncccctcctaccgaagacgccacctcgtcggggccacgtacggcccggcccgtcggggcctcggtcccgttgggtaccgaacggtaccctttacctttcccgaattccctaacgtacctactacggtacgggccggggtcttacggggaccaacgggccgacaagtagnnnnnnnnnnnnnnnnnnnnnn

SEQ ID NO: 243448 - DNA, 686 bp, Homo sapiens
  misc_feature: GYAE6OF01BKVL5.37.60.F05.1.454.CMB.1.raw
  modified_base (181)..(181): a, c, t, g, unknown or other
  misc_feature (181)..(181): n is a, c, g, or t
  modified_base (592)..(592): a, c, t, g, unknown or other
  misc_feature (592)..(592): n is a, c, g, or t
  modified_base (610)..(610): a, c, t, g, unknown or other
  misc_feature (610)..(610): n is a, c, g, or t
  modified_base (618)..(618): a, c, t, g, unknown or other
  misc_feature (618)..(618): n is a, c, g, or t
  modified_base (628)..(628): a, c, t, g, unknown or other
  misc_feature (628)..(628): n is a, c, g, or t
  modified_base (632)..(632): a, c, t, g, unknown or other
  misc_feature (632)..(632): n is a, c, g, or t
  modified_base (656)..(656): a, c, t, g, unknown or other
  misc_feature (656)..(656): n is a, c, g, or t
  modified_base (659)..(659): a, c, t, g, unknown or other
  misc_feature (659)..(659): n is a, c, g, or t
  modified_base (680)..(680): a, c, t, g, unknown or other
  misc_feature (680)..(680): n is a, c, g, or t
  modified_base (683)..(683): a, c, t, g, unknown or other
  misc_feature (683)..(683): n is a, c, g, or t
tcagtagtgtagatcacgaccggtgctcgatttagtacgtcatcagggaaaggggccgtggagtggattggatacgtctattatagtgggagcacctactacaacccgtcctcaagagtcgagtttccatgtccagttgacacgtctaagtaaccaaatctccctcaggctgacctctgtnactggccgtcggacaccggtcgtcttattagttggtgcgacgggtcccgaactaggtacgtttcgttaccgagtcgtcgacgtagttcggacctacggttcggggaccctagggtactcccgtagttccggttccaaccggttcctaccgtacgaacggtcccttaccgaaccggaacgggtcccaacgtttccgggttaccctttcccccggtaggtacccctaccccgttcccgaccgtaacggaccgaccctaccgtccgggtacggggacttaccgacgggcccgtccggtccggttcgccggtacggttaccggcgtaacggtaccttacggtaccctactacctaactaccgtacgtgggacggtccggtacgttcggaccgtacggtcgtagtagtacggttancgatcactgctaggacancgttcaancggatcttancgtntacgctggaatccgaagtgccttncgncggcaaaccttggaacctgtnccngtc

SEQ ID NO: 243449 - DNA, 544 bp, Homo sapiens
  misc_feature: GYAE6OF01CP54X.37.60.F05.1.454.CMB.1.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (435)..(435): a, c, t, g, unknown or other
  misc_feature (435)..(435): n is a, c, g, or t
  modified_base (512)..(513): a, c, t, g, unknown or other
  misc_feature (512)..(513): n is a, c, g, or t
  modified_base (515)..(544): a, c, t, g, unknown or other
  misc_feature (515)..(544): n is a, c, g, or t
tcagtagtgtagatcacgaccggtgctcgatttagtacgtcatcagggaagggcctggagtggattggatacgtctattatagtgggagcacctactacaaccccgtccctcaagagtcgagtttccatgtcagttgacacgtctaaagaaaccaaatctccctcgaggctcgacctctgtgactgccgcggacacggcgtactattatgtgcgacggtcccaanagttagttgtccngctgcaattgactacgtcgggaccacggtactcccgtggtaccaccgtcctcctacgacgtcccaccgaaccggaacgcccctagtcccggtttaccctttcccgtcccgaggacccctacccccgttaccaaccggaaacggcctacccacccggttcgggacggggacccaacggtcggcccgtccggaggtccncggtcgacgtacgaacgtctacctactactacctactatacggtaggacggtcggacgagggacgacggcaatgaannannnnnnnnnnnnnnnnnnnnnnnnnnnnnn

SEQ ID NO: 243450 - DNA, 711 bp, Homo sapiens
  misc_feature: GYAE6OF01C3S51.37.60.F05.1.454.CMB.1.raw
  modified_base (167)..(167): a, c, t, g, unknown or other
  misc_feature (167)..(167): n is a, c, g, or t
  modified_base (667)..(667): a, c, t, g, unknown or other
  misc_feature (667)..(667): n is a, c, g, or t
  modified_base (671)..(671): a, c, t, g, unknown or other
  misc_feature (671)..(671): n is a, c, g, or t
  modified_base (673)..(676): a, c, t, g, unknown or other
  misc_feature (673)..(676): n is a, c, g, or t
  modified_base (678)..(680): a, c, t, g, unknown or other
  misc_feature (678)..(680): n is a, c, g, or t
  modified_base (682)..(687): a, c, t, g, unknown or other
  misc_feature (682)..(687): n is a, c, g, or t
  modified_base (689)..(692): a, c, t, g, unknown or other
  misc_feature (689)..(692): n is a, c, g, or t
  modified_base (694)..(696): a, c, t, g, unknown or other
  misc_feature (694)..(696): n is a, c, g, or t
  modified_base (698)..(703): a, c, t, g, unknown or other
  misc_feature (698)..(703): n is a, c, g, or t
  modified_base (705)..(711): a, c, t, g, unknown or other
  misc_feature (705)..(711): n is a, c, g, or t
tcagtagtgtagatcacgaccggtgctcgatttagtacgtcatcagggaaagggcctggagtggattggatacgtctattataggtgggagcacctactacaacccgtccctcaagagtcgagtttccatgtcagttgacacgtctaaagaaccaaattcctccctnaggtctgacctctgtcgactcgccggcggacaccggccgttacttatttagttgtcggcgacggggtacccgaacgtagttacgttcgtttaccaagtcgtgacgtattcgaaccgtttcggacgggggacccaacgggtccttccgtcggtcccgtaccgttccttcccgtacaccgtaccctacccgaaacccggaccgggtacccctaacggttcccgggttacccctttcccccccgtacgggacccctacccccttcccgtaccaaaacggcccgtccgtaaaccccggtttccgggccggggggaccaacccggcggggaccccgggtcccgttgggggacctccgggtccgggtacggttaaccggaaaccgttaccgtttaccccgttacctaacttacccttaaacgtccttaacggtggggaacccgggtacggggttaccgtccggggaaacccgaaagggggcccaaagtacggtagagtcagacttnatcntnnnnannncnnnnnncnnnncnnncnnnnnncnnnnnnn

SEQ ID NO: 243451 - DNA, 424 bp, Homo sapiens
  misc_feature: GYAE6OF02H1PGU.37.60.F05.1.454.CMB.1.raw
  modified_base (420)..(424): a, c, t, g, unknown or other
  misc_feature (420)..(424): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttcccccctggcaccctcctccaagagcacctctgggggcacagcggccctgggctgcctggtcaaggactacttccatctacactactgagcgggctggcaaggcgcatagnnnnn

SEQ ID NO: 243452 - DNA, 422 bp, Homo sapiens
  misc_feature: GYAE6OF02G5EFO.37.60.F05.1.454.CMB.1.raw
  modified_base (416)..(422): a, c, t, g, unknown or other
  misc_feature (416)..(422): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctgggggcacagcggcctggctgcctggtcaaggactacttccatctacactactgagcgggctggcaaggcgcatagnnnnnnn

SEQ ID NO: 243453 - DNA, 421 bp, Homo sapiens
  misc_feature: GYAE6OF02GZKQE.37.60.F05.1.454.CMB.1.raw
  modified_base (417)..(421): a, c, t, g, unknown or other
  misc_feature (417)..(421): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcaggttcccgaacagtagttgttccagctgcgattgactactggggccacggatccctggtcaccgtctcctcagcctccaccaagggcccatcggtcttccccctggcaccctcctccaagagcacctctgggggcacagcggcctgggctgcctggtcaaggactacttccatctacactactgagcgggctggcaaggcgcatagnnnnn

SEQ ID NO: 243454 - DNA, 421 bp, Homo sapiens
  misc_feature: GYAE6OF02H13TD.37.60.F05.1.454.CMB.1.raw
  modified_base (411)..(411): a, c, t, g, unknown or other
  misc_feature (411)..(411): n is a, c, g, or t
  modified_base (417)..(421): a, c, t, g, unknown or other
  misc_feature (417)..(421): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatccggtcttccccctggcaccctcctccaagagcacctctgggggcacagcggccctgggctgcctggtcaaggctacttccatctacactactgagcggctggcaaggcncatagnnnnn

SEQ ID NO: 243455 - DNA, 430 bp, Homo sapiens
  misc_feature: GYAE6OF02IEG78.37.60.F05.1.454.CMB.1.raw
  modified_base (425)..(430): a, c, t, g, unknown or other
  misc_feature (425)..(430): n is a, c, g, or t
tcagtagtgtagatcacgaccggtgctcgatttagtacgtcatcagggaaagggcctggagtggattggatacgtctattatagtgggagcacctactacaacccgtccctcaagagtcgagttttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggccccatcggtcttcccccctggcacccctcctcccaagagcacctctgggggcacagcggcccctgggctgcctggtcaaggactacttccatctacactactgagcgggctggcaaggcgcatagnnnnnn

SEQ ID NO: 243456 - DNA, 421 bp, Homo sapiens
  misc_feature: GYAE6OF02FS3R4.37.60.F05.1.454.CMB.1.raw
  modified_base (416)..(421): a, c, t, g, unknown or other
  misc_feature (416)..(421): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttcccctggcaccctcctccaagagcacctctgggggcacagcggccctgggctgcctggtcaaggctacttccatctacactactgagcgggctggcaaggcgcatagnnnnnn

SEQ ID NO: 243457 - DNA, 438 bp, Homo sapiens
  misc_feature: GYAE6OF02JAUZ4.37.60.F05.1.454.CMB.1.raw
  modified_base (429)..(438): a, c, t, g, unknown or other
  misc_feature (429)..(438): n is a, c, g, or t
tcagtagtgtagatcacgaccggtgctcgatttagtacgtcatcagggaaagggcctggagtggattggatacgtctattatagtgggagcacctactacaacccgtccctccaacgacgtcgagtttccatgtcagttgacacgtctaagaccaaatctccctcaggctgacctctgtgactgccgcggacacggccgtctattattgtgcagggtcccgaacagtagttgttccagctgcgattgactactggggccacggatccctggtcaccgtctcctcagcctccaccaacgggcccatcggtcttccccctggccaccctcctccaacgacgcaccctctgggggcacagcggccctgggctgcctggtcaggctactcagtctacactactgagcgggctcggcaaggcgaccgatacggnnnnnnnnnn

SEQ ID NO: 243458 - DNA, 422 bp, Homo sapiens
  misc_feature: GYAE6OF02FGIGO.37.60.F05.1.454.CMB.1.raw
  modified_base (419)..(422): a, c, t, g, unknown or other
  misc_feature (419)..(422): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnn

SEQ ID NO: 243459 - DNA, 429 bp, Homo sapiens
  misc_feature: GYAE6OF02HVN4A.37.60.F05.1.454.CMB.1.raw
  modified_base (425)..(429): a, c, t, g, unknown or other
  misc_feature (425)..(429): n is a, c, g, or t
tcagtagtgtagatcacgaccggtgctcgatttagtacgtcatcagggaaagggccgtggagtggattggatacgtctattatagtgggagcacctactacaacccgtcctccaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatcccctggtcacgtctcctcagcctccaccaagggcccatcggtctcccccctggccaccctcctccaagacgcaccctctcgggggcacagcggccctgggcctgcctggtcaaggactacttccatctacactactgagcggctggcaaggtcgcatagnnnnn

SEQ ID NO: 243460 - DNA, 423 bp, Homo sapiens
  misc_feature: GYAE6OF02GFEB1.37.60.F05.1.454.CMB.1.raw
  modified_base (418)..(423): a, c, t, g, unknown or other
  misc_feature (418)..(423): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnnn

SEQ ID NO: 243461 - DNA, 432 bp, Homo sapiens
  misc_feature: GYAE6OF02H4E6T.37.60.F05.1.454.CMB.1.raw
  modified_base (428)..(432): a, c, t, g, unknown or other
  misc_feature (428)..(432): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattactgtgcgagagttggccccatagtaccagctgtcttccgccatgcttttgatatctggggccaaggggacaaatggtcaccgtctcttcagcctccaccaagggcccatcggtcttccccctggcaccctcctccaagagcacctctggggcacagcggccctgggctgcctggtcaaggactacttccatctacactactgagcgggctggcaaggcgcatagnnnnn

SEQ ID NO: 243462 - DNA, 490 bp, Homo sapiens
  misc_feature: GYAE6OF02G8YJG.37.60.F05.1.454.CMB.1.raw
  modified_base (443)..(443): a, c, t, g, unknown or other
  misc_feature (443)..(443): n is a, c, g, or t
  modified_base (449)..(452): a, c, t, g, unknown or other
  misc_feature (449)..(452): n is a, c, g, or t
  modified_base (455)..(458): a, c, t, g, unknown or other
  misc_feature (455)..(458): n is a, c, g, or t
  modified_base (460)..(461): a, c, t, g, unknown or other
  misc_feature (460)..(461): n is a, c, g, or t
  modified_base (463)..(490): a, c, t, g, unknown or other
  misc_feature (463)..(490): n is a, c, g, or t
tcagtagtgtagatcacgaccggtgctcgatttagtacgtcatcagggaaaggggccgtggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccatggtcaccgtctcctcagcctccaccaacgggcccagtccggtcttccccctggccacccctcctccaacgacgccaccctcgtcgggggcctacgacgccggcccgtgggcctcggccgtgggtccaagggaccttacgttccgatctacactactgacgcgggctggcaggcngatagnnnngtnnnncnngnnnnnnnnnnnnnnnnnnnnnnnnnnnn

SEQ ID NO: 243463 - DNA, 427 bp, Homo sapiens
  misc_feature: GYAE6OF02JBYIC.37.60.F05.1.454.CMB.1.raw
  modified_base (402)..(402): a, c, t, g, unknown or other
  misc_feature (402)..(402): n is a, c, g, or t
  modified_base (408)..(427): a, c, t, g, unknown or other
  misc_feature (408)..(427): n is a, c, g, or t
tcagtagtgtagatcacgaccggtgctcgatttagtacgtcatcagggaaaggggcctggagtggattggatacgtctattatagtgggagcacctactacaacccgtccctcaagagtcgagttttccatgtcagttgacacgtctaagaaccaaatctccctcaggctgacctctgtgactgccgcggacacggccgtctattattgtgcagggtcccgaacagtagttgttccagctgcgattgactactggggccacggatccatggtcaccgtctcctcagcctccaccagggcccatcggtctccccctggcaccctcctccaagcgcacctctggggcacgagcgcctggctgctgcaggctactcatctacactactgagcggctggcaaggcncatagnnnnnnnnnnnnnnnnnnnn

SEQ ID NO: 243464 - DNA, 425 bp, Homo sapiens
  misc_feature: GYAE6OF02IRL81.37.60.F05.1.454.CMB.1.raw
  modified_base (419)..(425): a, c, t, g, unknown or other
  misc_feature (419)..(425): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatcccctggtcaccgtctcctcagcctccacccaagggcccatcggtcttccccctggcaccctcctccaagagcacctctgggggcacagcggcctgggctgcctggtcaaggctacttccatctacactactgagcgggctggcaaggcgcatagnnnnnnn

SEQ ID NO: 243465 - DNA, 425 bp, Homo sapiens
  misc_feature: GYAE6OF02G74T2.37.60.F05.1.454.CMB.1.raw
  modified_base (419)..(425): a, c, t, g, unknown or other
  misc_feature (419)..(425): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccacccaagggcccatcggtcttccccctggcaccctcctccaagagcacctctgggggcacagcggccctgggctgcctggtcaaggctacttccatctacactactgagcgggctggcaaggcgcatagnnnnnnn

SEQ ID NO: 243466 - DNA, 427 bp, Homo sapiens
  misc_feature: GYAE6OF02GWBAN.37.60.F05.1.454.CMB.1.raw
  modified_base (422)..(427): a, c, t, g, unknown or other
  misc_feature (422)..(427): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttcccccctggcacccctcctccaagacgcacctctgggggcacagcggccctgggctgcctggtcaaggactacttccatctacactactgagcgggctggcaaggcgcatagnnnnnn

SEQ ID NO: 243467 - DNA, 429 bp, Homo sapiens
  misc_feature: GYAE6OF02JH28G.37.60.F05.1.454.CMB.1.raw
  modified_base (420)..(429): a, c, t, g, unknown or other
  misc_feature (420)..(429): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagacgcacctctgggggcacagcggccctgggctgcctggtcaaggactacttccatctacactactgagcgggctggcaaggcgcatagnnnnnnnnnn

SEQ ID NO: 243468 - DNA, 422 bp, Homo sapiens
  misc_feature: GYAE6OF02FNG7I.37.60.F05.1.454.CMB.1.raw
  modified_base (418)..(422): a, c, t, g, unknown or other
  misc_feature (418)..(422): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnn

SEQ ID NO: 243469 - DNA, 423 bp, Homo sapiens; identical to SEQ ID NO: 243460
  misc_feature: GYAE6OF02GHEPF.37.60.F05.1.454.CMB.1.raw
  modified_base (418)..(423): a, c, t, g, unknown or other
  misc_feature (418)..(423): n is a, c, g, or t

SEQ ID NO: 243470 - DNA, 426 bp, Homo sapiens
  misc_feature: GYAE6OF02HVC4C.37.60.F05.1.454.CMB.1.raw
  modified_base (421)..(426): a, c, t, g, unknown or other
  misc_feature (421)..(426): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctcccaagagcacctctgggggcacagcggccctgggctgcctggtcaaggactacgttccatctacactactgagcgggctggcaaggcgcatagnnnnnn

SEQ ID NO: 243471 - DNA, 418 bp, Homo sapiens
  misc_feature: GYAE6OF02FRJH6.37.60.F05.1.454.CMB.1.raw
  modified_base (418)..(418): a, c, t, g, unknown or other
  misc_feature (418)..(418): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagn

SEQ ID NO: 243472 - DNA, 427 bp, Homo sapiens
  misc_feature: GYAE6OF02I2J8N.37.60.F05.1.454.CMB.1.raw
  modified_base (422)..(427): a, c, t, g, unknown or other
  misc_feature (422)..(427): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccacccaagggcccatcggtcttcccccctggcaccctcctccaagacgcacctctgggggcacagcggccctgggctgcctggtcaaggactacttccatctacactactgagcgggctggcaaggcgcatagnnnnnn

SEQ ID NO: 243473 - DNA, 461 bp, Homo sapiens
  misc_feature: GYAE6OF02JA2FJ.37.60.F05.1.454.CMB.1.raw
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (426)..(446): a, c, t, g, unknown or other
  misc_feature (426)..(446): n is a, c, g, or t
  modified_base (448)..(461): a, c, t, g, unknown or other
  misc_feature (448)..(461): n is a, c, g, or t
tcagtagtgtagatcacgaccggtgctcgatttagtacgtcatcagggaaaggggcctggagtggattggatacgtctattatagtgggagcacctactacaacccgtccctcaagagtcgagtttccatgtcagttgacacgtctaagaccaaatctccctcaggctgacctctgtgactgccgcggacacggccgtctattattgtgcagggtcccgaacagtagttgttccagctgcgattgactactggggccacggatccatggtcaccgtctcctcagcctccaccaggcccatcgtctcccctgccacctcctccagacgcacctcgtggggcacgagcggccgtggctgccgtggtcaacggctacgtccatctacactactgagcgggctggcaacggcgacataggnacgntnatnnnnnnnnnnnnnnnnnnnnngnnnnnnnnnnnnnn

SEQ ID NO: 243474 - DNA, 460 bp, Homo sapiens
  misc_feature: GYAE6OF02I22JN.37.60.F05.1.454.CMB.1.raw
  modified_base (223)..(223): a, c, t, g, unknown or other
  misc_feature (223)..(223): n is a, c, g, or t
  modified_base (417)..(417): a, c, t, g, unknown or other
  misc_feature (417)..(417): n is a, c, g, or t
  modified_base (424)..(460): a, c, t, g, unknown or other
  misc_feature (424)..(460): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaccaaatctccctcaggctgacctctgtgactgccgcgggacacggccgtctattattgtgcagggtcccgaacngtagttgttccagcctgcgattgactactggggccacggattccatggtcacgtctcctcagcctccacaagggcccatcggtctccccctggcaccctcgtccaagagcacctctggggcacagcggcctgggctgcctggtcaaggctacttcgatctacactacctgagcgggctggcaaggcgtcatagnagctagnnnnnnnnnnnnnnnnnnnnnnnnnnnnnnnnnnnnn

SEQ ID NO: 243475 - DNA, 422 bp, Homo sapiens
  misc_feature: GYAE6OF02F6M8R.37.60.F05.1.454.CMB.1.raw
  modified_base (418)..(422): a, c, t, g, unknown or other
  misc_feature (418)..(422): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctgggggcacagcggcctgggctgcctggtcaaggactacttccatctacactactgagcgggctggcaaggcgcatagnnnnn

SEQ ID NO: 243476 - DNA, 460 bp, Homo sapiens
  misc_feature: GYAE6OF02ISZ0T.37.60.F05.1.454.CMB.1.raw
  modified_base (188)..(188): a, c, t, g, unknown or other
  misc_feature (188)..(188): n is a, c, g, or t
  modified_base (261)..(261): a, c, t, g, unknown or other
  misc_feature (261)..(261): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (426)..(443): a, c, t, g, unknown or other
  misc_feature (426)..(443): n is a, c, g, or t
  modified_base (445)..(445): a, c, t, g, unknown or other
  misc_feature (445)..(445): n is a, c, g, or t
  modified_base (447)..(460): a, c, t, g, unknown or other
  misc_feature (447)..(460): n is a, c, g, or t
tcagtagtgtagatcacgaccggtgctcgatttagtacgtcatcagggaaaggggccgtggagtggattggatacgtctattatagtgggagcacctactacaacccgtccctcaagagtcgagtttcccatgtcagttgacacgtctaagaccaaatctccctcaggctgacctctgtgactgccgnggacacggccgtctattattgtgcagggtcccaacagtagttgttccagctgcgattgactactgggccaggntccaatggtcaccgtctcctcagcctccacaagggcccatcgtcttcccctggcaccctctccaagagcactctaggggcacagcgcctggctgctgtcaagctacgtcatctacactactgagcggctggcaacggcgacctagtacgngacngtcatcgatcnnnnnnnnnnnnnnnnnngngnnnnnnnnnnnnnn

SEQ ID NO: 243477 - DNA, 462 bp, Homo sapiens
  misc_feature: GYAE6OF02G4NAV.37.60.F05.1.454.CMB.1.raw
  modified_base (176)..(176): a, c, t, g, unknown or other
  misc_feature (176)..(176): n is a, c, g, or t
  modified_base (193)..(193): a, c, t, g, unknown or other
  misc_feature (193)..(193): n is a, c, g, or t
  modified_base (320)..(320): a, c, t, g, unknown or other
  misc_feature (320)..(320): n is a, c, g, or t
  modified_base (396)..(396): a, c, t, g, unknown or other
  misc_feature (396)..(396): n is a, c, g, or t
  modified_base (419)..(419): a, c, t, g, unknown or other
  misc_feature (419)..(419): n is a, c, g, or t
  modified_base (424)..(462): a, c, t, g, unknown or other
  misc_feature (424)..(462): n is a, c, g, or t
tcagtagtgtagatcacgaccggtgctcgatttagtacgtcatcagggaaaggggccgtggagtggattggatacgtctattatagtgggagcacctactacaacccgtccctcaagagtcgagtttccatgtcagttgacacgtctaagaaccaaatctccctcaggctgacctntgtgactgccgcggacncggccgtctattattgtgcagggtcccgaacagtagttgttccagctgcgattgactacgtggggccacggatccatggtcaccgtctcctcagcctccaccaagggccccagtcggtcttcccccnggcacccctcctccaagacgcacctcgtggggcacgagcggccctggctgcctgtcaggctacttcatctacactngagcggtctggcaaggccgctanacggnnnnnnnnnnnnnnnnnnnnnnnnnnnnnnnnnnnnnnn

SEQ ID NO: 243478 - DNA, 420 bp, Homo sapiens
  misc_feature: GYAE6OF02ILMIU.37.60.F05.1.454.CMB.1.raw
  modified_base (416)..(420): a, c, t, g, unknown or other
  misc_feature (416)..(420): n is a, c, g, or t
tcagtagtgtagatcacgaccggtgctcgatttagtacgtcatcagggaagggcctggagtggattggatacgtctattatagtggtagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtctccccctggcaccctcctccaagagcacctctgggggcacagcgccctgggctgcctggtcaaggactacttccatctacactactgagcgggctggcaaggcgcatagnnnnn

SEQ ID NO: 243479 - DNA, 422 bp, Homo sapiens
  misc_feature: GYAE6OF02F3KRJ.37.60.F05.1.454.CMB.1.raw
  modified_base (420)..(422): a, c, t, g, unknown or other
  misc_feature (420)..(422): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggccccatcggtcttcccccctggcaccctcctccaagagcacctctgggggcacagcggccctgggctgcctggtcaaggctacttccatctacactactgagcgggctggcaaggcgcatagnnn

SEQ ID NO: 243480 - DNA, 430 bp, Homo sapiens
  misc_feature: GYAE6OF02G9NOY.37.60.F05.1.454.CMB.1.raw
  modified_base (419)..(430): a, c, t, g, unknown or other
  misc_feature (419)..(430): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgcctcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctgggggcacagcggcctgggctgcctggtcaaggactacgttccatctacactactgagcgggctggcaaggcgcatagcnnnnnnnnnnnn

SEQ ID NO: 243481 - DNA, 449 bp, Homo sapiens
  misc_feature: GYAE6OF02JV3KJ.37.60.F05.1.454.CMB.1.raw
  modified_base (335)..(335): a, c, t, g, unknown or other
  misc_feature (335)..(335): n is a, c, g, or t
  modified_base (421)..(449): a, c, t, g, unknown or other
  misc_feature (421)..(449): n is a, c, g, or t
tcagtagtgtagatcacgaccggtgctcgatttagtacgtcatcagggaaaggggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccagggatccctggtcaccgtctcctcagcctcaccaagggcccatcggtcttccccctggccaccctcctccaagacncacctctggggcacagcggccctggctgcctggtcaaggctactccgatctacactactgagcgggactggcaaggcgccagtagnnnnnnnnnnnnnnnnnnnnnnnnnnnnn

SEQ ID NO: 243482 - DNA, 422 bp, Homo sapiens
  misc_feature: GYAE6OF02ICQ18.37.60.F05.1.454.CMB.1.raw
  modified_base (330)..(330): a, c, t, g, unknown or other
  misc_feature (330)..(330): n is a, c, g, or t
  modified_base (417)..(422): a, c, t, g, unknown or other
  misc_feature (417)..(422): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtccccgaacagtagttgttccagctgcgattgactactggggccacggaccctggtcaccgtctcctcagcctccaccaagggcccatcggtcttcccctggcaccctcctccaagngcacctctgggggcacagcggccctgggctgcctggtcaaggactacttccatctacactactgagcgggctggcaaggcgcatagnnnnnn

SEQ ID NO: 243483 - DNA, 423 bp, Homo sapiens
  misc_feature: GYAE6OF02HB2NH.37.60.F05.1.454.CMB.1.raw
  modified_base (332)..(332): a, c, t, g, unknown or other
  misc_feature (332)..(332): n is a, c, g, or t
  modified_base (417)..(423): a, c, t, g, unknown or other
  misc_feature (417)..(423): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatcccctggtcaccgtctcctcagcctccaccaagggcccatcggtcttccccctggcgccctgctccaggngcacctccgagagcacagcggccctgggctgcctggtcaaggctactccatctacactactgagcgggctggcaaggcgcatagnnnnnnn

SEQ ID NO: 243484 - DNA, 484 bp, Homo sapiens
  misc_feature: GYAE6OF02G9XIN.37.60.F05.1.454.CMB.1.raw
  modified_base (353)..(353): a, c, t, g, unknown or other
  misc_feature (353)..(353): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (425)..(427): a, c, t, g, unknown or other
  misc_feature (425)..(427): n is a, c, g, or t
  modified_base (430)..(430): a, c, t, g, unknown or other
  misc_feature (430)..(430): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (477)..(478): a, c, t, g, unknown or other
  misc_feature (477)..(478): n is a, c, g, or t
  modified_base (483)..(483): a, c, t, g, unknown or other
  misc_feature (483)..(483): n is a, c, g, or t
tcagtagtgtagatcacgaccggtgctcgatttagtacgtcatcagggaaagggccgtggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattcgactacgtggggccacggatccatggtcaccgtctcctcagcctccacacgggccatcgtctccctggcacctcgtccaagcgcactcgtgggcacagcgcctggcngctgacaggctctcatcacactactgacgcgggctcggcaacggcgacaagacgtnaagtcatcgntacngnnngcnacgacactgtgtgtcgcngcgcgcgcgagnacgngacgngngcncgnnctcgnc

SEQ ID NO: 243485 - DNA, 432 bp, Homo sapiens
  misc_feature: GYAE6OF02HVAG9.37.60.F05.1.454.CMB.1.raw
  modified_base (421)..(432): a, c, t, g, unknown or other
  misc_feature (421)..(432): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtccccgaacagtagttgttccagctgcgattgactactggggccacggatccctggtcaccgtctcctcagcctccaccaagggcccatcggtcttcccccctggcaccctcctccaagacgcacctctgggggcacagcggccctggctgcctggtcaaggactacttccatctacactactgagcgggctggcaaggcgcatagnnnnnnnnnnnn

SEQ ID NO: 243486 - DNA, 485 bp, Homo sapiens
  misc_feature: GYAE6OF02GSFZL.37.60.F05.1.454.CMB.1.raw
  modified_base (404)..(404): a, c, t, g, unknown or other
  misc_feature (404)..(404): n is a, c, g, or t
  modified_base (442)..(443): a, c, t, g, unknown or other
  misc_feature (442)..(443): n is a, c, g, or t
  modified_base (446)..(446): a, c, t, g, unknown or other
  misc_feature (446)..(446): n is a, c, g, or t
  modified_base (451)..(464): a, c, t, g, unknown or other
  misc_feature (451)..(464): n is a, c, g, or t
  modified_base (466)..(485): a, c, t, g, unknown or other
  misc_feature (466)..(485): n is a, c, g, or t
tcagtagtgtagatcacgaccggtgctcgattttagtacgtcatcagggaaaggggccgtggagtggattggatacgtctattatagtgggagcacctactacaacccgtccctcaagagtcgagtttccatgtcagttgacacgtctaagaccaaatctccctcaggctgacctctgtgactgccgcggacacggccgtctattattgtgcgagggtcccgaacagtagttgttccagctgcgattggactacgtggggccacggatccatggtcacgtctcctcagcctcaccaagggcccagtccggtcttccccctggccacccctctcacgagcacctcgtggggcacaggccggcctggctacggtccgtggtacaaggccttactcgactcgaaccngtacctgacgcggtctggctaaggccgacagtagctcnncgntacgnnnnnnnnnnnnnngnnnnnnnnnnnnnnnnnnnn

SEQ ID NO: 243487 - DNA, 524 bp, Homo sapiens
  misc_feature: GYAE6OF02H4X8H.37.60.F05.1.454.CMB.1.raw
  modified_base (223)..(223): a, c, t, g, unknown or other
  misc_feature (223)..(223): n is a, c, g, or t
  modified_base (460)..(460): a, c, t, g, unknown or other
  misc_feature (460)..(460): n is a, c, g, or t
  modified_base (482)..(486): a, c, t, g, unknown or other
  misc_feature (482)..(486): n is a, c, g, or t
  modified_base (488)..(492): a, c, t, g, unknown or other
  misc_feature (488)..(492): n is a, c, g, or t
  modified_base (494)..(499): a, c, t, g, unknown or other
  misc_feature (494)..(499): n is a, c, g, or t
  modified_base (501)..(505): a, c, t, g, unknown or other
  misc_feature (501)..(505): n is a, c, g, or t
  modified_base (507)..(508): a, c, t, g, unknown or other
  misc_feature (507)..(508): n is a, c, g, or t
  modified_base (510)..(513): a, c, t, g, unknown or other
  misc_feature (510)..(513): n is a, c, g, or t
  modified_base (515)..(515): a, c, t, g, unknown or other
  misc_feature (515)..(515): n is a, c, g, or t
  modified_base (517)..(519): a, c, t, g, unknown or other
  misc_feature (517)..(519): n is a, c, g, or t
  modified_base (521)..(523): a, c, t, g, unknown or other
  misc_feature (521)..(523): n is a, c, g, or t
tcagtagtgtagatcacgaccggtgctcgatttagtacgtcatcagggaaaggggccgtggagtggattggatacgtctattatagtgggagcacctactacaacccgtccctcaagagtcgagtttccatgtcagttgacacgtctaagaaccaaatctcctcaggctgacctctgtgactgccgcggacacggccgtctattattgtgcagggtcccgaanagtagttgtccaggctgcgtattcgactacgtggggccacggatccatcggtcaaccgtctcctcagcctcacacgggccatcggtccttcccctggccaccctcctacaagacgcacctcgcggggcacgacggcggccgtgggcctggcctcggtacgaaacggtactaccgttaccaattccgtaactactacgtcgaacggtcgggacgttcgggaccgaaacgggtcccganaaacgttacggctatcgagctnnnnnannnnngnnnnnngnnnnngnncnnnncncnnncnnnc

SEQ ID NO: 243488 - DNA, 735 bp, Homo sapiens
  misc_feature: GYAE6OF02GN41W.37.60.F05.1.454.CMB.1.raw
  modified_base (606)..(606): a, c, t, g, unknown or other
  misc_feature (606)..(606): n is a, c, g, or t
  modified_base (614)..(614): a, c, t, g, unknown or other
  misc_feature (614)..(614): n is a, c, g, or t
tcagtagtgtagatcacgaccggtgctcgatttagtacgtcatcagggaaaggggccgtggagtggattggatacgtctattatagtgggagcacctactacaacccgtccctcaagagtcgagtttccatgtcagttgacacgtctaagaaccaaatctccctcaggctgacctctgtgactgccgcggacacggcctctattatgtgcgagggtcccgaacagtagttgttccagctgcgattgactacgtggggccaggatccatcggtcaccgtctcctcacgcctccaccaacgggcccaagtccggtaccttcccccgtggccctaccccgtccctaccgaaacgacgtcctaacccgtcggtacgggggaccaaccgtaggtcccgggtaccccgttgggaccgttcggtacccgttacgggtaccgtaaacggggtaaccctttaacccgttacccgaacgttacccgttaaaccctaaccgtttaacccgtacggtaaccggggcccggggtaaccgtttacggggaacccgtaaacgggggtaccccgaccgtaaagttacgggacttacgtaccgagtactgtacgatcgttacntaccggtntactccgaagccgattaacgtcgaggtaccgtagaccgttaggtaaccgacggttaacgaccgtacgtaaccgttacgtaccgtaacggtccgtaacggtaccgtcgttaccgtaccgtcg

SEQ ID NO: 243489 - DNA, 596 bp, Homo sapiens
  misc_feature: GYAE6OF02HACOI.37.60.F05.1.454.CMB.1.raw
  modified_base (262)..(262): a, c, t, g, unknown or other
  misc_feature (262)..(262): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (480)..(480): a, c, t, g, unknown or other
  misc_feature (480)..(480): n is a, c, g, or t
tcagtagtgtagatcacgaccggtgctcgatttagtacgtcatcagggaaagggccgtggagtggattggatacgtctattatagtgggagcacctactacaacccgtccctcaagagtcgagtttccatgtcagttgacacgtctaagaaccaaatctccctcaggctgacctctgtgactgccgcggacacggccgtctattatgtgcagggtcccgaacagtagttgttccagctgcgattgactacgtggggccaggntccatggtcaccgtctcctcacgcctccaccaacggggcccaagtccggtaccttcccccgtggccaccctccgtccaagacgccacctcgtcgggggtacacgacggccggcccgtgggactcgccgtcggtcgaaggccttacttccatcctacactacgtgacgcggctgggacaaggccgcgagtacgnctangctagctacgactcagtacgngtactagacctaggtcgtaattcgacggttccaagtacgttcggaacccttggtaacggcgttaaacggtcggtaacccgtcggtacgtaccgttcgacgtacgtacgtaccgtcg

SEQ ID NO: 243490 - DNA, 631 bp, Homo sapiens
  misc_feature: GYAE6OF02JXUWJ.37.60.F05.1.454.CMB.1.raw
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
tcagtagtgtagatcacgaccggtgctcgatttagtacgtcatcagggaaaggggccgtggagtggattggatacgtctattatagtgggagcacctactacaacccgtccctcaagagtcgagtttccatgtcagttgacacgtctaagaccaatctcctcaggctgacctctgtcgactgccgcggacacggccgtctattacttgtgcagggtcccaanagtagttgtccagctgcgattgactacgtgggccacggntccatggtcaccgtctcctcagcctccaccgacggccatcggtacctccccgtggccaccctcctccagacgccaccgtcgtcggggcacgacgccggtacccgtgggcctcggtccgtcgggtaccgaaacgggtaccttaaccggttacccacgttacccttaaccgaaccgttaccgttacggaacggtccgggtaccgtcgggtaccggaaacgggccggacgtaacgtaacgggtctacgcgtaggacgtccgtanacgtntcacgcgtcgtacgacgtcgtacgtcgtcgtcgtcgtagacgtcgacgtacgtacgtcgtacgtacgacgtacgtcgacgtacgtacgtacgtcgtcgtcgtcg

SEQ ID NO: 243491 - DNA, 433 bp, Homo sapiens
  misc_feature: GYAE6OF02IWRJB.37.60.F05.1.454.CMB.1.raw
  modified_base (419)..(419): a, c, t, g, unknown or other
  misc_feature (419)..(419): n is a, c, g, or t
  modified_base (421)..(433): a, c, t, g, unknown or other
  misc_feature (421)..(433): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggccaccctcctccaagagcacctctgggggcacagcggcctgggctgcctggtcaaggactacttccatctacactactgagcgggctggcaaggcgcatagnannnnnnnnnnnnn

SEQ ID NO: 243492 - DNA, 435 bp, Homo sapiens
  misc_feature: GYAE6OF02HLUNZ.37.60.F05.1.454.CMB.1.raw
  modified_base (222)..(222): a, c, t, g, unknown or other
  misc_feature (222)..(222): n is a, c, g, or t
  modified_base (359)..(359): a, c, t, g, unknown or other
  misc_feature (359)..(359): n is a, c, g, or t
  modified_base (420)..(420): a, c, t, g, unknown or other
  misc_feature (420)..(420): n is a, c, g, or t
  modified_base (427)..(435): a, c, t, g, unknown or other
  misc_feature (427)..(435): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacngtagttgttccagctgcgattgactactggggccacggatccctggtcaccgtctcctcagcctccacaagggcccatcggtcttcccccctggccaccctccctccaagacgcacctctgggggcacagcggcccnggggctgcctggtcaaggactacttccatctacactactgacgcggggctgggcaagggcncgatagnnnnnnnnn

SEQ ID NO: 243493 - DNA, 506 bp, Homo sapiens
  misc_feature: GYAE6OF02HZJ82.37.60.F05.1.454.CMB.1.raw
  modified_base (223)..(223): a, c, t, g, unknown or other
  misc_feature (223)..(223): n is a, c, g, or t
  modified_base (462)..(462): a, c, t, g, unknown or other
  misc_feature (462)..(462): n is a, c, g, or t
  modified_base (467)..(474): a, c, t, g, unknown or other
  misc_feature (467)..(474): n is a, c, g, or t
  modified_base (477)..(482): a, c, t, g, unknown or other
  misc_feature (477)..(482): n is a, c, g, or t
  modified_base (485)..(491): a, c, t, g, unknown or other
  misc_feature (485)..(491): n is a, c, g, or t
  modified_base (493)..(499): a, c, t, g, unknown or other
  misc_feature (493)..(499): n is a, c, g, or t
  modified_base (501)..(506): a, c, t, g, unknown or other
  misc_feature (501)..(506): n is a, c, g, or t
tcagtagtgtagatcacgaccggtgctcgatttagtacgtcatcagggaaagggcctggagtggattggatacgtctattatagtgggagcacctactacaacccgtccctcaagagtcgagttttccatgtcagttgacacgtctaagaccaaatctccctcaggctgacctctgtgactgccgcggacacggccgtctattattgtgcagggtcccgaacngtagttgttccagctgcgattcgactacgtggggccacggatccatgtcaccgtctcctcagcctccaccgaaggcccagtccggtactttcccccgtggcctaccctccctccaagacgccacccttcgtgggggacctacgaggccggcccgtgggctcggccgtggtcaaggacttacttccgatctactactactgacggcgggctgggacgaacggcgactacgtaggctagcntacgnnnnnnnnacnnnnnncgnnnnnnngnnnnnnncnnnnnn

SEQ ID NO: 243494 - DNA, 606 bp, Homo sapiens
  misc_feature: GYAE6OF02HSC84.37.60.F05.1.454.CMB.1.raw
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
  modified_base (504)..(504): a, c, t, g, unknown or other
  misc_feature (504)..(504): n is a, c, g, or t
tcagtagtgtagatcacgaccggtgctcgatttagtacgtcatcagggaaagggccgtggagtggattggatacgtctattatagtgggagcacctactacaacccgtccctcaagagtcgagtttccatgtcagttgacacgtctaagaccaaatctcctcaggctgacctctgtagactgccgcggacacggccgtctacttattgtgcagggtcccgaacagtagttgttcccagctagcgaattgactactggggccacggatccatggtcaccgtctcctcagcctccaccaggccagtcggtcttcccctggccaccctcctccagacgcacctcgtggggcctacgacggccgccgtcggcgtacgccgtggtcgaacggtactaccgttcctatccgtaactactactacgacgccgggtaccgtcggacgaacgggccgtaccgaagttacggatcgtanacgtcagtcngtatcgtgaatcgaacgatccgtanagtccgttaggtccctaacgggtagtacgtacgtacgtacgtacgtacgtacgtaccgtacgtacgtacgtaccgtaccgtaccgtacgtaccgtccgtccg

SEQ ID NO: 243495 - DNA, 441 bp, Homo sapiens
  misc_feature: GYAE6OF02IL02E.37.60.F05.1.454.CMB.1.raw
  modified_base (432)..(441): a, c, t, g, unknown or other
  misc_feature (432)..(441): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctcggcacccctcctcccaagacgccacctcgtgggggcacgacgcggccctgggctgccgtggtcaaggactacttccatctacactactgacgcgggctggcaaggcgacagtagnnnnnnnnnn

SEQ ID NO: 243496 - DNA, 485 bp, Homo sapiens
  misc_feature: GYAE6OF02GFRSA.37.60.F05.1.454.CMB.1.raw
  modified_base (288)..(288): a, c, t, g, unknown or other
  misc_feature (288)..(288): n is a, c, g, or t
  modified_base (338)..(338): a, c, t, g, unknown or other
  misc_feature (338)..(338): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (448)..(455): a, c, t, g, unknown or other
  misc_feature (448)..(455): n is a, c, g, or t
  modified_base (457)..(474): a, c, t, g, unknown or other
  misc_feature (457)..(474): n is a, c, g, or t
  modified_base (476)..(479): a, c, t, g, unknown or other
  misc_feature (476)..(479): n is a, c, g, or t
  modified_base (481)..(485): a, c, t, g, unknown or other
  misc_feature (481)..(485): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagcctgcgattgactactggggccaggatccatggtcaccgtctctcacgcccnccaccaaggcccatccggtccttccccctggccaccctcctaccaagacnccacctcgtggggccacgagccgggccctggctcgccgtggtacaaggcttactccattcctacgctacgtgaggtcggctggacaagggtccgcaagtcgatcnatnannnnnnnnannnnnnnnnnnnnnnnnncnnnncnnnnn

SEQ ID NO: 243497 - DNA, 566 bp, Homo sapiens
  misc_feature: GYAE6OF02GRWSI.37.60.F05.1.454.CMB.1.raw
  modified_base (188)..(188): a, c, t, g, unknown or other
  misc_feature (188)..(188): n is a, c, g, or t
  modified_base (478)..(479): a, c, t, g, unknown or other
  misc_feature (478)..(479): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (534)..(534): a, c, t, g, unknown or other
  misc_feature (534)..(534): n is a, c, g, or t
  modified_base (564)..(564): a, c, t, g, unknown or other
  misc_feature (564)..(564): n is a, c, g, or t
tcagtagtgtagatcacgaccggtgctcgattttagtacgtcatcagggaaagggccgtggagtggattggatacgtctattatagtgggagcacctactacaacccgtccctcaagagtcgagtttccatgtcagttgacacgtctaagaaccaaatctccctcaggctgacctctgtgactgccgnggacacggccgtctattattgtgcgagggtcccgaacagtagttgttccagctgcgattgactacgtggggccacggatcatgtcaccgtctcctcacgcctccaccgaacggacccacgtcggtccttccccgtcggcctaccctcctaccgaacgacgcacctcgtggggacacgacgcggccgtcggcgtcgccgtggtactaacggtactacgttacctactacctaacctactactacggacgcgggacgtcggacgtaacgacgcgagtaagcgatgcatagcnnanacncngacgtacgagtagtacgtcgtacgtacgcgtacgtgtcgacgtagcgngcgacgacgtacgacgtcgtcgcgcgcgtncg

SEQ ID NO: 243498 - DNA, 467 bp, Homo sapiens
  misc_feature: GYAE6OF02GSBSM.37.60.F05.1.454.CMB.1.raw
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (398)..(398): a, c, t, g, unknown or other
  misc_feature (398)..(398): n is a, c, g, or t
  modified_base (405)..(406): a, c, t, g, unknown or other
  misc_feature (405)..(406): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
  modified_base (454)..(467): a, c, t, g, unknown or other
  misc_feature (454)..(467): n is a, c, g, or t
tcagtagtgtagatcacgaccggtgctcgatttagtacgtcatcagggaaaggggccgtggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtggggccacggatccatggtcaccgtctcctcagcctccaccaggcccancgtctcccngcaccnctcagncacctctggggcacagcggcctgggctgacctggcaaggctactccatcacactctgagcggtctggcaaggcncataggnnagctatcgancagtcagcgntagntncagtcagtncgntancgancgnnnnnnnnnnnnnn

SEQ ID NO: 243499 - DNA, 459 bp, Homo sapiens
  misc_feature: GYAE6OF02G0LYH.37.60.F05.1.454.CMB.1.raw
  modified_base (438)..(459): a, c, t, g, unknown or other
  misc_feature (438)..(459): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtggggccacggactccctggtcaccgtctcctcagcctccaccaaggcccatcggtccttccccctggccacccctcctcccaacgacgccacctcgtgggggcacagccggcctgggctcgccgtggtacaaggactactccactcgtacactactgacgcgggctcggcaacggcgacagtagcnnnnnnnnnnnnnnnnnnnnnn

SEQ ID NO: 243500 - DNA, 460 bp, Homo sapiens
  misc_feature: GYAE6OF02HMRBU.37.60.F05.1.454.CMB.1.raw
  modified_base (406)..(406): a, c, t, g, unknown or other
  misc_feature (406)..(406): n is a, c, g, or t
  modified_base (433)..(460): a, c, t, g, unknown or other
  misc_feature (433)..(460): n is a, c, g, or t
tcagtagtgtagatcacgaccggtgctcgatttagtacgtcatcagggaaggggtccgtggagtggattggatacgtctattatagtgggagcacctactacaacccgtccctcaagagtcgagtttccatgtcagttgacacggtctaagaaccaaatctccgtcaggctgacctctgtgactgccgcggacacggccgtctattattgtgcagggtcccgaacagtagttgttccagctgcgattgactactggggccacggatccctggtcaccgtctcctcagcctccaccaagggccccatcggtcttcccccctggccacccctcctccaagacgccacccgtcgtgggggcacgagcggccctgggctgcctggtcaaggctactccatctacactacngagcgggctggcaagggcgcgagtagnnnnnnnnnnnnnnnnnnnnnnnnnnnn

SEQ ID NO: 243501 - DNA, 563 bp, Homo sapiens
  misc_feature: GYAE6OF02GYUG1.37.60.F05.1.454.CMB.1.raw
  modified_base (225)..(225): a, c, t, g, unknown or other
  misc_feature (225)..(225): n is a, c, g, or t
  modified_base (286)..(286): a, c, t, g, unknown or other
  misc_feature (286)..(286): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (517)..(518): a, c, t, g, unknown or other
  misc_feature (517)..(518): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(529): a, c, t, g, unknown or other
  misc_feature (524)..(529): n is a, c, g, or t
  modified_base (534)..(535): a, c, t, g, unknown or other
  misc_feature (534)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (550)..(563): a, c, t, g, unknown or other
  misc_feature (550)..(563): n is a, c, g, or t
tcagtagtgtagatcacgaccggtgctcgatttagtacgtcatcagggaaagggccgtggagtggattggatacgtctattatagtgggagcaccctactacaacccgtccctcaagagtcgagttttccatgtcagttgacacgtctaagaaccaaatctaccctcaggctgacctctgtgactgccgcggacacggccgtctattattgtgcagggtcccaanagtagttgttccagctgcgtattgactacgtgggccaggactccgtggtccaccgtctccncagcctccaccaacgggcccacgtccggtaccttccccccgtggcctaccccgtccctaccaaagtaccgaccacccgttcgtcgggggtccaccgacggcccggccccggtacggccgtcggccgttcggtacgaacggtacctaccgttacctacgtaccttaaccacttaccgtacgtaacggccgggtcgtacggacgtaacgggccgacacgttagcgtangntgnntncnannnnnngcgcnngngngcgcgangngnnnnnnnnnnnnnn

SEQ ID NO: 243502 - DNA, 424 bp, Homo sapiens
  misc_feature: GYAE6OF02JB5J8.37.60.F05.1.454.CMB.1.raw
  modified_base (278)..(278): a, c, t, g, unknown or other
  misc_feature (278)..(278): n is a, c, g, or t
  modified_base (416)..(424): a, c, t, g, unknown or other
  misc_feature (416)..(424): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtccccgaacagtagttgttccagctgcgattgactactggggccaggatccctggtcaccgtcncctcagcctcacccaaggcccatcggtcttcccctggcaccctcctccaagacgcaccctctggggggtcacagcgcctgggctgcctggtcaaggctacttcatctacactactgagcgggctggcaagcgcatagnnnnnnnnn

SEQ ID NO: 243503 - DNA, 543 bp, Homo sapiens
  misc_feature: GYAE6OF02HVC8H.37.60.F05.1.454.CMB.1.raw
  modified_base (225)..(225): a, c, t, g, unknown or other
  misc_feature (225)..(225): n is a, c, g, or t
  modified_base (329)..(329): a, c, t, g, unknown or other
  misc_feature (329)..(329): n is a, c, g, or t
  modified_base (487)..(488): a, c, t, g, unknown or other
  misc_feature (487)..(488): n is a, c, g, or t
  modified_base (493)..(493): a, c, t, g, unknown or other
  misc_feature (493)..(493): n is a, c, g, or t
  modified_base (496)..(499): a, c, t, g, unknown or other
  misc_feature (496)..(499): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (507)..(509): a, c, t, g, unknown or other
  misc_feature (507)..(509): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (517)..(519): a, c, t, g, unknown or other
  misc_feature (517)..(519): n is a, c, g, or t
  modified_base (521)..(521): a, c, t, g, unknown or other
  misc_feature (521)..(521): n is a, c, g, or t
  modified_base (523)..(524): a, c, t, g, unknown or other
  misc_feature (523)..(524): n is a, c, g, or t
  modified_base (526)..(526): a, c, t, g, unknown or other
  misc_feature (526)..(526): n is a, c, g, or t
  modified_base (528)..(530): a, c, t, g, unknown or other
  misc_feature (528)..(530): n is a, c, g, or t
  modified_base (532)..(536): a, c, t, g, unknown or other
  misc_feature (532)..(536): n is a, c, g, or t
  modified_base (538)..(539): a, c, t, g, unknown or other
  misc_feature (538)..(539): n is a, c, g, or t
  modified_base (541)..(543): a, c, t, g, unknown or other
  misc_feature (541)..(543): n is a, c, g, or t
tcagtagtgtagatcacgaccggtgctcgatttagtacgtcatcagggaaagggccgtggagtggattggatacgtctattatagtgggagcacctactacaacccgtccctcaagagtcgagtttccatgtcagttgacacgtctaagaccaaatctccctcaggctgacctctgtgactgccgcggacacggccgtctattattgtgccgagggtcccgaacngtagttgttccagctgcgattgactagtcgggccacggatccatcggtcaccgtctcctcgacgcctcccaccgaacgggcccagtccggttcccttcccccgnggcccaccccttccgtaccaacgacgccacccgtcgtaggggccacgacggccgacccgtggccgtcggtccgtggtaccgaacggtactaccgttaccattacctacgtaacctacgtcggacggtcgggcctggacgaacggccgacgtaagtagnngtacngannnntcangnannngngngngnnngngnngngnnngnnnnngnncnnn

SEQ ID NO: 243504 - DNA, 484 bp, Homo sapiens
  misc_feature: GYAE6OF02GEECD.37.60.F05.1.454.CMB.1.raw
  modified_base (459)..(459): a, c, t, g, unknown or other
  misc_feature (459)..(459): n is a, c, g, or t
  modified_base (461)..(484): a, c, t, g, unknown or other
  misc_feature (461)..(484): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagttagttgttccagctgcgattgactacgtggggcccacgggactcccgtggtcaccgtctcctcacgcctccaccaacgggcccatcggtccttccccctcggccacccctccctaccaacgacgccaccctcgtcgggggccacgacgccggcccgtggggcctcggccgtgggtcgaaggactacttccactctacactactgacgcgggctcgggcaagggccgacagtagngnnnnnnnnnnnnnnnnnnnnnnnn

SEQ ID NO: 243505 - DNA, 493 bp, Homo sapiens
  misc_feature: GYAE6OF02FVMP2.37.60.F05.1.454.CMB.1.raw
  modified_base (403)..(403): a, c, t, g, unknown or other
  misc_feature (403)..(403): n is a, c, g, or t
  modified_base (410)..(411): a, c, t, g, unknown or other
  misc_feature (410)..(411): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (430)..(433): a, c, t, g, unknown or other
  misc_feature (430)..(433): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
tcagtagtgtagatcacgaccggtgctcgatttagtacgtcatcagggaaaggggccgtggagtggattggatacgtctattatagtgggagcacctactacaacccgtccctcaagagtcgagtttccatgtcagttgacacgtctaagaccaaatctccctcaggctgacctctgtgactgccgcggacacggccgtctattattgtgcagggtcccgaacagtagttgttccagctgcgattgactactggggccaggatccatggtcacgtctcctcagcctccacaagggcccatcggtctccccgtgcaccctctccagagcacctctggggcacagcggccctggctgcctggtcaaggactactccatctacactactgagcgggctggcaggcncaatggnngactncagtcnacgtntannnntgtcgcgtacngacgngtacgngtagtgcgtngcgtagcgagcgctacgcncgtcgntcg

SEQ ID NO: 243506 - DNA, 538 bp, Homo sapiens
  misc_feature: GYAE6OF02IBPXL.37.60.F05.1.454.CMB.1.raw
  modified_base (182)..(182): a, c, t, g, unknown or other
  misc_feature (182)..(182): n is a, c, g, or t
  modified_base (218)..(218): a, c, t, g, unknown or other
  misc_feature (218)..(218): n is a, c, g, or t
  modified_base (282)..(282): a, c, t, g, unknown or other
  misc_feature (282)..(282): n is a, c, g, or t
  modified_base (412)..(412): a, c, t, g, unknown or other
  misc_feature (412)..(412): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
  modified_base (482)..(482): a, c, t, g, unknown or other
  misc_feature (482)..(482): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
  modified_base (519)..(519): a, c, t, g, unknown or other
  misc_feature (519)..(519): n is a, c, g, or t
  modified_base (523)..(523): a, c, t, g, unknown or other
  misc_feature (523)..(523): n is a, c, g, or t
  modified_base (529)..(529): a, c, t, g, unknown or other
  misc_feature (529)..(529): n is a, c, g, or t
  modified_base (535)..(535): a, c, t, g, unknown or other
  misc_feature (535)..(535): n is a, c, g, or t
tcagtagtgtagatcacgaccggtgctcgatttagtacgtcatcagggaagggcctggagtggattggatacgtctattatagtgggagcacctactacaacccgtcctcaagagtcgatttccatgtcagttgacacgtctaagaccaaatcctcctcaggctgacctctgtgactgccgnggacacggcctctattattgtgcacgggtcccaacngttagttgttccagctgcgattcgactacgtcgggcacggatccatcggtcaccgtctcctcancctcaccaggcccacgtcgtccttaccccttggccgtaccctccgtaccgacgacgcctaccgtccgtcgggggactacgacggcccggtccgtgggcctcggtccttcgggctaagggactccgttacnctctaccgactactacgagcggctacggacgaaggcgtcaagtgtancgtancgttancagcatcgatgntacgatctncgnantngagacgtgngtnacgctcgancgancgtacngtctcngtc

SEQ ID NO: 243507 - DNA, 435 bp, Homo sapiens
  misc_feature: GYAE6OF02GI46E.37.60.F05.1.454.CMB.1.raw
  modified_base (415)..(415): a, c, t, g, unknown or other
  misc_feature (415)..(415): n is a, c, g, or t
  modified_base (422)..(435): a, c, t, g, unknown or other
  misc_feature (422)..(435): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtggggccacggatccctggtcaccgtctcctcagcctccaccaagggcccatcggtcttccccctggcaccctcctccaagacgcacctctcgggggcacagcggccctgggctgcctggtcaaggactacttccatctacactactgagcgggctggcaaggcncgatagnnnnnnnnnnnnnn

SEQ ID NO: 243508 - DNA, 488 bp, Homo sapiens
  misc_feature: GYAE6OF02IBKSK.37.60.F05.1.454.CMB.1.raw
  modified_base (463)..(463): a, c, t, g, unknown or other
  misc_feature (463)..(463): n is a, c, g, or t
  modified_base (465)..(488): a, c, t, g, unknown or other
  misc_feature (465)..(488): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtcggggccacggatccctggtccaccgtctcctcagccctccaccaacgggcccatccggtccttccccctggcctcccctcctccaacgacgccacctcgtcggggccacgacgcggcccgtgggctcgccgtcggtacgaacgtacctacgttaccactactacctaacctacgtaggacgcgggcgtggacgtaacgggcacgatacgncnnnnnnnnnnnnnnnnnnnnnnnn

SEQ ID NO: 243509 - DNA, 427 bp, Homo sapiens
  misc_feature: GYAE6OF02F4J8L.37.60.F05.1.454.CMB.1.raw
  modified_base (417)..(427): a, c, t, g, unknown or other
  misc_feature (417)..(427): n is a, c, g, or t
tcagtagtgtagatcacgaccggtgctcgatttagtacgtcatcagggaaagggcctggagtggattgtatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggccacggatccctggtcaccgtctcctcagcctccaccaagggcccatcggtcttccccctggcaccctcctccaagagcacctctgggggcacagcgccctggctgcctggtcaggactacgttccatctacactactgagcgggctggcaaggcgcatagnnnnnnnnnnn

SEQ ID NO: 243510 - DNA, 435 bp, Homo sapiens
  misc_feature: GYAE6OF02I82H2.37.60.F05.1.454.CMB.1.raw
  modified_base (219)..(219): a, c, t, g, unknown or other
  misc_feature (219)..(219): n is a, c, g, or t
  modified_base (317)..(317): a, c, t, g, unknown or other
  misc_feature (317)..(317): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (420)..(435): a, c, t, g, unknown or other
  misc_feature (420)..(435): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattatgtgcagggtcccaanagtagttgttccagctgcgattgactacgtggggccacggatccctggtcaccgtctcctcagcctccacccaagggcccatcggtcttccccctgcncccctcctccaagagcacctcngggggcacagccggccngggctgcctggtcaaggctacttcatcacactactgacgcgggctcggcaagggcgcagtacgnnnnnnnnnnnnnnnn

SEQ ID NO: 243511 - DNA, 545 bp, Homo sapiens
  misc_feature: GYAE6OF02GDFQS.37.60.F05.1.454.CMB.1.raw
  modified_base (167)..(167): a, c, t, g, unknown or other
  misc_feature (167)..(167): n is a, c, g, or t
  modified_base (190)..(190): a, c, t, g, unknown or other
  misc_feature (190)..(190): n is a, c, g, or t
  modified_base (223)..(223): a, c, t, g, unknown or other
  misc_feature (223)..(223): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (434)..(434): a, c, t, g, unknown or other
  misc_feature (434)..(434): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
  modified_base (461)..(462): a, c, t, g, unknown or other
  misc_feature (461)..(462): n is a, c, g, or t
  modified_base (465)..(465): a, c, t, g, unknown or other
  misc_feature (465)..(465): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (486)..(486): a, c, t, g, unknown or other
  misc_feature (486)..(486): n is a, c, g, or t
  modified_base (526)..(526): a, c, t, g, unknown or other
  misc_feature (526)..(526): n is a, c, g, or t
tcagtagtgtagatcacgaccggtgctcgatttagtacgtcatcagggtaaaggggccgtggagtggattggatacgtctattatagtgggagcacctactacaacccgtccctcaagagtcgagtttccatgtcagttgacacgtctaagaaccaaagtctccctnaggctgacctctgtgactgccgnggacacggcctctattatgtgcagggtcccaangtagttcgttccagctgcgtattgactacgtggggacctacggtatccagtcggtaccacgtcctacctacgacgccctccaccgtaaggccccagtccgtcttcccccgtggccaccctcncgaagcnccacctgcgggcacaggccggcctggctcggcctggtacaaggacttactcacgtctacactcgtgagccgctggacacggngacataggcatctgancgtanctgacnngangtgcgntgtacngtcgtacgngacgtgtacggagacgtacgacgtacgtacgtagaccggntccgccgacgtcctacgtc

SEQ ID NO: 243512 - DNA, 453 bp, Homo sapiens
  misc_feature: GYAE6OF02F5NK6.37.60.F05.1.454.CMB.1.raw
  modified_base (437)..(437): a, c, t, g, unknown or other
  misc_feature (437)..(437): n is a, c, g, or t
  modified_base (442)..(453): a, c, t, g, unknown or other
  misc_feature (442)..(453): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtggggccacggactccctggtccaccgtctcctcagcctccaccaagggcccatccggtccttccccctggccaccctcctccaagacgcacctcgtgggggccacgagccggcccgtggggcctcggcctgggtacaaagggtacctacgttccatctacactactgagcgggctggcaaggcgnatagnnnnnnnnnnnn

SEQ ID NO: 243513 - DNA, 671 bp, Homo sapiens
  misc_feature: GYAE6OF02F4IMQ.37.60.F05.1.454.CMB.1.raw
  modified_base (230)..(230): a, c, t, g, unknown or other
  misc_feature (230)..(230): n is a, c, g, or t
  modified_base (534)..(534): a, c, t, g, unknown or other
  misc_feature (534)..(534): n is a, c, g, or t
  modified_base (548)..(548): a, c, t, g, unknown or other
  misc_feature (548)..(548): n is a, c, g, or t
  modified_base (554)..(554): a, c, t, g, unknown or other
  misc_feature (554)..(554): n is a, c, g, or t
tcagtagtgtagatcacgaccggtgctcgatttagtacgtcatcagggaaaggggccgtggagtggattggatacgtctattatagtgggagcacctacgtacaacccgtccctcaagagtccgagttttccatgtcagttgacacgtctaagaaccaaatctccctcaggctgacctctgtgactgccgcggacacggccgtctattacttggtgcgagggtcccgaanagttagttcgttccagctagcgtattcgactacgtggggcccacggtctaccattcggtccaccgtctccctcacgccctccaccgaacgggccccaatccggttccttcccccgtggcccaccccgtccctcccgaacgtacgccctaccttccggtcgggggacctacgacggccggtcccgtcgggctcggcctcgggtacaacgggaccttaccgttaccgtacttacccgtactaacccgttaccgtcggaacggtccgggtacctgggaacgtaacgggcacgtacttacggatcgtngcgatcgatcgctntacggntattcggacctgttagcggtcgttaccagtaacgggtccctttacgggacggtacggtaacggtcgaccgtacggtacgacgtacgtacgtacgtaccgtcgtaccgtaccgtacgg

SEQ ID NO: 243514 - DNA, 475 bp, Homo sapiens
  misc_feature: GYAE6OF02H4UCD.37.60.F05.1.454.CMB.1.raw
  modified_base (460)..(475): a, c, t, g, unknown or other
  misc_feature (460)..(475): n is a, c, g, or t
tcagtagtgtagatcacgaccggtgctcgatttagtacgtcatcagggaaagggcctggagtggattggatacgtctattatagtgggagcacctactacaaccccgtccctcaagagtcgagtttccatgtcagttgacacgtctaagaaccaaaatctccctcaggctgacctctgtgactgccgcggacacggccgtctattattgtgcagggtcccgaacagtagttgttccagctgcgatttgactacgtggggccacggactccctggtccaccgtcctcctcagccctccaccaacgggcccagtccggtccttcccccctggccacccctccctccaacgacgccacctcgtcgggggccacgagccggcccgtgggcctcgccgtggtcaacggtactacttcctactctactacctacgtgacgcgggctcggcgaacggcgcagtacgnnnnnnnnnnnnnnnn

SEQ ID NO: 243515 - DNA, 618 bp, Homo sapiens
  misc_feature: GYAE6OF02H2990.37.60.F05.1.454.CMB.1.raw
  modified_base (196)..(196): a, c, t, g, unknown or other
  misc_feature (196)..(196): n is a, c, g, or t
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
  modified_base (359)..(359): a, c, t, g, unknown or other
  misc_feature (359)..(359): n is a, c, g, or t
  modified_base (522)..(522): a, c, t, g, unknown or other
  misc_feature (522)..(522): n is a, c, g, or t
  modified_base (537)..(537): a, c, t, g, unknown or other
  misc_feature (537)..(537): n is a, c, g, or t
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
  modified_base (549)..(549): a, c, t, g, unknown or other
  misc_feature (549)..(549): n is a, c, g, or t
  modified_base (554)..(554): a, c, t, g, unknown or other
  misc_feature (554)..(554): n is a, c, g, or t
  modified_base (572)..(572): a, c, t, g, unknown or other
  misc_feature (572)..(572): n is a, c, g, or t
  modified_base (577)..(577): a, c, t, g, unknown or other
  misc_feature (577)..(577): n is a, c, g, or t
  modified_base (612)..(612): a, c, t, g, unknown or other
  misc_feature (612)..(612): n is a, c, g, or t
  modified_base (617)..(617): a, c, t, g, unknown or other
  misc_feature (617)..(617): n is a, c, g, or t
tcagtagtgtagatcacgaccggtgctcgatttagtacgtcatcagggaaaggggccgtggagtggattggatacgtctagttatagtgggagcacctactacaacccgtccctcaagagtcgagtttccatgtcagttgacacgtctaagaacccgaaattctccctcaggctgaccttctgtcgactgacccgnggactacggccgtctagttattgtgcgagggtcccgaacagtagttgtccagctcgcgattgaacctacgtggggccacggtntccgaatcggtcaccgtctcctcncgcctaccgacgaacgggcccacgttcggtacccttcccccgtggaccctaccccncgtaccgaagacgtcccaaccgtcggtcgggcctaacgccgtacgggcccgttaggcctcggtcccttaggtacgaaacggttacctaaccgtaccattacccgtactaacctaccgtcggaacggccgggtccgtggtaacggacggtcgtacagtacggtnacgtatactctagcnatncgaatnacncgtanttaggctagtacaacggntacgngtatagactggctaagtcacgtagccaagccttanactcnc

SEQ ID NO: 243516 - DNA, 512 bp, Homo sapiens
  misc_feature: GYAE6OF02F1LOC.37.60.F05.1.454.CMB.1.raw
  modified_base (227)..(227): a, c, t, g, unknown or other
  misc_feature (227)..(227): n is a, c, g, or t
  modified_base (309)..(309): a, c, t, g, unknown or other
  misc_feature (309)..(309): n is a, c, g, or t
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
  modified_base (463)..(463): a, c, t, g, unknown or other
  misc_feature (463)..(463): n is a, c, g, or t
  modified_base (493)..(493): a, c, t, g, unknown or other
  misc_feature (493)..(493): n is a, c, g, or t
tcagtagtgtagatcacgaccggtgctcgatttagtacgtcatcagggtaaaggggccgtggagtggattggatacgtctattatagtgggagcacctactacaacccgtccctcaagagtcgagtttccatgtcagttgacacgtctaagaccaaatctccctcaggctgacctctgtgactgccgcggtacacggccgtctattacttgtcgcagggtcccgaanagtagttcgttccagctgcgattgactactggggccacggatcatggtcacgtctctcagcctcacaggccatcgtctcccngcacctctcagcgcacctcgtcgggcacgagccggcctggctgtcctggtacgagctacgtccatctacactacngacgcggactcggacgaacggcgacgacgtagnacgntacgntacgtncgtancctnagagtncgngtncgtcaagtcngcgcgtgcgatggccttaggaccaggcacncgattcggactcgacgtcg

SEQ ID NO: 243517 - DNA, 441 bp, Homo sapiens
  misc_feature: GYAE6OF02F0NSB.37.60.F05.1.454.CMB.1.raw
  modified_base (163)..(163): a, c, t, g, unknown or other
  misc_feature (163)..(163): n is a, c, g, or t
  modified_base (170)..(170): a, c, t, g, unknown or other
  misc_feature (170)..(170): n is a, c, g, or t
  modified_base (422)..(422): a, c, t, g, unknown or other
  misc_feature (422)..(422): n is a, c, g, or t
  modified_base (428)..(441): a, c, t, g, unknown or other
  misc_feature (428)..(441): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctnacccggntgacctctgtgactgccgcggacacggccgtctattattgtgcagggtcccgaacagtagttgttccagctgcgattgactactggggccacggatccctggtcaccgtctcctcagcctccaccaagggccccaatcggtccttccccctggccaccctcctccaagacgcacctcgtgggggcacacgccggcctgggctgcctggcaaggactacttccatctacactactgacgcggctggacaggcncatagnnnnnnnnnnnnnn

SEQ ID NO: 243518 - DNA, 499 bp, Homo sapiens
  misc_feature: GYAE6OF02JDXL0.37.60.F05.1.454.CMB.1.raw
  modified_base (188)..(188): a, c, t, g, unknown or other
  misc_feature (188)..(188): n is a, c, g, or t
  modified_base (193)..(193): a, c, t, g, unknown or other
  misc_feature (193)..(193): n is a, c, g, or t
  modified_base (227)..(227): a, c, t, g, unknown or other
  misc_feature (227)..(227): n is a, c, g, or t
  modified_base (287)..(287): a, c, t, g, unknown or other
  misc_feature (287)..(287): n is a, c, g, or t
  modified_base (448)..(448): a, c, t, g, unknown or other
  misc_feature (448)..(448): n is a, c, g, or t
  modified_base (461)..(461): a, c, t, g, unknown or other
  misc_feature (461)..(461): n is a, c, g, or t
  modified_base (463)..(470): a, c, t, g, unknown or other
  misc_feature (463)..(470): n is a, c, g, or t
  modified_base (472)..(481): a, c, t, g, unknown or other
  misc_feature (472)..(481): n is a, c, g, or t
  modified_base (483)..(492): a, c, t, g, unknown or other
  misc_feature (483)..(492): n is a, c, g, or t
  modified_base (494)..(499): a, c, t, g, unknown or other
  misc_feature (494)..(499): n is a, c, g, or t
tcagtagtgtagatcacgaccggtgctcgatttagtacgtcatcagggaaaggggcctggagtgggattgggatacgtctattatagtgggagcacctactacaacccgtccctcaagagtcgagtttccatgtcagttgacacgtctaagaccaaatctccctcaggctgacctctgtgactgccgnggacncggccgtctattagttgtgcgagggtcccgaacngtagttgtccagctgcgattgactacgtggggccacggatccatcggtcaccgtctcctncgcctccacgaacggccacgtcggtccttccccgaggccacccctcacctaagcgctaccgtcggtcggggctacgacgcggacctggctcgcgtgtacgaggactcgttcataccacgacttaacgcgaggccggtctacggacgtaacgggcctaacgngtagcgactgcgngnnnnnnnnannnnnnnnnngnnnnnnnnnncnnnnnn

SEQ ID NO: 243519 - DNA, 469 bp, Homo sapiens
  misc_feature: GYAE6OF02GY0RK.37.60.F05.1.454.CMB.1.raw
  modified_base (422)..(422): a, c, t, g, unknown or other
  misc_feature (422)..(422): n is a, c, g, or t
  modified_base (452)..(469): a, c, t, g, unknown or other
  misc_feature (452)..(469): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtggggccacggactccctggtccaccgtctcctcacgcctccaccaacgggcccatccggtccttcccccgtcggccacccctcctcccaagacgccacctcgtcgggggcacgagccggcccgtgggcctcgccgtcggtcgaaggacctacgttccatcctacactacncgacggcggcgtcggcgacggcgacatagnnnnnnnnnnnnnnnnnn

SEQ ID NO: 243520 - DNA, 445 bp, Homo sapiens
  misc_feature: GYAE6OF02JF8KP.37.60.F05.1.454.CMB.1.raw
  modified_base (220)..(220): a, c, t, g, unknown or other
  misc_feature (220)..(220): n is a, c, g, or t
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
  modified_base (414)..(445): a, c, t, g, unknown or other
  misc_feature (414)..(445): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccaanagtagttgttccagctgcgattgactactggggccacggatccctggtcaccgtctcctcagcctccaccagggcccancggtctcccctggcaccctcctccaagngcacctctggggcacagcggcctggctgcctgcaaggactactccatcacactactgagcgggctggcaaaggcgacactaggatcnnnnnnnnnnnnnnnnnnnnnnnnnnnnnnnn

SEQ ID NO: 243521 - DNA, 550 bp, Homo sapiens
  misc_feature: GYAE6OF02HPMEE.37.60.F05.1.454.CMB.1.raw
  modified_base (262)..(262): a, c, t, g, unknown or other
  misc_feature (262)..(262): n is a, c, g, or t
  modified_base (506)..(512): a, c, t, g, unknown or other
  misc_feature (506)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (518)..(520): a, c, t, g, unknown or other
  misc_feature (518)..(520): n is a, c, g, or t
  modified_base (522)..(550): a, c, t, g, unknown or other
  misc_feature (522)..(550): n is a, c, g, or t
tcagtagtgtagatcacgaccggtgctcgatttagtacgtcatcagggaaagggcctggagtggattggatacgtctattatagtgggagcacctactacaaccccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactactggggcacggntcctggtcaccgtctcctctagccctcaccgaacgggcccatccggtcccttccccgtcggcctaccccttccacccagaacgcctaacctccgtcgggggccacgacggcggcccggttgggcctcggaccgtttcgggactaaacgggtaccttaactttaccggatacccggttaacctaaccggtttacctaggaaccgggcgggtcgttcgaacggaacggggcctacgacgttaaggnnnnnnngncncnnngnnnnnnnnnnnnnnnnnnnnnnnnnnnnn

SEQ ID NO: 243522 - DNA, 686 bp, Homo sapiens
  misc_feature: GYAE6OF02HNNZF.37.60.F05.1.454.CMB.1.raw
tcagtagtgtagatcacgaccggtgctcgatttagtacgtcatcagggaaagggcctggagtggattggatacgtctattatagtgggagcacctactacaacccgtccctcaagagtcgagttttccatgtcagttgacacgtctaagaccaaatctccctcaggctgacctctgtgactgccgcggacacggccgtctacttattcgtgtcagggttccccgaacagtagttgttaccagcctgcgattcgaccacgtggggccagggaaccctggtccaccgtctcctcagcctccaccgacggcccagtccggtccttccccgtggccgcccgtgcctccgaggacgccaccgtccgagacgccaacgacggccggacccgtgggcctcggccgttggtaccgaacggtacctaccgtttaccacgttacctaaccgaccttaaccgtcggacgggtccgggtccgtacgggaacccgtaaaggggcccgtacgtaaacggttacggtcgaccgtacgcttaggacgacgtccgagtaccggaccgtaaccggtcgtaccgacggttaaccggtccgagttaccgggcttacggaccgtaccgtagtaccgtacgccgtcggaccgttaacgccggttaccgcgttaccggacggtcttacccggaacgttcgaacgtccgg

SEQ ID NO: 243523 - DNA, 528 bp, Homo sapiens
  misc_feature: GYAE6OF02GM31B.37.60.F05.1.454.CMB.1.raw
  modified_base (223)..(223): a, c, t, g, unknown or other
  misc_feature (223)..(223): n is a, c, g, or t
  modified_base (281)..(281): a, c, t, g, unknown or other
  misc_feature (281)..(281): n is a, c, g, or t
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (451)..(451): a, c, t, g, unknown or other
  misc_feature (451)..(451): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (498)..(498): a, c, t, g, unknown or other
  misc_feature (498)..(498): n is a, c, g, or t
  modified_base (511)..(511): a, c, t, g, unknown or other
  misc_feature (511)..(511): n is a, c, g, or t
  modified_base (524)..(524): a, c, t, g, unknown or other
  misc_feature (524)..(524): n is a, c, g, or t
tcagtagtgtagatcacgaccggtgctcgatttagtacgtcatcagggaaagggccgtggagtggattggatacgtctattagtagtgggagcacctactacaacccgtcctcaagagtcgagtttccatgtcagttgacacgtctaagaccaaatctccctcaggctgacctctgtgactgcccgtcggacaccggcgtctattattgtgcagggtcccaangtagttgttaccagctgcgattgactactgggccaggactcatggtcaccgtctcctnacgcctcaccaggcccatcggtactccccngcacccgtcncgangccacgtcgtgggctacagcgccgtggctcgctggtacacggtactcttccagttcctaacgactactgacgtcggctggaccaagggcacgactggacngtcngatntcgncgtatcgactgtanacggcttaagccgtaaggtntactgntagtacgtacacgtacgtacncgtagcaggtacncgtacgtgcgtcncgtc

SEQ ID NO: 243524 - DNA, 438 bp, Homo sapiens
  misc_feature: GYAE6OF02HATBJ.37.60.F05.1.454.CMB.1.raw
  modified_base (428)..(438): a, c, t, g, unknown or other
  misc_feature (428)..(438): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtggggccacggatccctggtcaccgtctcctcagcctccaccaaggcccatcggtcttcccccctggccacccctcctcccaagacgccacctcgtgggggcacgagccggccctgggctgcctggtcaaggctacttccatctacactactgagcgggctggcaaggcgcagtagnnnnnnnnnnn

SEQ ID NO: 243525 - DNA, 447 bp, Homo sapiens
  misc_feature: GYAE6OF02GNPB6.37.60.F05.1.454.CMB.1.raw
  modified_base (416)..(416): a, c, t, g, unknown or other
  misc_feature (416)..(416): n is a, c, g, or t
  modified_base (431)..(433): a, c, t, g, unknown or other
  misc_feature (431)..(433): n is a, c, g, or t
  modified_base (435)..(447): a, c, t, g, unknown or other
  misc_feature (435)..(447): n is a, c, g, or t
tcagtagtgtagatcacgaccggtgctcgatttagtacgtcatcagggaaagggcctggagtggattggatacgtctattatagtgggagcacctactacaacccgtccctcaagagtcgagttttccatgtcagttgacacgtctaagaaccaaatctccctcaggctgacctctgtgactgccgcggacacggccgtctattattgtgcagggtcccgaacagtagttgttccagctgcgattgactacgtggggccacggatccctggtcaccgtctcctcagcctccaccaaggcccatcggtccttccccctcggccacccctcctccaacgacgccacctcgtcgggggcacgacgcggccctgggctgcctggtacaaggactactcactctacactactgagcggcgnggcaaggcgcatagnnngnnnnnnnnnnnnn

SEQ ID NO: 243526 - DNA, 761 bp, Homo sapiens
  misc_feature: GYAE6OF02HUS6C.37.60.F05.1.454.CMB.1.raw
  modified_base (224)..(224): a, c, t, g, unknown or other
  misc_feature (224)..(224): n is a, c, g, or t
tcagtagtgtagatcacgaccggtgctcgatttagtacgtcatcagggaaagggccgtggagtggattggatacgtctattatagtgggagcacctactacaacccgtcctcaagagtcgagtttccatgtcagttgacacgtctaagaccaaatctccctcaggctgacctctgtcgactcgccgcggacacggccgtctattattgtgcgagggtccgaacngtagttgtccagctgcgtattcgactacgtcggggaccacggtatccgagtcggtcaccgtctcctcgacgcctaccaccgaacggacccacgttccggtacccttccccgtcggtacccaccccgttccctaccgtaacggacgtaccacccgttcggtacgggggacctacgacggcccgggtaccggttcgggtccgtaccggtccggttacgggttaccggtaaacggggtaacctttaaccgtttaccccgtaaaccgttaccctttaaaccgtaacccgtttaaccgttacgggtaaccggggtacccggggtacccgtacggggtacccggtaaaacggggtcccgggtaaaccggttaacgttacgggtagacggttacacgttaaggcctagttacgacggtcaacgttcgacgtacgtaccgttagaccttacgacgttacgcgtacgtaacgtgtacgtaccgagttacgaccgggtctaacggaccgtacggctaacgggttccggtccgtcgtaccgtcgtacg

SEQ ID NO: 243527 - DNA, 617 bp, Homo sapiens
  misc_feature: GYAE6OF02GPCMO.37.60.F05.1.454.CMB.1.raw
  modified_base (117)..(117): a, c, t, g, unknown or other
  misc_feature (117)..(117): n is a, c, g, or t
  modified_base (141)..(141): a, c, t, g, unknown or other
  misc_feature (141)..(141): n is a, c, g, or t
  modified_base (163)..(163): a, c, t, g, unknown or other
  misc_feature (163)..(163): n is a, c, g, or t
  modified_base (237)..(237): a, c, t, g, unknown or other
  misc_feature (237)..(237): n is a, c, g, or t
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
  modified_base (542)..(542): a, c, t, g, unknown or other
  misc_feature (542)..(542): n is a, c, g, or t
  modified_base (588)..(588): a, c, t, g, unknown or other
  misc_feature (588)..(588): n is a, c, g, or t
  modified_base (597)..(597): a, c, t, g, unknown or other
  misc_feature (597)..(597): n is a, c, g, or t
  modified_base (615)..(615): a, c, t, g, unknown or other
  misc_feature (615)..(615): n is a, c, g, or t
tcagtagtgtagatcacgaccggtgctcgatttagtacgtcatcagggtaagggtcctggagtggattggatacgtctattactagtgggagcacctactacaacccgtcctcaagngtcgagtttccatgtcagttgacncgtctaagaccaaatctccctnaggctgaccttctgtcgactcgaccgcggtaccacggcccgtctagttacttggcgcaggggttcccccgaaancggttacgttgttcccgagccgttgccgaatttcgacctacggtcggggcccagggttactcccattcggtccacgttctcctcacgtcctcccacctaacgggccctagtccgtctaccccgtggcctaccctctccaagcgctaccgccgtgggtcacgtacgcggccgtaggccgtacggtcctgggtacaacggtacgtaccgtccctagtcccactacttacctcgcggcgttacggtcgcggtaaaccggtggtacctaagttcgacgngtacgtnacggtctagtcagctactgacgnaacgtgaacttggcctagtcgagccgtatgtacagtcgacgtagtnaaccggttntcgtactcctggctacgntc

SEQ ID NO: 243528 - DNA, 558 bp, Homo sapiens
  misc_feature: GYAE6OF02I56I4.37.60.F05.1.454.CMB.1.raw
  modified_base (165)..(165): a, c, t, g, unknown or other
  misc_feature (165)..(165): n is a, c, g, or t
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
  modified_base (491)..(491): a, c, t, g, unknown or other
  misc_feature (491)..(491): n is a, c, g, or t
  modified_base (498)..(498): a, c, t, g, unknown or other
  misc_feature (498)..(498): n is a, c, g, or t
  modified_base (505)..(505): a, c, t, g, unknown or other
  misc_feature (505)..(505): n is a, c, g, or t
  modified_base (520)..(520): a, c, t, g, unknown or other
  misc_feature (520)..(520): n is a, c, g, or t
  modified_base (533)..(533): a, c, t, g, unknown or other
  misc_feature (533)..(533): n is a, c, g, or t
  modified_base (541)..(541): a, c, t, g, unknown or other
  misc_feature (541)..(541): n is a, c, g, or t
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
tcagtagtgtagatcacgaccggtgctcgatttagtacgtcatcagggaaagggccgtggagtggattggatacgtctagttatagtgggagcacctacgtacaacccgtcctcaagagtcgagtttccatgtcagttgacacgtctaagaaccaaatctccctnaggctgacctctgtgactgccgcggacacggccgtntattattgtcgcgagggtcccgaacgtagtacgtttcgttcccgaagtctaggccggaatttcggactacgtggggcctaacggntccatggtacaccgtctacctcacgcctccacgaacggcccatccgttcctcccctggctacccgtcctcaacgacacaccgtcgtcgggcacgacgcggccctggctagtccgtggtacgaacggcttactcacgttcacctactactgacgcggtacgtacgacgaaccggcacgtcgtacgncagtatgntactgcacgtanagctctnctgtacngtacgcttaagcgtnacgtgcagcgacnctagcacncggtaacncacgtncta

SEQ ID NO: 243529 - DNA, 542 bp, Homo sapiens
  misc_feature: GYAE6OF02HSH07.37.60.F05.1.454.CMB.1.raw
  modified_base (230)..(230): a, c, t, g, unknown or other
  misc_feature (230)..(230): n is a, c, g, or t
  modified_base (499)..(499): a, c, t, g, unknown or other
  misc_feature (499)..(499): n is a, c, g, or t
  modified_base (501)..(503): a, c, t, g, unknown or other
  misc_feature (501)..(503): n is a, c, g, or t
  modified_base (505)..(506): a, c, t, g, unknown or other
  misc_feature (505)..(506): n is a, c, g, or t
  modified_base (508)..(508): a, c, t, g, unknown or other
  misc_feature (508)..(508): n is a, c, g, or t
  modified_base (510)..(542): a, c, t, g, unknown or other
  misc_feature (510)..(542): n is a, c, g, or t
tcagtagtgtagatcacgaccggtgctcgatttagtacgtcatcagggaaagggcctggagtgggattggatacgtctattatagtgggagcacctactacaacccgtccctcaagagtcgagttttcccatgtcagttgacacgtctaaagaaccaaatctccctcaggctgacctctagtgactgccgcggacacggccgtctattacttgtgacagggtcccaaacngtagttgtccagctgcgattgactacgtgggccacggatcccgtggtcaccgtactcctcgagcctccaccaagggccccatccggtccttaccccccgtggccctaacccctcctaccctaacgacgccaccctcgtcgggggcaacacggccggaccccgtggggcctcggccgtcggtactaagggaccttacgttacccagtcctaacgaccttaacctcggaacgtcggggactacggacgtaacgggcgacgtaagtacggancnnngnnanannnnnnnnnnnnnnnnnnnnnnnnnnnnnnnnn

SEQ ID NO: 243530 - DNA, 746 bp, Homo sapiens
  misc_feature: GYAE6OF02JISKY.37.60.F05.1.454.CMB.1.raw
  modified_base (164)..(164): a, c, t, g, unknown or other
  misc_feature (164)..(164): n is a, c, g, or t
  modified_base (663)..(663): a, c, t, g, unknown or other
  misc_feature (663)..(663): n is a, c, g, or t
  modified_base (666)..(666): a, c, t, g, unknown or other
  misc_feature (666)..(666): n is a, c, g, or t
  modified_base (678)..(678): a, c, t, g, unknown or other
  misc_feature (678)..(678): n is a, c, g, or t
  modified_base (692)..(692): a, c, t, g, unknown or other
  misc_feature (692)..(692): n is a, c, g, or t
  modified_base (699)..(699): a, c, t, g, unknown or other
  misc_feature (699)..(699): n is a, c, g, or t
  modified_base (719)..(719): a, c, t, g, unknown or other
  misc_feature (719)..(719): n is a, c, g, or t
  modified_base (734)..(734): a, c, t, g, unknown or other
  misc_feature (734)..(734): n is a, c, g, or t
  modified_base (742)..(742): a, c, t, g, unknown or other
  misc_feature (742)..(742): n is a, c, g, or t
tcagtagtgtagatcacgaccggtgctcgatttagtacgtcatcagggaaaggggccgtggagtggattggatacgtctattatagtgggagcacctactacaacccgtcctcaagagtcgagtttccatgtcagttgacacgtctaagaccaaatcgtccctnaggctgacctctgtgactgccgcggacaccgggccgttctattacgttgtcgacgagggtccccgaacaggttagttcggttcccgagtccgtaggaccgtacgtttcgaaccttcggtggggccctaacgggactttcccgaagttcggttaccgaacccggttcctcccgttaccgaacggtcccccttaccccgaaaccggtaaaccggggcccccgtaacgttcccgggtttaccccgtttacccccccgttcgggtaccccgtaacccccttcccgttaacccgaaacggtaaccgtcccgtaaacccgtttcccggttaaccgggggggtccctaacgtaacccggccgggtaccccgttcgggggaacttccggcccgttcgggttaaccgacggtaaccgttaaccttccgtaacgtaccgtacctacgtaaccgtggtaccggcggtccgtcggacgaacgggcgtactacgtacggctgacgtcagtancgntcgtcgcacgtntacgctatgcctancgtcagntaacgtcaggccttgacgtntacggctatcgacgntcgacggnactc

SEQ ID NO: 243531 - DNA, 666 bp, Homo sapiens
  misc_feature: GYAE6OF02IJM3R.37.60.F05.1.454.CMB.1.raw
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
  modified_base (303)..(303): a, c, t, g, unknown or other
  misc_feature (303)..(303): n is a, c, g, or t
  modified_base (536)..(536): a, c, t, g, unknown or other
  misc_feature (536)..(536): n is a, c, g, or t
  modified_base (552)..(552): a, c, t, g, unknown or other
  misc_feature (552)..(552): n is a, c, g, or t
  modified_base (561)..(561): a, c, t, g, unknown or other
  misc_feature (561)..(561): n is a, c, g, or t
tcagtagtgtagatcacgaccggtgctcgatttagtacgtcatcagggaagggccgtggagtggattggatacgtctattatagtgggagcacctactacaaccgtccctcaagcgtcgatttccatgtcagttgacacgtctaagaacaatctccctcaggctgacctgtgtgcttgccgcggacncggcctctagttntgtgacgcggtcccgaatagtcgttcgtccaggtctcgcgtaagttcacttacggtcgggactaccggactccgtaagtggttaccaccgtcctcgtccgacnccgtccgaacccgacggtacccagttccgtacccttcccgtggccaccctcgtacccgaagtccgaccgtaccttacggcgggtactacgacggccggtaccgtgggcctcggtccggtaggttaccgaacggtcctaaccgttcaaacttccggtaaacccttacggacccgtttggtaaccggacgggtccgttacggaccggtaacgcccgtgtaaacgtagccggtaancgtacgctactacgtngtacgacgngtacgacgtcgtcgtacgtacgtacgtacgtacgtcgtacgtacgtacgacgtcgtcgtacgacgtcgtacgtcgtacgtacgtacgtacgtactacgtacgtcg

SEQ ID NO: 243532 - DNA, 781 bp, Homo sapiens
  misc_feature: GYAE6OF02GTX5U.37.60.F05.1.454.CMB.1.raw
  modified_base (117)..(117): a, c, t, g, unknown or other
  misc_feature (117)..(117): n is a, c, g, or t
  modified_base (671)..(671): a, c, t, g, unknown or other
  misc_feature (671)..(671): n is a, c, g, or t
  modified_base (680)..(680): a, c, t, g, unknown or other
  misc_feature (680)..(680): n is a, c, g, or t
tcagtagtgtagatcacgaccggtgctcgatttagtacgtcatcagggtaaaggggccgtggagtggattggatacgtctatatagtgggagcacctactacaacccgtcctcaagntcgagtttccatgtcagttgacacgtctaagaaccaaagtctccctcaggtctgacctctgtgactgccgcgaccacggcgtctattatgcgcgacggtaccaacagttagttcgtccagtctcggcgtattcggacttacggttcggggaccctacggtactcccgtaagtccgggtactaacccggtctcccgtacgacgtcccgtaccccaaccggaacgggtcccctaacggttcccgttcccttacccccgtgggaccctaccccgttccgtaccgaaggaccgtcctaaccgtccgggtcggggaaccaccgtaccggcccgggtacccgtacgggtccgtccggtacccggttacgggtaaccggtaacggttacccgttaacccgttacccgtaacgttaccccgttaaacctaacccggttacctaacgggggtacccggggtacccgggttaccggttacggggaaccccggggtaaggtaccccggtacggtaacggtaccggtacgtactacggttaccgagtcgttaacgacgtctaccgngtaacgtcncgttaacggtcgcttcgtacggtctacggttcgtaccgagtacgtaccggtggaactcgttcgacgtacgtcaacgcgttacgacgtacgtcgacgttccg

SEQ ID NO: 243533 - DNA, 766 bp, Homo sapiens
  misc_feature: GYAE6OF02GN4CW.37.60.F05.1.454.CMB.1.raw
  modified_base (744)..(744): a, c, t, g, unknown or other
  misc_feature (744)..(744): n is a, c, g, or t
tcagtagtgtagatcacgaccggtgctcgatttagtacgtcatcagggtaaaggggccgtggagtggattggatacgtctattatagtgggagcacctactacaacccgtcctcaagagtccgagtttccatgtcagttgacacgtctaagacctaaatcgtcctcaggctgacctctgtgactgccgcggactacggccgtctagttagttgtgctacgggtcccgaaccaggttacgttacgttccaggccgtgcggtacttgacgtacgtggggacccacggtataccagttaggtccgtaccggtcctccgtaccgtacgtacccgtcccaaccgtaacggggccccctaagtacccggttccgttccccccgtaggtaccctaccccgtcccgttaaccgaaccggtaaggcccgtaacccgttccgggtaggggggacctacggttaaccggccgggtacccgttggggccgtacggtccgttccgggtaactaacggggtaacctttaccggtaccccacgttaccctaactaaccgttaccgtaggaccggtcgggacgtcgggaacgaaccgggtccgtacggaacgttacgagaccgtagtattcggacttagtaccgagttaccgatttaacgcgttaaccggtaactaccgggtctaacgggttctaaacgtccggttagaccgtaacgttcggacgaccggagttaaccgcgaaccgtgaccggtaccttnaacccggctcgttacgcctccg

SEQ ID NO: 243534 - DNA, 689 bp, Homo sapiens
  misc_feature: GYAE6OF02IQEYJ.37.60.F05.1.454.CMB.1.raw
  modified_base (224)..(224): a, c, t, g, unknown or other
  misc_feature (224)..(224): n is a, c, g, or t
  modified_base (592)..(592): a, c, t, g, unknown or other
  misc_feature (592)..(592): n is a, c, g, or t
  modified_base (599)..(599): a, c, t, g, unknown or other
  misc_feature (599)..(599): n is a, c, g, or t
  modified_base (615)..(615): a, c, t, g, unknown or other
  misc_feature (615)..(615): n is a, c, g, or t
  modified_base (620)..(620): a, c, t, g, unknown or other
  misc_feature (620)..(620): n is a, c, g, or t
  modified_base (624)..(624): a, c, t, g, unknown or other
  misc_feature (624)..(624): n is a, c, g, or t
  modified_base (630)..(630): a, c, t, g, unknown or other
  misc_feature (630)..(630): n is a, c, g, or t
  modified_base (636)..(636): a, c, t, g, unknown or other
  misc_feature (636)..(636): n is a, c, g, or t
  modified_base (641)..(641): a, c, t, g, unknown or other
  misc_feature (641)..(641): n is a, c, g, or t
  modified_base (645)..(645): a, c, t, g, unknown or other
  misc_feature (645)..(645): n is a, c, g, or t
  modified_base (653)..(653): a, c, t, g, unknown or other
  misc_feature (653)..(653): n is a, c, g, or t
  modified_base (666)..(666): a, c, t, g, unknown or other
  misc_feature (666)..(666): n is a, c, g, or t
  modified_base (680)..(680): a, c, t, g, unknown or other
  misc_feature (680)..(680): n is a, c, g, or t
tcagtagtgtagatcacgaccggtgctcgatttagtacgtcatcagggaaggggccgtggagtggattggatacgtctattatagtgggagcacctactacaacccgtcctcaagacgtcgagtttccatgtcagttgacacgtctaagacaaatctcctcaggctgacctcgtgtcgactgccgcggcacggccgtctattagtgtgcgagggtcccgaacgngtagttcgttccgagctgacgattcgactacgtcggggacctacggtactccgtagttcggtaccgtaccgtcttccgtacgacggcccctccgaaacccggaacggggccccctaaggttccccgggttcccttacccccgttcggtacccgtaccccgttacccgttacccgaacgacggtaccctacccggttcgggtacgggtcccgaacgtaaccgggcccggtaacccggtcggggtactaccggtaccgttcggtaccgaacggtaccgtacctttaccgaacttaccctagtacccgtacgtcggaacggtccggtcgtacgggtaaccgaggtaccggtataacggttagccgaaggtnacggttnacgctagtcaggcagngtacngtcncgtcgngtacgngtgcngtancgtacggnagtccgagtacgngtctcggacgttcncgtactgac

SEQ ID NO: 243535 - DNA, 466 bp, Homo sapiens
  misc_feature: GYAE6OF02I037W.37.60.F05.1.454.CMB.1.raw
  modified_base (454)..(466): a, c, t, g, unknown or other
  misc_feature (454)..(466): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagtctgcgattgactacgtggggccacggactcccgtggtccaccgtctcctcagcctccaccaacggccatccggtccttccccctggccaccctccctccaacgacgccaccctcgtcggggccacgacgcccggccgtgggcctcgaccgtggtacaaggcctacgttccattccactacgtactcggacggcggctcggacaaggcgacagtagcnnnnnnnnnnnnn

SEQ ID NO: 243536 - DNA, 724 bp, Homo sapiens
  misc_feature: GYAE6OF02FODGW.37.60.F05.1.454.CMB.1.raw
  modified_base (578)..(578): a, c, t, g, unknown or other
  misc_feature (578)..(578): n is a, c, g, or t
  modified_base (614)..(614): a, c, t, g, unknown or other
  misc_feature (614)..(614): n is a, c, g, or t
tcagtagtgtagatcacgaccggtgctcgatttagtacgtcatcagggtaaaggggccgtggagtggacttggatacggtctattatagtgggagcacctactacaacccgtccctcaagagtcgagtttccactgtcagttgacacgtctaagaaccaaatctccctcaggctgacctctgtgactgccgcggacacggccgtctattattgtgcagggtcccaacagtagttcgttccagcgtgcgattgacctacgtggggaccctacggattccagtcggtacctacccgtcgtccctacacggtcccctccgaaccgaacggggccccctagtcccggttacccttaccccccgttggacccgtaccccttcccgtacccgaaacggtacgcctaacccgttccggtacgggggacctaaccgaccggtacgggccccttggggccttcggtccgtacggtacggaaacgggttaccttacgtaccctacgtacctaacctaccgtaccgtacggaacggccgggtactgggtaccggaaacggtccgacgtaagtaacgcgtactcggtatncggttacagtgtcctacggacgtacttcaggtaccnctttaaggcctacggttaacccgtggtttaacccggcggtacggtgtacgtaacgtacgtaccgtaacgtacgtacgtacgtacggtacgtacgtacgtaccgtacgtcg

SEQ ID NO: 243537 - DNA, 617 bp, Homo sapiens
  misc_feature: GYAE6OF02I6X8T.37.60.F05.1.454.CMB.1.raw
  modified_base (580)..(580): a, c, t, g, unknown or other
  misc_feature (580)..(580): n is a, c, g, or t
  modified_base (582)..(617): a, c, t, g, unknown or other
  misc_feature (582)..(617): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacaccggccgtctattattgtgcagggtcccgaacagttagttcgttccagctgcgattcgactacgtggggccacggactcccgtggtccaccgtcctcctcacgcctaccaacccgaacgggcccctacggtccggttccctttaccccccgtcgggtcccctaaccccctcccgtacccgtaaaggccggaccctacccgttccgggtacggggggacccaaccgtaacggggccccgggtccccggttacgggggctccgggtcccgttcgggtaaccgtaaacggggtaccctttaccgtttacccgaactttacctaaacccgtaccttaacgtcggaacggcccggggtcgtacgggtaccgaacgggccgacggtacgttacggncnnnnnnnnnnnnnnnnnnnnnnnnnnnnnnnnnnnn

SEQ ID NO: 243538 - DNA, 694 bp, Homo sapiens
  misc_feature: GYAE6OF02H8ILE.37.60.F05.1.454.CMB.1.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (643)..(643): a, c, t, g, unknown or other
  misc_feature (643)..(643): n is a, c, g, or t
  modified_base (647)..(647): a, c, t, g, unknown or other
  misc_feature (647)..(647): n is a, c, g, or t
  modified_base (654)..(654): a, c, t, g, unknown or other
  misc_feature (654)..(654): n is a, c, g, or t
  modified_base (656)..(658): a, c, t, g, unknown or other
  misc_feature (656)..(658): n is a, c, g, or t
  modified_base (660)..(661): a, c, t, g, unknown or other
  misc_feature (660)..(661): n is a, c, g, or t
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
  modified_base (667)..(668): a, c, t, g, unknown or other
  misc_feature (667)..(668): n is a, c, g, or t
  modified_base (670)..(672): a, c, t, g, unknown or other
  misc_feature (670)..(672): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
  modified_base (678)..(679): a, c, t, g, unknown or other
  misc_feature (678)..(679): n is a, c, g, or t
  modified_base (681)..(685): a, c, t, g, unknown or other
  misc_feature (681)..(685): n is a, c, g, or t
  modified_base (687)..(687): a, c, t, g, unknown or other
  misc_feature (687)..(687): n is a, c, g, or t
  modified_base (689)..(694): a, c, t, g, unknown or other
  misc_feature (689)..(694): n is a, c, g, or t
tcagtagtgtagatcacgaccggtgctcgatttagtacgtcatcagggaagggcctggagtggattggatacgtctattatagtggtagcacctactacaacccgtccctcaagagtcgagtttccatgtcagttgacacgtctaagaaccaaatctccctcaggctgacctctgtgactgccgcggacacggccgtctattattgngcagggtcccanagtagttntccngctgcgtattgactacgtgggcacggactcccgtggtccaccgtctcctcacgtccctaccaaccgaacggggcccctacgttcccgggttcctttccccccccgttacgggcccctaccccccgttccctaccccgaaacggaccgacccaaccccgtttaccgggttcggggggggcccaaccgtaccggggaccccggggtccccgggttcggggggtcccgtttccgggtcccggtttacggggtaaccgttaaaaccggggaacccttttaaaccccgtttaacccctaacgtttaccgttaaaccctaacctttaaccgtacgggtaaccggggtacccgggggtccttacgggggacccggtaaacggggtcccggtaccgtaaaggttacggctcgtacgcgcncgcncgctcgnannncnncncngnncnnncnananncnnnnncncnnnnnn

SEQ ID NO: 243539 - DNA, 623 bp, Homo sapiens
  misc_feature: GYAE6OF02HADQC.37.60.F05.1.454.CMB.1.raw
  modified_base (233)..(233): a, c, t, g, unknown or other
  misc_feature (233)..(233): n is a, c, g, or t
  modified_base (564)..(564): a, c, t, g, unknown or other
  misc_feature (564)..(564): n is a, c, g, or t
  modified_base (569)..(569): a, c, t, g, unknown or other
  misc_feature (569)..(569): n is a, c, g, or t
  modified_base (575)..(575): a, c, t, g, unknown or other
  misc_feature (575)..(575): n is a, c, g, or t
  modified_base (588)..(588): a, c, t, g, unknown or other
  misc_feature (588)..(588): n is a, c, g, or t
  modified_base (594)..(594): a, c, t, g, unknown or other
  misc_feature (594)..(594): n is a, c, g, or t
  modified_base (603)..(603): a, c, t, g, unknown or other
  misc_feature (603)..(603): n is a, c, g, or t
  modified_base (617)..(617): a, c, t, g, unknown or other
  misc_feature (617)..(617): n is a, c, g, or t
tcagtagtgtagatcacgaccggtgctcgatttagtacgtcatcagggaaaggggccgtggagtggattggatacgtctattatagtgggagcacctacgtacaacccgtccctcaagagtcgagtttccatgtcagttgacacgtctaagaaccaaatctccctcaggctgacctctgtgactgcccgcggtaccacggccgtctattatggtgcgtaacgggtccccgaancgtagttgttccagcttgcgattgacctcgtggggcctaggctccagtcgctaccgtctcgctacgcctccgaccaacgggcccctagtccggtaccttccccgtggtacctaccccgtccgtaccgaaccgtagacccaccgttccggacgggggtaccacggtaccgcggcccgtcgggtctcgttccgtaccggtacgtaacggacgttaccgttcaacgtttcccaactaccgtctacggaggtaccgggtccgtagggaccgtacggacgtaccgaaggtacgatacgcgatacagtctagccagcttagactagtcacgcgcaancgganccgtanggcacggagtccnttacgnacccggtancgtcggactcgtancgcgtc

SEQ ID NO: 243540 - DNA, 847 bp, Homo sapiens
  misc_feature: GYAE6OF02HCOOI.37.60.F05.1.454.CMB.1.raw
tcagtagtgtagatcacgaccggtgctcgatttagtacgtcatcagggaaagggccgtggagtggattggatacgtctattatagtgggagcacctactacaacccgtccctcaagagtcgagtttccactgtcagttgacacgtctaagaccaaatctccctcaggctgacctctgtgactgccgcggacacggccgtctattattggtgcgacgggtcccgaacagtagttgttccagctgcgattcgactacgtcggggccacgggtactccgtaagttcggttccacccgttcgtccctaccgaacggccccttacccgaacccgaaacggggccccctaacgttccccgggttccctttcccccccggttacgggtacccctaaccccccgttacccttacccgaaaacggtaccggtacccctaaacccggttccgggtcggggggtaccctaacccggtaacggggaccccgggtcccccggttacggggcccgttaccggggtccccgttacggggttaacccggtaaacggggtaccctttaacccggtttacccgaaacctttcccgttaaaccaaacccgtttaccgttacgggtaaccggggtccggggtaccggttaccgggtacccgggtaacgggtacccggtacccgtaacgttaacggtcgaacgtccgtaggtcgtactaggtccgtaatacggtacctgtaacggcttacgtaacgacggtcttaacgggcctaaacgttcgtaccgagtaccggttaagaccgttccgaagacgttcgggaactcggttacccggattaccggtacggtcaaccgggttcttacccg

SEQ ID NO: 243541 - DNA, 600 bp, Homo sapiens
  misc_feature: GYAE6OF02IX0QH.37.60.F05.1.454.CMB.1.raw
  modified_base (548)..(548): a, c, t, g, unknown or other
  misc_feature (548)..(548): n is a, c, g, or t
  modified_base (553)..(553): a, c, t, g, unknown or other
  misc_feature (553)..(553): n is a, c, g, or t
  modified_base (559)..(559): a, c, t, g, unknown or other
  misc_feature (559)..(559): n is a, c, g, or t
  modified_base (563)..(564): a, c, t, g, unknown or other
  misc_feature (563)..(564): n is a, c, g, or t
  modified_base (566)..(566): a, c, t, g, unknown or other
  misc_feature (566)..(566): n is a, c, g, or t
  modified_base (568)..(569): a, c, t, g, unknown or other
  misc_feature (568)..(569): n is a, c, g, or t
  modified_base (571)..(583): a, c, t, g, unknown or other
  misc_feature (571)..(583): n is a, c, g, or t
  modified_base (586)..(591): a, c, t, g, unknown or other
  misc_feature (586)..(591): n is a, c, g, or t
  modified_base (593)..(593): a, c, t, g, unknown or other
  misc_feature (593)..(593): n is a, c, g, or t
  modified_base (595)..(600): a, c, t, g, unknown or other
  misc_feature (595)..(600): n is a, c, g, or t
tcagtagtgtagatcacgaccggtgctcgatttagtacgtcatcagggaaagggcctggagtggattggatacgtctattatagtgggagcacctactacaacccgtcctcaagagtcgagtttccatgtcagttgacacgtctaagaaccaaatctccctcaggctgacctctgtgactgccgcggacacggccgtctattattgtgcacgggtccccgaactaggttagttcgttcccgaggtcctagccggtattggacctacgtggggcccacgggactccctggtccaccgtctcctcacgcctccaccaagggcccatccggtccttcccccgtggcctaccctccctcccgaacgacgccaccttacgtcggggggaccacgacggccggtcccgtcggggctcggcccgttacgggtcccgaaacgggtacccttaaccgtttcccgaacttacccgtaaccaaccgttaaccgtccgggaaacggtcccgggggtaccgttaccggggaccgtaaacgggccgtaccgaacgttaacgngctcngctcancganngngnngnnnnnnnnnnnnncgnnnnnngncnnnnnn

SEQ ID NO: 243542 - DNA, 597 bp, Homo sapiens
  misc_feature: GYAE6OF02I51O3.37.60.F05.1.454.CMB.1.raw
  modified_base (160)..(160): a, c, t, g, unknown or other
  misc_feature (160)..(160): n is a, c, g, or t
  modified_base (165)..(165): a, c, t, g, unknown or other
  misc_feature (165)..(165): n is a, c, g, or t
  modified_base (204)..(204): a, c, t, g, unknown or other
  misc_feature (204)..(204): n is a, c, g, or t
  modified_base (526)..(526): a, c, t, g, unknown or other
  misc_feature (526)..(526): n is a, c, g, or t
  modified_base (544)..(545): a, c, t, g, unknown or other
  misc_feature (544)..(545): n is a, c, g, or t
  modified_base (547)..(547): a, c, t, g, unknown or other
  misc_feature (547)..(547): n is a, c, g, or t
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
  modified_base (559)..(561): a, c, t, g, unknown or other
  misc_feature (559)..(561): n is a, c, g, or t
  modified_base (563)..(563): a, c, t, g, unknown or other
  misc_feature (563)..(563): n is a, c, g, or t
  modified_base (569)..(569): a, c, t, g, unknown or other
  misc_feature (569)..(569): n is a, c, g, or t
  modified_base (577)..(577): a, c, t, g, unknown or other
  misc_feature (577)..(577): n is a, c, g, or t
  modified_base (579)..(580): a, c, t, g, unknown or other
  misc_feature (579)..(580): n is a, c, g, or t
  modified_base (582)..(583): a, c, t, g, unknown or other
  misc_feature (582)..(583): n is a, c, g, or t
  modified_base (586)..(586): a, c, t, g, unknown or other
  misc_feature (586)..(586): n is a, c, g, or t
  modified_base (590)..(591): a, c, t, g, unknown or other
  misc_feature (590)..(591): n is a, c, g, or t
  modified_base (593)..(593): a, c, t, g, unknown or other
  misc_feature (593)..(593): n is a, c, g, or t
  modified_base (595)..(596): a, c, t, g, unknown or other
  misc_feature (595)..(596): n is a, c, g, or t
tcagtagtgtagatcacgaccggtgctcgatttagtacgtcatcagggaagggccgtggagtggattggatacgtctattatagtggagcacctactacaacccgtccctcaagagtcgatttccatgtcagttgacacgtctaagaccaaatctccctnaggcngacctctgtgactgccgcggacacggccgtcattattgngactacgggtcccaagagtacgttcgttccgagtcgtgtaccgattcgactacgttcgggggaccacggaactccagttacggtacaaccggttccttccacgacgccaccgaaccgaaggaccctagtaccggtccttcccccgtggtacctaacccgtccgtacaacgggtacaacgcctacgggtcggggtacacggacggtccggaccgtacgggtctcggacgttcgggacaaccgggtactacggttaccaacgttctaaacctacgttaacgcgacggaccgggttacgaggtaaccagggaccagtacgagaanacgttgatagctaacgtnnanatngcanacgannngntagacngacagagngnngnncgngcanncncnnc

SEQ ID NO: 243543 - DNA, 549 bp, Homo sapiens
  misc_feature: GYAE6OF02J1HFT.37.60.F05.1.454.CMB.1.raw
  modified_base (174)..(174): a, c, t, g, unknown or other
  misc_feature (174)..(174): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
  modified_base (508)..(509): a, c, t, g, unknown or other
  misc_feature (508)..(509): n is a, c, g, or t
  modified_base (511)..(512): a, c, t, g, unknown or other
  misc_feature (511)..(512): n is a, c, g, or t
  modified_base (514)..(514): a, c, t, g, unknown or other
  misc_feature (514)..(514): n is a, c, g, or t
  modified_base (517)..(518): a, c, t, g, unknown or other
  misc_feature (517)..(518): n is a, c, g, or t
  modified_base (520)..(520): a, c, t, g, unknown or other
  misc_feature (520)..(520): n is a, c, g, or t
  modified_base (523)..(549): a, c, t, g, unknown or other
  misc_feature (523)..(549): n is a, c, g, or t
tcagtagtgtagatcacgaccggtgctcgatttagtacgtcatcagggaaaggggccgtggagtggattggatacgtctattatagtgggagcacctactacaacccgtccctcaagagtcgagtttccatgcagttgacacgtctaagaccaaatctcctcaggctgacctcngtgactgccgcggtacacggccgtcgtattacgtgtcgacgtcgggtcccgaactcgtagtcgttccacgtcgtgcgattgactacgtcggggcctacggacttccacgtggtccaaccgtcgtacctcacgccgaccaccgaaccgggccagtccggttcctaccccgtcggccaccctcctccaacggtacgccctacctaccgggtggggaccctcgaagccgggtcccagggtccccgggtacgaacgtcgaaagggaccctataccccagtccaaccgttacaaccgttgacggacggccagtacgaacggngntacganacgtacgtnngnngnatnntnagnnnnnnnnnnnnnnnnnnnnnnnnnnn

SEQ ID NO: 243544 - DNA, 577 bp, Homo sapiens
  misc_feature: GYAE6OF02IXNSZ.37.60.F05.1.454.CMB.1.raw
  modified_base (395)..(395): a, c, t, g, unknown or other
  misc_feature (395)..(395): n is a, c, g, or t
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
  modified_base (485)..(485): a, c, t, g, unknown or other
  misc_feature (485)..(485): n is a, c, g, or t
  modified_base (489)..(490): a, c, t, g, unknown or other
  misc_feature (489)..(490): n is a, c, g, or t
  modified_base (493)..(494): a, c, t, g, unknown or other
  misc_feature (493)..(494): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
  modified_base (516)..(516): a, c, t, g, unknown or other
  misc_feature (516)..(516): n is a, c, g, or t
  modified_base (528)..(528): a, c, t, g, unknown or other
  misc_feature (528)..(528): n is a, c, g, or t
  modified_base (533)..(533): a, c, t, g, unknown or other
  misc_feature (533)..(533): n is a, c, g, or t
  modified_base (545)..(545): a, c, t, g, unknown or other
  misc_feature (545)..(545): n is a, c, g, or t
tcagtagtgtagatcacgaccggtgctcgatttagtacgtcatcagggaaaggggcctggagtggattggatacgtctagttatagtgggagcacctactacaacccgtcctcagagtcgagtttccatgtcagttgacacgtctaagaaccaaatcctccctcagggctgacctctgtgactgccgcgacacggcctctattattgtagcgagggtacccaacgagttacgttcgtccgagctcgcgtattcgactacggtggggaccacggtacgtccagtggtcctaccggtctcctcgacggtcctacccaccgaacgggcccagtccgtccttcccccgtggccacccttccgtaccgaacggtacgacctaccgtcggtggggacacgnggccgaccgtggacnggtctcggtanaacggtactactacattccactactacgtagacggcggtactacgggactacggcgacatagcngcanngtnntagnacganctagancgctagntacgaactcganacgtntaacgtcggtanaccgtgactacagcgtacgctatacgcgtatc

SEQ ID NO: 243545 - DNA, 769 bp, Homo sapiens
  misc_feature: GYAE6OF02HD7PX.37.60.F05.1.454.CMB.1.raw
  modified_base (684)..(684): a, c, t, g, unknown or other
  misc_feature (684)..(684): n is a, c, g, or t
  modified_base (694)..(694): a, c, t, g, unknown or other
  misc_feature (694)..(694): n is a, c, g, or t
  modified_base (714)..(714): a, c, t, g, unknown or other
  misc_feature (714)..(714): n is a, c, g, or t
  modified_base (721)..(721): a, c, t, g, unknown or other
  misc_feature (721)..(721): n is a, c, g, or t
  modified_base (725)..(726): a, c, t, g, unknown or other
  misc_feature (725)..(726): n is a, c, g, or t
  modified_base (733)..(733): a, c, t, g, unknown or other
  misc_feature (733)..(733): n is a, c, g, or t
  modified_base (738)..(738): a, c, t, g, unknown or other
  misc_feature (738)..(738): n is a, c, g, or t
  modified_base (747)..(747): a, c, t, g, unknown or other
  misc_feature (747)..(747): n is a, c, g, or t
  modified_base (762)..(762): a, c, t, g, unknown or other
  misc_feature (762)..(762): n is a, c, g, or t
  modified_base (768)..(768): a, c, t, g, unknown or other
  misc_feature (768)..(768): n is a, c, g, or t
tcagtagtgtagatcacgaccggtgctcgatttagtacgtcatcagggaagggcgtggagtggattggatacgtctagttatagtgggagcacctactacaacccgtcctcaacgagtcgagtttccatgtcagttgacacgtctaagaacaaagtctcctcaggctgacctctgtcgactgccgcggacacggccgtctattacgtgtcgcgacgggtcccgaaactacggttagttcgttccgacggccttcggaccgtagtttacgaaccgttaccgtcgggggtaccctaacgggtaactccgtaagttcggtcctaacccggtccttaccgttccgaaaccgtccccgttaacccgaacccggtaaaccgggcccctaaggttacccggttccccgttacccccgttacgggaccccttaaacccccgttccgtaacccgtaaacggtccgacccgttacccggtaccgggttggggaccctacgggtacgggtccccggttccggtaacggggtccctaaacggtcccggttacgggttaaccgtaacgggttacccgtttaaaccgttcccgaatttacccgtaaacgtacccgttaactacgggtacggaccgggtcgtaccgggtacgaaccggaccgtaaccgtaggtacgtacggtacagctagcctagcttntacgcagttnactgtcacgttgactggctnagcgtancgtnnaaccgtntaacnccgggttanacgtcgacgtcgtcncgtacng

SEQ ID NO: 243546 - DNA, 779 bp, Homo sapiens
  misc_feature: GYAE6OF02I0P8L.37.60.F05.1.454.CMB.1.raw
  modified_base (115)..(115): a, c, t, g, unknown or other
  misc_feature (115)..(115): n is a, c, g, or t
  modified_base (675)..(675): a, c, t, g, unknown or other
  misc_feature (675)..(675): n is a, c, g, or t
  modified_base (682)..(682): a, c, t, g, unknown or other
  misc_feature (682)..(682): n is a, c, g, or t
  modified_base (687)..(687): a, c, t, g, unknown or other
  misc_feature (687)..(687): n is a, c, g, or t
  modified_base (698)..(698): a, c, t, g, unknown or other
  misc_feature (698)..(698): n is a, c, g, or t
  modified_base (710)..(710): a, c, t, g, unknown or other
  misc_feature (710)..(710): n is a, c, g, or t
  modified_base (717)..(717): a, c, t, g, unknown or other
  misc_feature (717)..(717): n is a, c, g, or t
  modified_base (728)..(728): a, c, t, g, unknown or other
  misc_feature (728)..(728): n is a, c, g, or t
  modified_base (746)..(746): a, c, t, g, unknown or other
  misc_feature (746)..(746): n is a, c, g, or t
  modified_base (752)..(752): a, c, t, g, unknown or other
  misc_feature (752)..(752): n is a, c, g, or t
tcagtagtgtagatcacgaccggtgctcgatttagtacgtcatcagggaaaggggctggagtggattggatacgtctattatagtgggagcacctactacaacccgtcctcaagngtcgagttttcccattgtcagttgacacgtctaagaaccaaatcctccctcaggcctgacctctgtgactgccgcgaccaccgggccttctatttagtgtcgtacgacggggtaccccaagtaggtttacgttccgttaccaaggccgttagtaccggtaagttttaccggaaccgtttaaccggttcggggggacccctaaccgggtacttacccgtaagtttcggttacccgtacccggtacctttccccgtacggaaccgtcccccgtacccgaacccggtaaaccgggcccccgacggtttacccccgttacccgtttacccccccggtaggtacccccgtacccccgttcccgttaacccggaaaaccggtccgtaacccgtaaccccggttccggggttacgggggtaaccccaacggtaacgggtcccggtccccggttagggtccgtcccgtacgggtcgtaacgaacgttacgttaccctaccagtaccctaacggaacttcgtacgggacggtcgggtacgacggaccgtacgacgtacgtagcaggtcngacgttnacttnatcgcatctancgatcgtcgaanccgttanccgaggtaccntacgcgtacaggttaccncggtanacgtcgtctacgctagtcacgccgtta

SEQ ID NO: 243547 - DNA, 717 bp, Homo sapiens
  misc_feature: GYAE6OF02GYKRX.37.60.F05.1.454.CMB.1.raw
  modified_base (194)..(194): a, c, t, g, unknown or other
  misc_feature (194)..(194): n is a, c, g, or t
  modified_base (229)..(229): a, c, t, g, unknown or other
  misc_feature (229)..(229): n is a, c, g, or t
  modified_base (362)..(362): a, c, t, g, unknown or other
  misc_feature (362)..(362): n is a, c, g, or t
  modified_base (634)..(634): a, c, t, g, unknown or other
  misc_feature (634)..(634): n is a, c, g, or t
  modified_base (638)..(638): a, c, t, g, unknown or other
  misc_feature (638)..(638): n is a, c, g, or t
  modified_base (643)..(643): a, c, t, g, unknown or other
  misc_feature (643)..(643): n is a, c, g, or t
  modified_base (646)..(646): a, c, t, g, unknown or other
  misc_feature (646)..(646): n is a, c, g, or t
  modified_base (650)..(650): a, c, t, g, unknown or other
  misc_feature (650)..(650): n is a, c, g, or t
  modified_base (654)..(654): a, c, t, g, unknown or other
  misc_feature (654)..(654): n is a, c, g, or t
  modified_base (656)..(656): a, c, t, g, unknown or other
  misc_feature (656)..(656): n is a, c, g, or t
  modified_base (663)..(663): a, c, t, g, unknown or other
  misc_feature (663)..(663): n is a, c, g, or t
  modified_base (668)..(668): a, c, t, g, unknown or other
  misc_feature (668)..(668): n is a, c, g, or t
  modified_base (671)..(671): a, c, t, g, unknown or other
  misc_feature (671)..(671): n is a, c, g, or t
  modified_base (675)..(675): a, c, t, g, unknown or other
  misc_feature (675)..(675): n is a, c, g, or t
  modified_base (679)..(679): a, c, t, g, unknown or other
  misc_feature (679)..(679): n is a, c, g, or t
  modified_base (685)..(685): a, c, t, g, unknown or other
  misc_feature (685)..(685): n is a, c, g, or t
tcagtagtgtagatcacgaccggtgctcgatttagtacgtcatcagggaaagggccgtggagtggattggatacgtctattatagtgggagcacctactacaacccgtccctcaagagtcgagtttccactgtcagttgacacgtctaagaaccaaatctccctcaggtctgacctctgtgactgccgcggacncggccgtcgtattagtgtcgcgacgggtcccgaanggtagttcgtccagctgcgagttcgactacgtggggaccaggtactccagtcggtacctaccgtcgtacctacgacgcccgttaccgaaccgaacggggtccccaggtttcccggtccccttttacccccggnggtaccccgtacccccgttacccgttacccggtaaaacgccgggtaaaccctaccccggttacccggggttcggggggaccccttaaacggaaacccggggtccccggggttaaccccgtttcggggaacccgttacggttccgggttaccgggtacggtaaaccggtacccgttaaccgtttcccgaacgtttccctaaaccgtacccgttacggtaacggcgggtccgggtaacttcgggaccgaacgggtccgacgtacgtagcggacnctgnacgtnacngtcngtcngntacgctnacgtntgnacgngcgngcgcgncgcgcgcgcgacgcgtcgtcgtcgcgtcgtcg

SEQ ID NO: 243548 - DNA, 537 bp, Homo sapiens
  misc_feature: GYAE6OF02GZ3V7.37.60.F05.1.454.CMB.1.raw
  modified_base (223)..(223): a, c, t, g, unknown or other
  misc_feature (223)..(223): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
  modified_base (496)..(496): a, c, t, g, unknown or other
  misc_feature (496)..(496): n is a, c, g, or t
  modified_base (505)..(505): a, c, t, g, unknown or other
  misc_feature (505)..(505): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (519)..(520): a, c, t, g, unknown or other
  misc_feature (519)..(520): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
  modified_base (534)..(534): a, c, t, g, unknown or other
  misc_feature (534)..(534): n is a, c, g, or t
tcagtagtgtagatcacgaccggtgctcgatttagtacgtcatcagggaaagggccgtggagtggattggatacgtctagttatagtggagcacctactacaaccgtccctcaagagtcgagttttccatgtcagttgacacgtctaagaaccaaatctccctcaggctgacctctgtgactgccgcggacacggccgtctattattgtgcagggtcccaacngtagttgttccagctgccgattgactactgggccacggatccatcggtcaccgtctcctcacgcctccaccgacgggcccagtccggtccttccccgtggccacccctcgtaccgaacgacgcctaccgttcgcggggtccacacggtccggcccgtgggcctcgccgtggtccaaggtactacttccatcctacactacgtgacgcgggctcgggactaggccgacgacgtagacacgntagntgactgancgtgnacacgtgtnagtcgancgtgcgacntacgntagntcgcnncgntcgncgnctcnacg

SEQ ID NO: 243549 - DNA, 645 bp, Homo sapiens
  misc_feature: GYAE6OF02IFFMK.37.60.F05.1.454.CMB.1.raw
  modified_base (594)..(594): a, c, t, g, unknown or other
  misc_feature (594)..(594): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (606)..(606): a, c, t, g, unknown or other
  misc_feature (606)..(606): n is a, c, g, or t
  modified_base (608)..(609): a, c, t, g, unknown or other
  misc_feature (608)..(609): n is a, c, g, or t
  modified_base (611)..(611): a, c, t, g, unknown or other
  misc_feature (611)..(611): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(629): a, c, t, g, unknown or other
  misc_feature (618)..(629): n is a, c, g, or t
  modified_base (631)..(645): a, c, t, g, unknown or other
  misc_feature (631)..(645): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaaagaaccaaaatctccctcaggctgacctctgtgactgccgcggacacggccgtctattattgtgcgacgggtcccgaaacagttagttcgttccgagcttgacgtaattcgactacggtcggggccaacgggactccgtcggtccgtaccgtcctcctcgacgccctaccaaccgtaaccgggccctacgtcccggttcccgttccccccgtcgtcccgtaccccttacccgaccaacgtaacgccctacccgtcggtaccgggggtcaacccgacggtcccgggtccccggtcggggtcctccggggtccgtcggggttaacgaaaccgggtaaccctttaacccgttcccaacgttacccgtaacctaaccgtttaaccgtcgggtaacgggtcccgggggtcgtacggggacccggtaacgggaccgaccggtaaagttacggncgngngngngcngnngncgncncnnnnnnnnnnnncnnnnnnnnnnnnnnn

SEQ ID NO: 243550 - DNA, 806 bp, Homo sapiens
  misc_feature: GYAE6OF02IY5ZH.37.60.F05.1.454.CMB.1.raw
  modified_base (198)..(198): a, c, t, g, unknown or other
  misc_feature (198)..(198): n is a, c, g, or t
  modified_base (699)..(699): a, c, t, g, unknown or other
  misc_feature (699)..(699): n is a, c, g, or t
  modified_base (710)..(710): a, c, t, g, unknown or other
  misc_feature (710)..(710): n is a, c, g, or t
  modified_base (715)..(715): a, c, t, g, unknown or other
  misc_feature (715)..(715): n is a, c, g, or t
  modified_base (717)..(717): a, c, t, g, unknown or other
  misc_feature (717)..(717): n is a, c, g, or t
  modified_base (719)..(719): a, c, t, g, unknown or other
  misc_feature (719)..(719): n is a, c, g, or t
  modified_base (734)..(734): a, c, t, g, unknown or other
  misc_feature (734)..(734): n is a, c, g, or t
  modified_base (741)..(741): a, c, t, g, unknown or other
  misc_feature (741)..(741): n is a, c, g, or t
  modified_base (745)..(745): a, c, t, g, unknown or other
  misc_feature (745)..(745): n is a, c, g, or t
  modified_base (749)..(749): a, c, t, g, unknown or other
  misc_feature (749)..(749): n is a, c, g, or t
  modified_base (762)..(762): a, c, t, g, unknown or other
  misc_feature (762)..(762): n is a, c, g, or t
  modified_base (768)..(768): a, c, t, g, unknown or other
  misc_feature (768)..(768): n is a, c, g, or t
  modified_base (783)..(783): a, c, t, g, unknown or other
  misc_feature (783)..(783): n is a, c, g, or t
tcagtagtgtagatcacgaccggtgctcgatttagtacgtcatcagggaaagggcctggatggattggatacgtctattatagtgggagcacctactacaacccgtcctcaagagtcgagtttccatgtcagttcgacacgtctaagaaccaatctcctcaggctgactctgtgactgcgcggacacggcgtctattnttggtgctacgggtacccgactaggttagttcgttccaggtcctaggccgtagttcggtaaccttaccgggttcgggggacccaaccggggtacttccccggttagggtccctaaccccggttccttaccccttccgaccgtaccccttaccccgaacccggaaaccgggtccccctaacggtttcccgggttacccccttttacccccccgggttggacccctacccccttacccccgttacccgaaacggtaccggtacccgtaaccccggtttaccgggtccggggggccaaaccggtaccggggtcccggggtccccgggtaccgggccgtttacccgggccccgtttagggtaacccgtaaacgggtttaaccctttaacccgtttaccctacgttacccgttaaaccgtaacgtttaacccgtcggggtaacgggcccgggggtaacccggttagggtacgaaaacgggggtccccctgaaaaccggtttacggntagacgtacanacgtncncngacgtacgagtcacncgacgtntcgnctgngtagtacgcgcgngtagtntagtccgtactgcgntcgtaacgtacggtcgtacgtcg

SEQ ID NO: 243551 - DNA, 462 bp, Homo sapiens
  misc_feature: GYAE6OF02F0QPG.37.60.F05.1.454.CMB.1.raw
  modified_base (223)..(223): a, c, t, g, unknown or other
  misc_feature (223)..(223): n is a, c, g, or t
  modified_base (440)..(462): a, c, t, g, unknown or other
  misc_feature (440)..(462): n is a, c, g, or t
tcagtagtgtagatcacgaccggtgctcgatttagtacgtcatcagggaagggcctggagtggattggatacgtctattatagtgggagcacctactacaacccgtccctcaagagtcgagttttccatgtcagttgacacgtctaagaaccaaatctccctcaggctgacctctgtgactgccgcggacacggccgtctattattgtgcacgggtcccgaanagtagttcgttccagctgcgattgactacgtggggccacggactccctggtcaccgtctcctcacgcctccaccaagggcccatcgcttccccctggccaccctcctccaacgacgcacctcgcgggggcaccgagccggcccgtgggctcgccgtgggtaccaaggtactacgttccatcctacactcgtagagcgggctggacgagcgcatacgnnnnnnnnnnnnnnnnnnnnnnn

SEQ ID NO: 243552 - DNA, 500 bp, Homo sapiens
  misc_feature: GYAE6OF02JADSJ.37.60.F05.1.454.CMB.1.raw
  modified_base (163)..(163): a, c, t, g, unknown or other
  misc_feature (163)..(163): n is a, c, g, or t
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
  modified_base (468)..(469): a, c, t, g, unknown or other
  misc_feature (468)..(469): n is a, c, g, or t
  modified_base (473)..(475): a, c, t, g, unknown or other
  misc_feature (473)..(475): n is a, c, g, or t
  modified_base (477)..(500): a, c, t, g, unknown or other
  misc_feature (477)..(500): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctnaggctgacctccgtgactgccgcggacacggccggtctatattgtgcaggtcccgacagtagttgttccagctgcgattnactactggggccgacggatccctggtcacctcctctcagcctccaccgaacggcccancggtcttccccgtcggcaccctccctcaacgancacctcgtgggggcacaggtccggcccgtcgggctcgtccgtggtaccgaggtaccgtacctttccgactacctaccacttacgtgagggccgggtcgtggtaccggaaggccggtaccagtacggatcagtcnncatnnncnnnnnnnnnnnnnnnnnnnnnnnn

SEQ ID NO: 243553 - DNA, 526 bp, Homo sapiens
  misc_feature: GYAE6OF02IIKHN.37.60.F05.1.454.CMB.1.raw
  modified_base (223)..(223): a, c, t, g, unknown or other
  misc_feature (223)..(223): n is a, c, g, or t
  modified_base (485)..(485): a, c, t, g, unknown or other
  misc_feature (485)..(485): n is a, c, g, or t
  modified_base (487)..(526): a, c, t, g, unknown or other
  misc_feature (487)..(526): n is a, c, g, or t
tcagtagtgtagatcacgaccggtgctcgatttagtacgtcatcagggaagggcctggagtggattggatacgtctattatagtggggagcacctactacaacccgtccctcaagagtcgagtttccatgtcagttgacacgtctaaagaaccaaatctccctcaggctgacctctgtgactgccgcggacacggccgtctattattgtgcagggtcccgaanagtagttgttcccagctgcgattgactacgtggggccacggatccctggtcaccgtctcctcagcctccaccgagggcccatccggtaccttccccccgtggccctaccctccctaccaacggacgccaccttcgcgggggcacgacgccggcccgtgggcctcgccgtgggtccgaaaggtaccttaaccgttcccgaattccctaactactaccctggtaacggcggggtctcggggacaaaggggtcgactagtacgcngnnnnnnnnnnnnnnnnnnnnnnnnnnnnnnnnnnnnnnnn

SEQ ID NO: 243554 - DNA, 484 bp, Homo sapiens
  misc_feature: GYAE6OF02FS5DU.37.60.F05.1.454.CMB.1.raw
  modified_base (367)..(367): a, c, t, g, unknown or other
  misc_feature (367)..(367): n is a, c, g, or t
  modified_base (457)..(484): a, c, t, g, unknown or other
  misc_feature (457)..(484): n is a, c, g, or t
tcagtagtgtagatcacgaccggtgctcgatttagtacgtcatcagggaaagggcctggagtggattggatacgtctattatagtgggagcacctactacaacccgtccctcaagagtcgagttttccatgtcagttgacacgtctaagaaccaaatctccctcaggctgacctctgtgactgccgcggacacggccgtctattattgtgcgagggtcccgaacagtagttcgttccagctgcgattcgactacgtggggccacggactccctggtcaccgtctcctcacgcctccaccgaacgggcccagtccggtccttcccccgtggccacccctccctccaagcgcaccctcgtcggggcacnggccgccgtgggcctcgccgtggtcaacgggtactacgttccatcctacaccgtactggacggtcgggctcgggacaagggcacgatagnnnnnnnnnnnnnnnnnnnnnnnnnnnn

SEQ ID NO: 243555 - DNA, 546 bp, Homo sapiens
  misc_feature: GYAE6OF02HHZFC.37.60.F05.1.454.CMB.1.raw
  modified_base (517)..(546): a, c, t, g, unknown or other
  misc_feature (517)..(546): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaaatcctccctcaggctgacctctgtgactgccgcggacaccggccgtctattattgtcgcgagggtcccgaacgagttagttcgttccagctgcgattgactacgtggggccacggactcccgtggtccaccggtctccctcgagccctaccaccgaacgggccccaagtccggttcccttccccccgtggaccctacccctccctacccaacggacgaccaacccgtcggtcgggggacaccgacggccggccccgtgggcctcggcccgtcgggtacgaaacgggtaccttacgttccctactaccgtaactaccgtaactcggacggtcgggcgtgggaccgaagggcctacgagtacgnnnnnnnnnnnnnnnnnnnnnnnnnnnnnn

SEQ ID NO: 243556 - DNA, 604 bp, Homo sapiens
  misc_feature: GYAE6OF02JDBPT.37.60.F05.1.454.CMB.1.raw
  modified_base (222)..(222): a, c, t, g, unknown or other
  misc_feature (222)..(222): n is a, c, g, or t
  modified_base (561)..(561): a, c, t, g, unknown or other
  misc_feature (561)..(561): n is a, c, g, or t
  modified_base (571)..(604): a, c, t, g, unknown or other
  misc_feature (571)..(604): n is a, c, g, or t
tcagtagtgtagatcacgaccggtgctcgatttagtacgtcatcagggaaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattatgtgcgagggtcccgaanagtacgttgttccagctgcgtattgactacgtggggccacggatccctggtccaccgtctcctcacgcctccaccgaaggcccagtccggttccttcccccgtcggcccaccccgtccctccgaaacgtacggaccctaccgtccgttcggggggcccaacgacggcccgggtcccctcggggggcctcgggtacccgttacggggtacccgaaaaccggggtacccttacccgttacccgtacgttaccccttaaacctaccgttaaacccgttcgggacgggtaccgggggtaccgttccgggaacggtaaaccgggcggtaaccctaaggtaaggncgcactgagnnnnnnnnnnnnnnnnnnnnnnnnnnnnnnnnnn

SEQ ID NO: 243557 - DNA, 583 bp, Homo sapiens
  misc_feature: GYAE6OF02HO142.37.60.F05.1.454.CMB.1.raw
  modified_base (189)..(189): a, c, t, g, unknown or other
  misc_feature (189)..(189): n is a, c, g, or t
  modified_base (221)..(221): a, c, t, g, unknown or other
  misc_feature (221)..(221): n is a, c, g, or t
  modified_base (350)..(350): a, c, t, g, unknown or other
  misc_feature (350)..(350): n is a, c, g, or t
  modified_base (369)..(369): a, c, t, g, unknown or other
  misc_feature (369)..(369): n is a, c, g, or t
  modified_base (454)..(454): a, c, t, g, unknown or other
  misc_feature (454)..(454): n is a, c, g, or t
  modified_base (497)..(498): a, c, t, g, unknown or other
  misc_feature (497)..(498): n is a, c, g, or t
  modified_base (500)..(501): a, c, t, g, unknown or other
  misc_feature (500)..(501): n is a, c, g, or t
  modified_base (503)..(503): a, c, t, g, unknown or other
  misc_feature (503)..(503): n is a, c, g, or t
  modified_base (506)..(506): a, c, t, g, unknown or other
  misc_feature (506)..(506): n is a, c, g, or t
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
  modified_base (541)..(541): a, c, t, g, unknown or other
  misc_feature (541)..(541): n is a, c, g, or t
  modified_base (575)..(575): a, c, t, g, unknown or other
  misc_feature (575)..(575): n is a, c, g, or t
tcagtagtgtagatcacgaccggtgctcgatttagtacgtcatcagggaagggcctggagtggattggatacgtctattatagtgggagcacctactacaaccccgtccctcaagagtcgagttttccatgtcagttgacacgtctaaagaaccaaatctaccctcaggctgacctctgtgactgccgngacacggccgtctattatgtgcaggtcccaantacgttgtccagctgcgaatgactacgtgggaccacggatccctggtaccaccgtctcctcacgcctaccaccgtaacggcccagtccgttccttccccctggaccctaaccccgtcctaccgtaacgngaccaccgtcgtcgggganaccacggccgccgtaggctcgtccgtaggtaccgaagaccgttaccttacgaacttctaactaaccgtactaggtacgccgggtnacggtacgaacgggtaccagtacgtaagtgcgactgactgacnncnncnganctagtacagngacactagacganacanagtactanaagtacgagacgacgacgacgacgacgtacgacncgagtacg

SEQ ID NO: 243558 - DNA, 730 bp, Homo sapiens
  misc_feature: GYAE6OF02I9TKF.37.60.F05.1.454.CMB.1.raw
  modified_base (174)..(174): a, c, t, g, unknown or other
  misc_feature (174)..(174): n is a, c, g, or t
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (628)..(628): a, c, t, g, unknown or other
  misc_feature (628)..(628): n is a, c, g, or t
  modified_base (652)..(652): a, c, t, g, unknown or other
  misc_feature (652)..(652): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctcngtgactgccgcggacacggcctntattatgtagcaggtcccgaactagttagttgttaccagtctgcgtattcggacttacgnggggtaccaacggacttccccgtaggttccaaccgtcctaccttacacggtccctaccaaccgaacggcccgaacgtcggttacccttacccccgtggtaccctaccccttaccctacccgaaacggacgtaccacccgttaccggtcggggggaccaacgacggcccgggtcccgtacggggtcctccgggaccttcgggttaaccgaaacgggtaccttaaccgtttaccgaaccgtttaccgtaactaaacccgttaaccgacgggtaacggtccgggtaccggttaccgggaaccggtaaacgggaccccggtaacgttaacgtaaagggtcctaaagggaccgttccaaggtaaccgacacagacncgacacgacacgacacgtagtacncgcgtacgagacgacgacgtacgacgtacgtacgtacgtacgtacgtacgtactacgacacgtacgtacgtacgtacg

SEQ ID NO: 243559 - DNA, 450 bp, Homo sapiens
  misc_feature: GYAE6OF02GQ2NY.37.60.F05.1.454.CMB.1.raw
  modified_base (404)..(404): a, c, t, g, unknown or other
  misc_feature (404)..(404): n is a, c, g, or t
  modified_base (420)..(421): a, c, t, g, unknown or other
  misc_feature (420)..(421): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (428)..(450): a, c, t, g, unknown or other
  misc_feature (428)..(450): n is a, c, g, or t
tcagtagtgtagatcacgaccggtgctcgatttagtacgtcatcagggaagggcctggagtggattggatacgtctattatagtgggagcacctactacaacccgtccctcaagagtcgagtttccatgtcagttgacacgtctaagaaccaaatctccctcaggctgacctctgtgactgccgcggacacggccgtctattattgtgcagggtcccgaacagtagttgttccagctgcgattgactacgtggggccacggactccctggtcaccgtctcctcagcctccaccaaggcccatcggtccttccccctggccgccctcgcctccaggcgcacctccgagagcacagccggccctgggctgcctggcaaggactactcatctacactactgagcggntggcgaggcgcatcgnngnancgnnnnnnnnnnnnnnnnnnnnnnn

SEQ ID NO: 243560 - DNA, 901 bp, Homo sapiens
  misc_feature: GYAE6OF02GO8KK.37.60.F05.1.454.CMB.1.raw
  modified_base (194)..(194): a, c, t, g, unknown or other
  misc_feature (194)..(194): n is a, c, g, or t
  modified_base (778)..(778): a, c, t, g, unknown or other
  misc_feature (778)..(778): n is a, c, g, or t
tcagtagtgtagatcacgaccggtgctcgattttagtacgtcatcagggaaaggggccgtggagtggattggatacgtctattatagtggagcacctactacaacccgtccctcaagagtcgagtttccatgtcagttgacacgtctaagaccaaatcgtccctcaggctgacctctgtcgactgccgcggacnccggtccgtctagttattgtcgcgagggtcccgaactagtagttcgttccaggcctggacgtacttcgaccttacgtcggggcccaacgggactccagttcgggtacctaaccggtcctaccgttaccgaacggtccccttacccgaaccccgaacgggggacccccctaacggttcccgggttacccctttacccccccggtggggtacccctaaccccccggtttccccgttaacccgaaaacgggtaccggtaccccttaacccgggttcccggttacgggggggtaccctaaaccgggaaccgggtccccgggtccccggttcgggtacccgttacggtaccccggttgggttaacccggtaaacgggtacccgtttaacccggtttacccgtaaactttacccgttaaacccggtaacccgttaacccgtttacgggaaacccgggttcccggggtaccgggtttaccgggttaacccgaaaccggggtttacccggaccgtaaacgggttacggacctaacgtcgtaaaccggtaccgttgtaccgttaacggtcttaccgatacggtacgttaaccnggtcctataccgggttaactacggttcgaacgtccgtaaggtccgttagggaccttacggaacgggtccttaaagcgtttaacgacccgtgggtaactacccgggttgtaccggtacttaccg

SEQ ID NO: 243561 - DNA, 630 bp, Homo sapiens
  misc_feature: GYAE6OF02GP8QA.37.60.F05.1.454.CMB.1.raw
  modified_base (166)..(166): a, c, t, g, unknown or other
  misc_feature (166)..(166): n is a, c, g, or t
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
  modified_base (532)..(532): a, c, t, g, unknown or other
  misc_feature (532)..(532): n is a, c, g, or t
  modified_base (546)..(546): a, c, t, g, unknown or other
  misc_feature (546)..(546): n is a, c, g, or t
  modified_base (570)..(570): a, c, t, g, unknown or other
  misc_feature (570)..(570): n is a, c, g, or t
  modified_base (603)..(603): a, c, t, g, unknown or other
  misc_feature (603)..(603): n is a, c, g, or t
  modified_base (618)..(618): a, c, t, g, unknown or other
  misc_feature (618)..(618): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
tcagtagtgtagatcacgaccggtgctcgatttagtacgtcatcagggtaaagggccgtggagtggattggatacgtctagttatagtggagcacctactacaacccgtccctcaagagtcgagtttccatgtcagttgacacgtctaagaaccaaatctaccctnaggctgacctctgtcgactgccgcggacacggccgtctattntgtgcagggtcccaanagtagttcgtccagctgcgattgactacgngggccaggatccatcgtcacgtctccgtcacgcctccgaccgaacggcccagtccggtaccttcccccgtgtaccaccccgttcccgtaccgaacggacgtaccgtacccgttacggtccgggggtacacccgtaaggccggtcccgtacgggtccgtcggtccgtacggtacgaaacggtacgttaaccgttacccgaagttcccgtaaccaaccgttacgtacggacggtccgggacgttcggaacgtaacgggtccgtaaccgtaagttaacggnacgtagacgcgtancgtatcgatcgatagcgtctgacnccgtgacctgcgcttagacgtccagcgtaacgngtcgcgtcacgtcgnacgtcncngtcg

SEQ ID NO: 243562 - DNA, 736 bp, Homo sapiens
  misc_feature: GYAE6OF02IKD5K.37.60.F05.1.454.CMB.1.raw
  modified_base (680)..(680): a, c, t, g, unknown or other
  misc_feature (680)..(680): n is a, c, g, or t
  modified_base (685)..(685): a, c, t, g, unknown or other
  misc_feature (685)..(685): n is a, c, g, or t
  modified_base (688)..(688): a, c, t, g, unknown or other
  misc_feature (688)..(688): n is a, c, g, or t
  modified_base (690)..(690): a, c, t, g, unknown or other
  misc_feature (690)..(690): n is a, c, g, or t
  modified_base (692)..(693): a, c, t, g, unknown or other
  misc_feature (692)..(693): n is a, c, g, or t
  modified_base (696)..(696): a, c, t, g, unknown or other
  misc_feature (696)..(696): n is a, c, g, or t
  modified_base (698)..(698): a, c, t, g, unknown or other
  misc_feature (698)..(698): n is a, c, g, or t
  modified_base (700)..(700): a, c, t, g, unknown or other
  misc_feature (700)..(700): n is a, c, g, or t
  modified_base (702)..(703): a, c, t, g, unknown or other
  misc_feature (702)..(703): n is a, c, g, or t
  modified_base (706)..(707): a, c, t, g, unknown or other
  misc_feature (706)..(707): n is a, c, g, or t
  modified_base (710)..(711): a, c, t, g, unknown or other
  misc_feature (710)..(711): n is a, c, g, or t
  modified_base (713)..(718): a, c, t, g, unknown or other
  misc_feature (713)..(718): n is a, c, g, or t
  modified_base (722)..(726): a, c, t, g, unknown or other
  misc_feature (722)..(726): n is a, c, g, or t
  modified_base (728)..(731): a, c, t, g, unknown or other
  misc_feature (728)..(731): n is a, c, g, or t
  modified_base (733)..(735): a, c, t, g, unknown or other
  misc_feature (733)..(735): n is a, c, g, or t
tcagtagtgtagatcacgaccggtgctcgatttagtacgtcatcagggaaagggccgtggagtggattggatacgtctattatagtgggagcacctactacaacccgtccctcaagagtcgagttttccatgtcagttgacacgtctaagaaccaaatctccctacaggctgacctctgtgactcgccgcggacacggtccgtactatttacgttgtcgacgacggggttccccgaaacgtaggtttacgtttcggtttcccaggtaccgttggacggtaattttcgaaccgttacggtccgggggtacccaacggggtaccttccccgtcgggttcccgtaacccggttccttccccgttccgaacggtcccctaccccgaacccgaaccggggtcccaacgttcccgggtttccctttcccccccggtcggggtacccctaccccccgttaccccgtaaccgaaacggaccgtacccgtacccgttccgggttacggggggccaaaccggtacgggccccgggtacccggtcggggccttccggcccgtttacggggtacgaaaacgggtacccgtttaaccctttccctaactttaccccgtaaaccgttacctaccgtacgggacgggtccggggttacgtaccgggaaccgtaacgggccgacgtacgtagcgtnacgtngtncncnngcncncncnngcnnacnncnnnnnncgcnnnnngnnnnannnc

SEQ ID NO: 243563 - DNA, 728 bp, Homo sapiens
  misc_feature: GYAE6OF01DGD27.19.52.E08.1.454.CMB.1.raw
tcagtactctcgtgcacgaccggtgctcgatttagtcgagctctctcggcgggggcatcactcaacaaccacatctgtcctctagaagaaaccctgtgagcacagcctcctcaccatggacgtgggccgtggaggactccctccttcgttggtggcagcagctaacaagtcgaccccacctcccgaggtcgctacgtggtgcaggtcggtggggctggagggtagaaggacgggccggtcgggggcctgaggtaggaacggttctccgtgacaagtacgttccgttccggttaccccttaccttaaatttagtatatactagttgggtggacgacgacggaccgtacgtaggacggaacgggcgtcggaggtgggtaggtagggtaggtaggagtttttttttttttttttttttttttttttttaagggaaagggtaaaaggtaaggaaacgaacgaggacgtagtaggacggaggaggtacgtacggacgggacgaggacgtacgacgacgtacggtaccggtaccgggtaccccgtccgtacggtaccggaccgaccgacgtaccgtacgtaggtaggacggacgtacggaaggtaagtacgtacgaccgtaccgtacggacggaccgaccggtaccgttacgttacgttacgtcggtacggacggacggacggacggacgtaagtagtaggtaggtacggacggtaggtacggtggttcgttcg

SEQ ID NO: 243564 - DNA, 619 bp, Homo sapiens
  misc_feature: GYAE6OF01EFEV5.19.52.E08.1.454.CMB.1.raw
  modified_base (471)..(471): a, c, t, g, unknown or other
  misc_feature (471)..(471): n is a, c, g, or t
tcagtactctcgtgcacgaccggtgctcgatttagtcgagctctctcggcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtcgtggggctggacggtgaaggacggccgtcggggcctcgagtcgaacggtctcccgtgactaagccttcgtcggttccccttactaaattttgatatcaagttgggtcgcgacacggccacgtggacgaagggctcggagtggagtgggatggataggaaacggtaaagaggaaacacgaggtctagtgacggtagacgtagttaccgagggacaggacgtccaacgagtcgacggtaccggggacccccttggtcggtcgactacgcgtaccctacgagnggtacgcggtgaacggagtctaggaacctacgtacgggaaggaccgtaccggtccggttacttacgtacgttggtcgtacggaggtaccggccggacgtaagtacgtagggaacgtgggaacggtaggtacgtaggttacgtttcggg

SEQ ID NO: 243565 - DNA, 595 bp, Homo sapiens
  misc_feature: GYAE6OF01AWTP6.19.52.E08.1.454.CMB.1.raw
  modified_base (588)..(588): a, c, t, g, unknown or other
  misc_feature (588)..(588): n is a, c, g, or t
tcagtactctcgtgcacgaccggtgctcgatttagtcgagctctctcggcgggggccatcactcaacaaccacatctgtcctctagagaaaaccctgtgagcacagctcctcaccatggactgggcctggaggatcctcctcttggtggcagcagctacaagtgcccactcccaggtgctactggtgcagtcgtggggctggaggtgaaggaggcctgggggcctgagtgaaggtctcctgcaagcttcgtcgggttccccttactaaaattttgaattatctaagttgggtgcgacacggccacgtggacaagggctcggagtcggagtgggatggataggaaacggtaaaggtgaaacacgagactagtggacggagtagtacgttacggagggacgtaagacgtaccacgtagtcggaccggtccgggggacccctggtacggtccggacacgtacgccctagaggtggacgcgtaaggagtacgtcgacgaccacgtagggacgtaccgcggtaccgtacgttagtcgtgtcgacggtagacggaccgagaattaggagtacgtacggacggtagtcgtcggtnttacggg

SEQ ID NO: 243566 - DNA, 766 bp, Homo sapiens
  misc_feature: GYAE6OF01CL8QO.19.52.E08.1.454.CMB.1.raw
  modified_base (549)..(549): a, c, t, g, unknown or other
  misc_feature (549)..(549): n is a, c, g, or t
  modified_base (561)..(561): a, c, t, g, unknown or other
  misc_feature (561)..(561): n is a, c, g, or t
  modified_base (696)..(696): a, c, t, g, unknown or other
  misc_feature (696)..(696): n is a, c, g, or t
tcagtactctcgtgcacgaccggtgctcgatttagtcgagctctctcggcgggggcatcactcaacaaccacatctgtcctctagacgaaaaccctgtgagcacagcctcctcaccatggacgtgggcctggaggactccttcctcgttggtggcagcagactaacgaagtcgccccactcccgaggtgcttacgtggtgcgagtcggtgggcgtggagggtagaaggcggtccggtcggggcctagaggtaggtaaccggttctccgtagacgtaacgttcctttccggttacccggttttaacccttaacgttaaaagttttcggaaactttacttaccggttaaggttttcggggacgaccggtaacggtaccggtaccggtaacggtacgggaaccggtaaaggggtcccgtaagggtaacggttgggtaaggtacggggtaagttaacgggaagtaaacgggggtaaaaacggttaaacgaaccgggaaacgagggtacggtaacttagggacggacggaaggtactacggtacggaggaacgngtacgccaacgngtacgggacccgtccggggtaccaggttcgtacgaacacgtaacgtccttaaggaggttacggatcgggtaacgtaacgtagtacccaaggtaaccccgtagggtacgaccgggtaccgtaaccgttaccggttntaagttcgtggaccgacggtacgtcgaacggtatagtacggaggtacgagtgtaagtcgttgtctttcgg

SEQ ID NO: 243567 - DNA, 1062 bp, Homo sapiens
  misc_feature: GYAE6OF02J19TO.19.52.E08.1.454.CMB.1.raw
  modified_base (181)..(181): a, c, t, g, unknown or other
  misc_feature (181)..(181): n is a, c, g, or t
tcagtactctcgtgcacgaccggtgctcgatttagtcgagctctctcggcgggggcatcactcaacaaccacatctgtcctctagagaaaccctgtgagcacagctcctcaccagtggactgggcctggaggatcctcctcttggtggctacgcagctacgagtcgcccactccgaggtcncgtacgtcggtcgcgtaggtcgtggggcttacggacgggttcgaacggtacggtcccggtcgggggtcccttacgacgggttacggtaacgggttcccgttacccggtagggtaccgtaaacgggttacccgttttaccggtcccggggtttacccccgtttaacccggtaaaaagttttttccggaaccgtttacggttacccgttaacgttaccgggggttacggtacccggtaaccggtacgggtaccccgtaaccggttaccgggtaacccggtaaaccggggtcccggtttacccgggtaacgggtttaaccgggtaccggtttacggggaacgtttaccgggggtaaccggttaacgggggttaaaaacccgggttaaaaaccggggttaccgggaaaaccggttaccggtaaccgggggttaccgttaacgggttaccgggtaccggggttaaaccgggttacgtaacccggtttaccggtaaccgggtaaccggtaacgggttaacccgggttaccgttaaccccggtacggttacccgggtaacccgggttaacccgggggtaacccccgttacgggttccgggtaacccggggtacccgttaacccgggttaaccggtaccccggtttaacggtaaccgggttaccgggttaccgtacccggttcgggtaaaccgtaccgggttaccggtaccgtaacccggttaccggtacgggtaacgggtaacccgttaccggtacccggttacgttaacgttaccggttacggtacggtaccggttaccggaccgggttacccggacggttaacgtacggttacggtaacggttacggtaaccgggtacgttaccgggtaccgttacggttacccgg

SEQ ID NO: 243568 - DNA, 200 bp, Homo sapiens
  misc_feature: GYAE6OF01BVVDE.52.12.B01.1.454.CMB.1.raw
  modified_base (185)..(200): a, c, t, g, unknown or other
  misc_feature (185)..(200): n is a, c, g, or t
tcagcgcagtacgacacgaccggtgctcgatttagtagtgtagattccgcgggcacgaccggtgctcgatttagtcgagctctctcgcgggcacgaccggtgctcgatttagtcgagctctctcgcgggcacgaccggtgctcgatttagtcgagctctcgtcgcgggctggcaaggcgcatagnnnnnnnnnnnnnnnn

SEQ ID NO: 243569 - DNA, 695 bp, Homo sapiens
  misc_feature: GYAE6OF01B1K2U.52.12.B01.1.454.CMB.1.raw
tcagcgcagtacgacacgaccggtgctcgatttagtagtgtagattcgcagggagctctgagagaggagcccagccctgggattttcaggtgttttcatttggtgatcaggactgaacagagagaactcaccatggtagtttgggctggagcgtggtcgttttctaggtcggtcttaagttttaaaaggtgtccagtgtgaggtgcgagctgctgcgagggtcgggggagcgttggtaacgcggtccggtcgggggggtcccctggaacggtaccgttcctccgtggtcgccgacggtccctcggtggtacttcctaccgtttcgcgtactagtcgaactagtaggcgtccggttcggcccgaccgacggcctaccggaaggaggtcgggtgtagggtaggttcggtactcgtaaggttataaagtcggtagggtaagtaacgtagaattacgtacgactaagttaccgtcggtaacggacggtccgtacgtaccactacgtctacccgagaactaacgtaacttaacgaaacgactaacgtacgtacgttacgaacacgtaaacaagttaaccgaacgtacgtacccgtaaggaacggtaacgaccggaacgacccgtaccgacctaacttacgttcaaacggtaacgaaagactaacacgaacgtacgtaggaacgaacgggtagaaacccgg

SEQ ID NO: 243570 - DNA, 795 bp, Homo sapiens
  misc_feature: GYAE6OF01CV6AU.52.12.B01.1.454.CMB.1.raw
  modified_base (493)..(493): a, c, t, g, unknown or other
  misc_feature (493)..(493): n is a, c, g, or t
tcagcgcagtacgacacgaccggtgctcgatttagtagtgtagattcgcagggagctctgagagaggagcccagccctgggattttcaggtgttttcatttggtgatcaggactgaacagagagaactcaccatggagtttgggctgagcgtgtcgttctaggtcgataatttaaaggctcagtgtgagtgacagtctgctgcgtaggtagggggactcggtttggaacctaaggacccgtaggggggtaccctggaacgacttcgccgtgagaacgttcgaccttagtggtaaactttccggtaacctttccggactttacgtaacgtagtacaggtttacgaccggtacgttaggtccccgaacccgtagggtaccctacgaaggtaagacggggtacctttggaagggttccggtcttaaccggaaggtttaaccgttaaaggttcgggaacgtttagggaaaagttaccgtaatttaacggttaaaccngtaaacggttacccgtgggtaaacgggtccggggaaccctagggtttaccccgtaaacgaaccctttacggtaacccaaccggttaaggtaaaaaccccaagtttacccggaaaaactaacctaacgtacgttacgtaacgtacgtaacgtaaacgtaaacgtacgaacgtacgtacgtacgaacgacggtaccggaacggaaacccgaacccgtttaccgttacgtttaacgttacgttaacgtaaacgtaaaacaaccgtaacaacgtaaccgtaagacggtaacggaaggacgtaaacg

SEQ ID NO: 243571 - DNA, 714 bp, Homo sapiens
  misc_feature: GYAE6OF01EO2RD.52.12.B01.1.454.CMB.1.raw
  modified_base (350)..(350): a, c, t, g, unknown or other
  misc_feature (350)..(350): n is a, c, g, or t
  modified_base (670)..(670): a, c, t, g, unknown or other
  misc_feature (670)..(670): n is a, c, g, or t
tcagcgcagtacgacacgaccggtgctcgatttagtagtgtagattcggcggggagctctgagagaggagcccagccctgggatttttcaggttgttttcattttggtgatcgaggactagaacagagagaactacaccagtggaggtttgggctgagtctggttcttttttcgtgtcggtactttaaagttttaaaggtgtccagtggtggaggtgcagctgcgtgcggtaggggtcgggggagtcgttggtacacgggtccgggttcgggggtcccctaggacgtaccttccgtcgtggtcgactcgcctacgtggtaccttccgtaccgtttcgcgtatagtcgacngtggacgtccggtcgggtacccgcgtacggtcgaccgaagggtacggtggggacggtggtacggttggtacgtagtaagttaagttagtgggtagtaagataatagtacgtacgagtacgtcgtcggaggccggtctctaccgataccgtacgtacgaagaaccgtaactaactaacgaaagtaccctaactcgtttaacagtaacgtacaaactaacgtaaccgaacggtaccgacgtaggacggaccggacggaacgtaccgaccggtacccttaaagttacgttaacgaacggtaaacaaacgtaccaacccgaaanaccggaaggtacggtaacgggacgaaccggtaccgaaaccccgg

SEQ ID NO: 243572 - DNA, 146 bp, Homo sapiens
  misc_feature: GYAE6OF02JDVUH.52.12.B01.1.454.CMB.1.raw
  modified_base (146)..(146): a, c, t, g, unknown or other
  misc_feature (146)..(146): n is a, c, g, or t
tcagcgcagtacgacacgaccggtgctcgatttagtagtgtagattccgcgggcacgaccggtgctcgatttagtcgagctctctcgcgggcacgaccggtgctcgatttagtcgagctctctcgcgggctggcaaggcgcatagn

SEQ ID NO: 243573 - DNA, 691 bp, Homo sapiens
  misc_feature: GYAE6OF02GE5N9.52.12.B01.1.454.CMB.1.raw
  modified_base (477)..(477): a, c, t, g, unknown or other
  misc_feature (477)..(477): n is a, c, g, or t
tcagcgcagtacgacacgaccggtgctcgatttagtagtgtagatttcgtcgggggagcgtctgagacgaggagcccagcccgtgggagttttctacggtgtttttcgatttggtgatcaggactgaacagagagaactcaccatggtagtttggctgagcggttcgtcgttttctagtggtactagttttaaaaggtgtcagtgtagtggtgcgagcgtgctgcggaggtcgggggagccttggtacaggccgtcggggtccctgacgtcctctccgtgtcgacgcgtcctcgtggtacttacctaccttttcgcgttctatgacatgacgcgttgggtcccgccgagggcctaccgaaggtaacgtggggctgggaggttgggtctcgaggttattaagtagggtggtacggaaattacgaagttacgttacgactaagtacgtcgtaggaacggccgtacgttacgaaccggtnttaccctccgaagtaccgaactaacgttaccaaacgtaacaaccaacgtagtactacgtcgaactaaacgtgaaaccagtacccgtaagacggacgtaccgaacggaccgaacccgggtaccaccgtttaacggttaccgtaacgttaaacggtaaaattaaccgtacgtaacgaacgtacggaccgttaggaaccggtacgacgtaaacccgg

SEQ ID NO: 243574 - DNA, 624 bp, Homo sapiens
  misc_feature: GYAE6OF02HO7QN.52.12.B01.1.454.CMB.1.raw
  modified_base (174)..(174): a, c, t, g, unknown or other
  misc_feature (174)..(174): n is a, c, g, or t
  modified_base (187)..(187): a, c, t, g, unknown or other
  misc_feature (187)..(187): n is a, c, g, or t
  modified_base (229)..(229): a, c, t, g, unknown or other
  misc_feature (229)..(229): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
tcagcgcagtacgacacgaccggtgctcgatttagtagtgtagattcggccgggggagcctcgtgacgagaggagtcccagccccttgggattttcaggtgttttcatttggtgatcaggactgaacagagagaactcaccatggagtttgggctgagcggtgtagttctaggngctagttaaaggngtcagtgtgaggtgcgagctgctgcgaggtcgggagctgtcncgccgtggggtccctgacgtctctcctgtcgcagtcctctggattcacctttcgcgtctntcgaactnaggngtcgtggtccgcgaggctctaggatgggntggacgtggctctaggtactaagtgtacgtgaagttacgattacgttaccgccgtaagaccgttccgtaacggaacgggaccctacgttacccaacacttaccacctaagagtaactaacttacgaaagttaaccacgtagtacgttaacgcaggtaccaaacgtgtaaaccgtcgtaaccgttacggaagacgtaccggaaacgaacgttaccgactaaccctagttttcgaacgtacggtaaacaacgttaacaccgtagacggtacgtacggtaacgaggcctaaacccgg

SEQ ID NO: 243575 - DNA, 672 bp, Homo sapiens
  misc_feature: GYAE6OF02I7T1W.52.12.B01.1.454.CMB.1.raw
  modified_base (551)..(551): a, c, t, g, unknown or other
  misc_feature (551)..(551): n is a, c, g, or t
tcagcgcagtacgacacgaccggtgctcgatttagtagtgtagatttcgcggggagctctgtagagaggagccctagccctgggattttcaggtgttttcatttggtgatcaggactgaacagagagaactcgaccatggagtttggctgagctggtctttttcttgtggcttaagttttaaaggtgtccagtgtgaggtgcagctgctgcgaggtcgggggagcgttggtacaggccgtggggggtccctaggacgtaccgtcctccgtgtgcagcctgtgtacttcctaccttcgcgtactagtcgacatgacgcggttcggtccgccgaggcctaccgaggaacgtcgggcgtggaggtcggtcgtacgtaaggttagttaagtaggtaggtaacggtaatactaagttacgtacgtactaacgtaccgttacggtaggaacggtccgtaccttaccgacctacgtcccgtacgaagtaccgtaactaaacttacccgaaagtaacctaacgtaacgttacgttactccgtgaaccaagtacgaaccncgtaccgtagaacggaccgtaaccgacggaacccgaccggaccctacgtttacttaccgtaacgtaaacgaaacctacgaccaacgtacgaacgcccgtaggaacggaccggagaacccgg

SEQ ID NO: 243576 - DNA, 798 bp, Homo sapiens
  misc_feature: GYAE6OF02FMULW.52.12.B01.1.454.CMB.1.raw
tcagcgcagtacgacacgaccggtgctcgatttagtagtgtagatttgcggggagctctgcttcagctgtgagcgcagaaggccggactcgggacaatcttcatcatgacctgctcccctctcctcctcacccttctcattcactgcacagggtcctgggcccagtctgtgttgacgtcagccgcccttcagtgtctcgcgccccaggacaggaggtcacctatcctcctgcttccgtaggaagcagtctaccaacagtttcggactaaattaattttggcgtccctaggtacctacgaccaaccgtcccgaaggtccaacaccgacccccctaaaacgttccctccgtaattttactaccggaaactaacttacggtaactaaaccggttccgaaccccgttcgaaggggtaccttaacccgtaggtaaccccggtaattttcccgtacgtttacgggaccccttaaccgtaaggttcccgttaggtacccgtaccggtttaacccgaaccggtaccccctaccccgggttgggaaccctacgtacccggaacccggtacccttaccggaacggttacccggtaggggggaaccctaacgggtcccgttaaagttttaacggtaccgttaccgggaaccgggtaaccgtaaggtaccggggtaacgttaccggacggtaccggtacccttggtaacgtcggaacgtttccggaaccggttaaggggttccggtttaccggggaccgggtaagggtaaccctaaggccggtaacccgggtccgttaacccggtacggg

SEQ ID NO: 243577 - DNA, 560 bp, Homo sapiens
  misc_feature: GYAE6OF01BPWGU.12.79.H02.1.454.CMB.1.raw
  modified_base (336)..(336): a, c, t, g, unknown or other
  misc_feature (336)..(336): n is a, c, g, or t
  modified_base (468)..(468): a, c, t, g, unknown or other
  misc_feature (468)..(468): n is a, c, g, or t
  modified_base (502)..(502): a, c, t, g, unknown or other
  misc_feature (502)..(502): n is a, c, g, or t
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaaatctcctgcaagtcttctggttacgcactcaccgccaatggtatcagctggctgcgacaggcccctggacaaggtcttgagtggatgtcatggatcagcactttcaatgganacacaaagtatggagagaacttcgagggtcagagtcaccatcgaccactgacagatacaacgaacatacgcctacttggaactggagggcctggacggtctacgacgaccgaccggcccttctatttattgngtacgagtaatttagttttacgttagtttgtttnttgggttggttgttggttgttacgtagttaggttttacgtaccgttggttaccggggg

SEQ ID NO: 243578 - DNA, 571 bp, Homo sapiens
  misc_feature: GYAE6OF01EUXWB.12.79.H02.1.454.CMB.1.raw
  modified_base (415)..(415): a, c, t, g, unknown or other
  misc_feature (415)..(415): n is a, c, g, or t
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgaggtggatggggatggatcgagcgcttacaatggtaacacagactatgcacagaagttcaggacagagtcaccatcgaccacagacacactccacgacgcaaccagccctanagtagggatctaggaggacgccgtaggagactcgtaggaccgacgacgggtccgtagttataccgtggtcgacggtagttagggttttagtgtaattacgtttagttggtaggttgggttacggttacctagtctttacgtttcgggttaccccgg

SEQ ID NO: 243579 - DNA, 740 bp, Homo sapiens
  misc_feature: GYAE6OF01EPDCY.12.79.H02.1.454.CMB.1.raw
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagccgtgggcctcaagtaaaaatcctcctgcaagttcttcgtggttacgcactccaccgccaagtggtatcagctggctgcgacgacggcccctggacaaggttcttggagtggatgtacagtggatcagctactttacaagtgganacaanaaagtagaggaagtacgtaactcggacggacagacgtacacgtaagtaccgacctaagtacgaacaagtactaaacccaaacggtaaacaacgttaaccgacccgtttaacgttacgggaacctaggggtaacccgggtaccgttagggtacccgggttagaaccgggaacccggtaaacccggaccccggttaccctttaacgtttaacgtttacggtttacgttacgggaaccgttaaagttttaaaacgtttttacggttttttaccggttttaagttttccgggtttaggtttggggtttcgggtttgttgggttttacgtttaacgtttaaggttttgggttttaaccgtaaccgggtaggggttttaaccccgggggg

SEQ ID NO: 243580 - DNA, 697 bp, Homo sapiens
  misc_feature: GYAE6OF01BME7Q.12.79.H02.1.454.CMB.1.raw
tcagatacgacgtacacgaccggtgctcgatttagtgtcacacgaagggaaaggggacccaaaaaccacacccctccttgggagaatcccctagatcacagctcctcaccatggactggacctggagcatcctttcttggtgacagtagcaacaggtgtccactcccaggtgcatctggagcagtctggagctgaggtgaaggagccgtggggcctcaagtaaaaatctcctgcaagtcttctggttacgcactcaccgccaatggtatcagctggctgcgacacgccctaggacaaggtctggaggtgtatgtcgtagtggatacgagtctacttacgaagtggacactaacgtaaagtagtagggaagacgtaaccgttccggaggtcaaggtacgtaccaaccgtagtaccgaacccagttacgaactagaactaaccgaaacgaaacctagtaacccgaccttaaggttaacgggaaccgtaggggaccgggttctagggtaacgggttaccctagggaacccggtaacccgtacccgggtacccttttaccgtaaaggttttacgtcggttacggaacgttaaaggttaaactttttacgtttttacggtagttttcggttcggttagggttggttcgttgtttacggttactaaggtttcggttacgaacccggtttgggttacccggggg

SEQ ID NO: 243581 - DNA, 666 bp, Homo sapiens
  misc_feature: GYAE6OF01CUZAM.12.79.H02.1.454.CMB.1.raw
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaaatctcctgcaagtcttctggttacgcactcaccgccaatggtatcagctggctgcgacaggccccctggacaaggtcttggagtggatgtcatggatcagctactttcaagtggagaacacaaagtagtaggagagaacttccgagggtacaggtagtcggccagtcgaccactgaacagatacaaacgaacatacgccttacgttggaacgtggacggggtcctaggacggtcgtacggaacgaccgaccggtcccttacttacgtttaacgtttggtacgtaccgttaaagtaaacgtttttaaacgtttttcggttttaaagtttttcggttttacggtttaggggtttcggggtttaggtttaggtttacggttttaaccgtaaagggtttttcggttttaacgggtaacccgtttaaggggtttaaccccggggggg

SEQ ID NO: 243582 - DNA, 690 bp, Homo sapiens
  misc_feature: GYAE6OF01EQTIA.12.79.H02.1.454.CMB.1.raw
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagccgtggggcctcaagtaaaaatctcctgcaagtcttctggttacgcactcaccgccaatggtatcagctggctgcgacacggccctggacaaggtctgaggtggatgtcagtggatcgagtctactttacaagttaggaacgaacaaacgtaaaggttaagtaggaaagtaacggtaaccgttaccggacgggacgtaggacgtccaacctagtacgaaccctagtacggaacgaagtacgtaaccgaaacgaacctaagtaccgtacccgttacgttacgggaaacgtcgggacggggtcccttagggaccggttcgtacggaaccgaccgtacccgggtaccctttagttaacgtttagtcggtagtaaccggtaatttaaacgttttttacgttttaccggtttagtttcggtttaggttcggggttggttgttcggttagttacgtaagtttggtttacgaccgttggggttacccgggg

SEQ ID NO: 243583 - DNA, 705 bp, Homo sapiens
  misc_feature: GYAE6OF01CNJFW.12.79.H02.1.454.CMB.1.raw
tcagatacgacgtacacgaccggtgctcgatttagtgtcacacgaagggaaagggacccaaaaccacaccctcttggagaatccctagatcacagctcctcaccatggactggacctggagcattccttttcttggtgacagtagcaacaggtgtccactcccaggtgcatctggagcagtctggagctgagggtgaaggagccgtggggcctgaagtaaaaatctcctgctaagttcttcgtggttacgctactcacccgaccaagtggtactcaggtctggactgaccgacgacggccccgtggaccgtaaggtcgttgaggtgatgtctagtggatcagtctactttacaaggtggaagactaaacgtaaagtagtaggagtaacgtaacgttacggaaggtacagacgtacaactagtacgaccacgtacgaacgaagtaacacgaaaacaactaagtacggaccttaacggttacgggaacgttcggggaacgggttcgaggttacggaccgtacggaaccgtaaccgtaccggtacccttagttaacgttggttacgtacgggtaagttaaagttaacgttttaaacgtttttcggtttaagttttcggtttagggttacggggttttgggttacggttttagttcggtttaaacgtaggttttaggtttacgtaccccgggttagggtttacccgggg

SEQ ID NO: 243584 - DNA, 776 bp, Homo sapiens
  misc_feature: GYAE6OF01EA9C2.12.79.H02.1.454.CMB.1.raw
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaagggacgccgtggggcctacgaagtaaaaactcctcctgactaagttcttcgtacggttacgcactccacccgacctaagtggtatcgagtcgtggctgcgacgaccggccccgtggacgtaacggttcgtggacggtggagttcggtacagtggactcacgtacttactttacgaagtaggaacgaacgtaaacgtaaagtacggtaaggaaggtaacggtaaccgttaccggaacgggtacgaacggtaacgtaccgaaccgtaagtaccggaacctacgtaacgaaccgtaaggtaacctaaccgaaaacgtaacacgttaacgtaacccgtttaacgggttacgggaaccggttagggacgggtaccgttagggtaaccggttcgtacggaaccgtaacccggtacccgtcctttaacttagtttacgtaggtacggtaacggtaagttttaacttttagttttaggttttaacgtttcggtttagttcggggttttggtttacggttagttacggtttacgtttaaggtttacggttttaccggtaccggttacggggtttaaccggggg

SEQ ID NO: 243585 - DNA, 774 bp, Homo sapiens
  misc_feature: GYAE6OF01DPD6M.12.79.H02.1.454.CMB.1.raw
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctggaggtgaaggacgtccgtggggcctagaagtaaaaactcctctgactaagtcttctggtacgctactcaccgcaatggtatcagtcgtggctagcgacgacggtcccctaggaacgtaaggttcgttaggaggtaggtatagtctagttaggactacgaacgtacctaacttttacgaaggtaggaacgaaaccgtaaacgtaaaagttaggtacgggaaggtaaacgtaaccttaccgggaagggactaaaggtacgtaccaaaccgtagtacggaaccctacgtaagaaccgtaacggtaactaaccgaaaaccgtaactaacgtaaaccgttacccgttaacggtaacgggtaaccgtaggggtaccgggtaccgttaaggtacgggtaaccgtacggaaaccgtaacccggtacccgtacccgtttaacgttaacgtttagttacggtacgtaacgttaaagtttaagttttaacgtttttacgttaaggtttcgtttcgggttagggtttcggttagttggtttacgttacttaggtttaccggtttacgtaaccggttagggttaccccgggg

SEQ ID NO: 243586 - DNA, 675 bp, Homo sapiens
  misc_feature: GYAE6OF01CRXPB.12.79.H02.1.454.CMB.1.raw
  modified_base (345)..(345): a, c, t, g, unknown or other
  misc_feature (345)..(345): n is a, c, g, or t
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctggaggtgaaggagccgtggggcctcgaagtaaaaatctcctgcaagttcttcgtggttacgcactcaccgcagtggtatcagctggctgcgacacggccctggacaggtctgagtgatgtcagtggatcagtctactttacgaagtggaanaaccgaaagtaaaagtagtagggaagtaacgaacgttaccggaggtacgacggtacgtaccgacgtaacgtacgaaccctagtacgaacaagtacaaccgaaacgtaactagtaaccgtaccttaacgtaggtaacgtagggtaccggggtactagggtaggtaccgtacggaaccggaccgtacccgggtacccttacgtttagttacgttaggtacggtaacgttaaagtttaacttttaagttttaccgtttagtttcggtttgttgggtttggttggttgtttagttacgttaagtttgtttaccggacgttaggttacccggggg

SEQ ID NO: 243587 - DNA, 642 bp, Homo sapiens
  misc_feature: GYAE6OF01B3TI1.12.79.H02.1.454.CMB.1.raw
  modified_base (347)..(347): a, c, t, g, unknown or other
  misc_feature (347)..(347): n is a, c, g, or t
  modified_base (527)..(527): a, c, t, g, unknown or other
  misc_feature (527)..(527): n is a, c, g, or t
  modified_base (540)..(540): a, c, t, g, unknown or other
  misc_feature (540)..(540): n is a, c, g, or t
tcagatacgacgtacacgaccggtgctcgatttagtgtcacacgaagggaaaggggacccaaaaaccacacccctcctgggagaatcccctagatcacagctcctcaccatggactggacctggagcatccttttcttggtgacagtagcaacaggtgtccactcccaggtgcatctggagcagtctggagctgaggtgaaggagccgtggggcctcaagtaaaaatctcctgcaagtcttcgtggttacgctactccaccgcaagtgtatcagctggctgcgacacggcccctggactaggtctgagtggatgtcagtggatccgagtctactttacaagtagganaaccgaataaaggtagaggaagtaacgtaaccgttacggacgggtacaggtacgtaccgaaccgaagtacgacccgtactacggaaacagaactacgaaaccgaactagtaaccgtaccgttacgttacggaacgtagggacgggtccgtaggacggtgtacgacgacgcccgtaccttntattacgtggtanacgtaagttaagtttacgtttacgtttagtttcggtttaggttgggttggttgtttggttactttagtagttttggtacggttacgttgggttaacccgggg

SEQ ID NO: 243588 - DNA, 684 bp, Homo sapiens
  misc_feature: GYAE6OF01CJM0B.12.79.H02.1.454.CMB.1.raw
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagccgtggggcctcagtaaaaaatctcctgcaagtcttctggttacgcactcaccgccaatggtatcagctggctgcgacacggcccctggacaaggtcttggagtggatgtcagtggatcgagctactttcaagtggacgaacaacgtaaagtagtaggaagtacgtaacgttcgaagggcagacgtacaaccgatacgaaccacgtagaacagaactaccgaaacgaacataacgccttaacgttacggaaacttgggaacgggtcctaggacggttaccgtacggaaccgaccgtacccgggtacccttagttaacgtttacggtttcgtacggtaacgttaaggtttaaacttttaaacgtttttcggtttagttttcgggtttacggtttcggggttagggttggtttaggtttacgttttaccgttaaaggtttccggttttaacggtacccgtttaggggtttacccgggggg

SEQ ID NO: 243589 - DNA, 644 bp, Homo sapiens
  misc_feature: GYAE6OF01EP3RD.12.79.H02.1.454.CMB.1.raw
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaaatctcctgcaagtcttctggttacgcactcaccgccaatggtatcagctggctgcgacacggcccctggacaaggtcttgagtggatgtcatggatcagctactttcaagtggaacgacaacaaagtagtggaagacgtaacttcgagggcagacgtaccaacatacgaccagtcgaacagactacaaacgtaacatacgaccttaacgtgggaactggacgggtccctggaacgttcgagaaccggaaccgacccggtacccttattaactttacgtttcggtacgtacggtaaaggtttaactttttagtttttaccgtttaagtttcggtttacgggttgggtttgggtttagttacgggttttagttaccgttaaattttggggttttaccaaccggttagggtttacccgggggg

SEQ ID NO: 243590 - DNA, 768 bp, Homo sapiens
  misc_feature: GYAE6OF01DMKJW.12.79.H02.1.454.CMB.1.raw
  modified_base (335)..(335): a, c, t, g, unknown or other
  misc_feature (335)..(335): n is a, c, g, or t
  modified_base (719)..(719): a, c, t, g, unknown or other
  misc_feature (719)..(719): n is a, c, g, or t
  modified_base (752)..(752): a, c, t, g, unknown or other
  misc_feature (752)..(752): n is a, c, g, or t
tcagatacgacgtacacgaccggtgctcgatttagtgtcacacgaagggaaaggggacccaaaaaccacacccctccttgggagaatccctagatcacagctcctcaccatggactggacctggagcattccttttcttggtgacagtagcaacaggtcgtccactcccgaggtgcatcgtggacgcaggtcgtggagcgtggaggtaggaagggacgccgtggggacctacgaaagtaaaaactcctacgtacgactaacgttcttacgttacggttacgacctacgttccgaacccggtacctaaaggttcggtactcggacgtcgtcggtcncggaccgaccgacgggtaccccgtaggaaccgtaggttcgttaggacgtggtatgtcaggtggactagactctacgttacaagtcggaacgaacaacgtaaagtacgtaggaagaacgtacgtacggaggacacgactacgaacgtacgtaacaaccgtagacggaactaagaaccgtaacaaacggtaaatacggtacctaacgttaacgaagggtaaccggtacgggaacggggttccctagggtaacggttccgaacgggaccggtaacccgtccggttaacctttagtttaaattcgggtttacacgggtaaacgttaacgttttaagttttacgttttacggttagttttcggtagtttagggtttggtttaacggttnttacggttacgtttaggttacgttttaaccggngttcggggtaccgggg

SEQ ID NO: 243591 - DNA, 620 bp, Homo sapiens
  misc_feature: GYAE6OF01BRWJF.12.79.H02.1.454.CMB.1.raw
  modified_base (320)..(321): a, c, t, g, unknown or other
  misc_feature (320)..(321): n is a, c, g, or t
  modified_base (360)..(360): a, c, t, g, unknown or other
  misc_feature (360)..(360): n is a, c, g, or t
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctggagggtgaagggagccgtggggcctacgaagtaaaaatctcctgacaagttcttcgtggtacgcactcaccgcaatggtatcagctggctgcgacgcggccctggactaggtctggagtgatgtnnggatcagctattacaagtggagacaagaagtagtagganacgtaacgtcggaggcaaggactacacagtcgactacgtagacagactaacgaaacgaacgtactacgtacccgtaacgttacgggaacgtgggtaccgggtacctagggtacggtcgtacggaaccgacgtacccggtacccttagttactttagtcgtacgaacgtagtttaaacttttagtttcgttttaagttcggtttaggttgggttggttggttgttagttacgtagtttcgttacgtacgtggttaccgggg

SEQ ID NO: 243592 - DNA, 640 bp, Homo sapiens
  misc_feature: GYAE6OF01EKA49.12.79.H02.1.454.CMB.1.raw
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagccgtggggcctcgaagtaaaaatctacctgacaagtcttcgtggttacgcactcaccgccatgtatcagctggctgcgacgacggccctgacgtaaggtcttaggagtggatgtctagtgatcagctattacaagtcgacgacgaacgaagtagtaggagacgtaacgttacgaggtcaagtacgtaccgaacgtacgtacgaacctagtacggaacagtactaaccgaaacggaatacgtaacgtccccttaaaggtacggtaacgacgggtacgggtaccctggtaaccggtctacggaacgtaccggtaccgtcccttatttaggttctggtacgagtaacttaatttttaccgttagtttagttcggttacgtgggtttaggtcgttagttacgttaacgtagtttgttaacgtgtagggttacccgggg

SEQ ID NO: 243593 - DNA, 776 bp, Homo sapiens
  misc_feature: GYAE6OF01EB6BQ.12.79.H02.1.454.CMB.1.raw
  modified_base (502)..(502): a, c, t, g, unknown or other
  misc_feature (502)..(502): n is a, c, g, or t
  modified_base (531)..(531): a, c, t, g, unknown or other
  misc_feature (531)..(531): n is a, c, g, or t
  modified_base (548)..(548): a, c, t, g, unknown or other
  misc_feature (548)..(548): n is a, c, g, or t
tcagatacgacgtacacgaccggtgctcgatttagtgtcacacgaagggaaagggacccaaaaaccacacccctccttgggagaatcccctagatcacagcctcctcaccatggactggacctggagcatccttttcttggtgacagtagcaacaggtgtccactcccaggtgcatctggagcagtctggagcgtgaggtgaagggacgccgtggggaccctagaagttaaaaacgtcctcctagtaccgtaagttctttaccgttcggttaaccgccgtacccttaccgaccccgacctaagttcggttactcgaacgtcgtcggcgtacgacgaccgaccggccccgtagaacgtacgttcgttggacggtggtattcgtacgtagtacggactcgtaacgtccttaactttacgaacggtagaaccgaactaaacggtaagttaacgtaggaacgtaacgtaaccgttacggaggacgtacggacgtaaccaaccgtanaccgtaaccgaacgtacgaaccggtaacncgttaaaacccggaaanaccgtaacgttaactaccggtttacgtagggttaaccgacggggtaggttccggtaggtactacggcgaaacccgcgtaccccgttacttacttagtttcgaggtacgtacttaaagttacgttttttaagtcggtttttaagtttcggtttcggttagggttgtttacgtttggttaacttacggtttaacgtttcgggttaaacttcggggtaccgttaccggggg

SEQ ID NO: 243594 - DNA, 932 bp, Homo sapiens
  misc_feature: GYAE6OF01BXXQM.12.79.H02.1.454.CMB.1.raw
tcagatacgacgtacacgaccggtgctcgatttagtgtcacacgaagggaaaggggacccaaaaaccacacccctccttgggagaatcccctagatcacagctcctcaccatggactggacctggagcatccttttctggtgacagtagcaacaggtgtccactcccaggtgcatctggagcagtctggagctgaggtgaaggagccgtggggcctacgaagtaaaaatctctgcaagtcttctggtacgcactcaccgccaatggtatcagctggctgcgacacggccccgtggacaaggtctgagtggatgtacagtggatcacggtacctaacttttacgaaagtgggaaacgtaaccgaaacgtaaaaaggttagtaggggaaagaaacggtaaaccctttacccggaaggggactaaacgggtaacgtacccgtaaacccgtaggttaaccgaaaccccgtaacgtaaccggtaaacccgaagtaaccttaaaccggaaaaaccgtaaaaccgtaaacgttaaccggttaaacccgttaaccgtttaacgggaaaccggttacggggtaaaccgggggtacccgtttaacgggtaacgggttacccgtaacgggtaaacccggtaaacccgggtaacccccgggttaacccccgtttaacgtttaaaccggttttaacggtttacgggttaaccgggttaacccggtttaaaaacgggttttaaaaacgttttttaaaacgggtttttttaacccggttttaagggtttttttaacccgggttttacggggttttaacgggggttttagggggtttttcggttttaacggggtttttaacgtttttaacccgggttaaaggttttttacccgggttttttaccgggtaaaacccggtttaacggggggttttaaacccccggggggg

SEQ ID NO: 243595 - DNA, 740 bp, Homo sapiens
  misc_feature: GYAE6OF01DEEVX.12.79.H02.1.454.CMB.1.raw
  modified_base (183)..(183): a, c, t, g, unknown or other
  misc_feature (183)..(183): n is a, c, g, or t
  modified_base (329)..(329): a, c, t, g, unknown or other
  misc_feature (329)..(329): n is a, c, g, or t
  modified_base (399)..(399): a, c, t, g, unknown or other
  misc_feature (399)..(399): n is a, c, g, or t
tcagatacgacgtacacgaccggtgctcgatttagtgtcacacgaagggaaggggacccaaaacacacccctccttgggagaactccctagatcacagcctcctccaccatggactggacctggagctattcctttttctggtcgacagtagcaacacggtgtccactcccaggtcgcatcgnggagcagtcgtggacgtcgtaggaggtaggaacgggcgtccggtcggggccctagtaaaggttaaaactccgtaccgtcgacgtaacggttcttcgttacgggttaccactacctcgaccgacaagtggtactcgagcgtcggcgngccgacgtcggtacccgtaggacgttaggtccgttggacgtaggtagttaggtacctaggtacggtaacncgtacgtaccttacgtttaagaacggtaggaacgttaaacgtaaagtaaggtaggagggactaacggttaccgccggagggacttacgggacgtccggactaggtaccaaccgtaggacgaacaagtacaaccgaacgttaacacgttacgtaccgttacgacggtatacgggacgtccgtggctaccgtcggaacctaccgggaccttccgtacttagttacgtgtacgaagttacgttaagtttccgttagtttacgttggtttccgttagggtttcggttagttacgttcggtttacgttaggtttacggttaccgttacccggtggtaccccggggg

SEQ ID NO: 243596 - DNA, 740 bp, Homo sapiens
  misc_feature: GYAE6OF01EXRSA.12.79.H02.1.454.CMB.1.raw
  modified_base (209)..(209): a, c, t, g, unknown or other
  misc_feature (209)..(209): n is a, c, g, or t
  modified_base (384)..(384): a, c, t, g, unknown or other
  misc_feature (384)..(384): n is a, c, g, or t
tcagatacgacgtacacgaccggtgctcgatttagtgtcacacgaagggaaagggacccaaaaaccacacccctccttgggagaatcccctagatcacagctcctcaccatggactggacctggagctattccttttcttggtgacagtagcaacaggtgtccactcccaggtgcatctggagctagtcgtggagctgagggtgaaggngccgtggggcctagaaagtaaaactctcctgactaagttcttcgtggttaccgctactccgacccgaccaagtggtactacgacgtcgtaggctgccgtaaccgcggtaccccgtaggacgtaaggttcgtgaggtggtatgtctagtggatcagtcctacttagaagtaggaanaacaagtaaagtagaggtaacgtaacgtaaccgtacggaggactaaggtacctacgacaacgttaccgaactaacgacgaactaataacctaacgaaaaacaaacgttaactaaccgttaccgtaacgtacggttacgaggggtaaccggtcggaagttaccggtaacgtaccgaaccggtacccgtacccggtcccgttaaagttatttacggtgtacgttaaacggtaaaggttttaaacttttttacggtttaccggtttagttttccggttacggtttaggggtggttttattaaggtttacttaacgggtttacgtttacggttacccgtacgggtttcggtaacccgggg

SEQ ID NO: 243597 - DNA, 542 bp, Homo sapiens
  misc_feature: GYAE6OF02FGJP6.12.79.H02.1.454.CMB.1.raw
  modified_base (346)..(346): a, c, t, g, unknown or other
  misc_feature (346)..(346): n is a, c, g, or t
tcagatacgacgtacacgaccggtgctcgatttagtgtcacacgaagggaaaggggacccaaaaaccacacccctccttgggagaatcccctagatcacagctcctcaccatggactggacctggagcatccttttctggtgacagtagcaacaggtgtccactcccaggtgcatctggagcagtctggagctgaggtgaaggagcctggggcctcagtaaaaatctcctgcaagtcttctggttacgcactcaccgccaatggtatcagctggctgcgacaggccccctggacaaggtcttagagtggatgtcatggatcagcactttcaatggagacacaagtntggagagaacttccagggtcagacgtacaccagtcgaccactgactagaactcaaacgaacatacgacctacgttggaactggacggggcctggacggtctagaccgacgaccggccctctatttacgtgtgcgtagtaatttatttcgtatttcggtctggtgtgtgttgtctaattgttcgactagttacgggg

SEQ ID NO: 243598 - DNA, 660 bp, Homo sapiens
  misc_feature: GYAE6OF02GFL8P.12.79.H02.1.454.CMB.1.raw
  modified_base (338)..(338): a, c, t, g, unknown or other
  misc_feature (338)..(338): n is a, c, g, or t
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaaatctcctgcaagtcttctggttacgcactcaccgccaatggtatcagctggctgcgacaggccccctggacaaggtctgagtggatgtcagtggatcagctactttcaatgganacacaaagtatggagagactcgaggcagagtcacatgaccatagacagactacgaacgaacagtacgcctaacttaggaacgtggacggggtccgtagacggtcgtacggacgtaaccgaccgggtcccttacgttaacgtttacgtttcggtacggtaccgtaaagttaaacgtttttaacgtttttacggttttaacgtttttcgggttttaccggtttagggggtttcgggtttaggttttacgggtttacggttttaccgtttaaaaggttttcggggttttttaacgtaacccggttaggttttaacccgggggggg

SEQ ID NO: 243599 - DNA, 716 bp, Homo sapiens
  misc_feature: GYAE6OF02JYD2T.12.79.H02.1.454.CMB.1.raw
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaaatctcctgcaagtcttctggttacgcactcaccgccaatggtatcagctggctgcgacacggccctggacaaggtcttggagtggatgtcagtggatcagctacgtttcaagtggacgtaacaacgtaaagtagtaggaacgaagtaaacccgttaccgaaggggacaacggtacggtaccaaccgaactacggaaccctacgtacggaacaaggtaactaccgaaaacggtaaactaacgttaacggacccttaaacgttagggaaaccgttagggacggggtaccctagggtacgggtacgttaggaacccgtaccgaccgggtacccttcgttaacgtttacgtttcggacgttaaccggtaagttaaacgtttttaaacgtttttcggttttaacgttacgggttttcttaacgggggttggttaggtttacggttgttttaacgttaaggtttggttttaccggtaaccggttaggtttaccggggg

SEQ ID NO: 243600 - DNA, 653 bp, Homo sapiens
  misc_feature: GYAE6OF02GH1FA.12.79.H02.1.454.CMB.1.raw
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctaggttacgcactcaccgccaatggtatcagcgtggctgcgaacacggcccccgtggacaaggtcttaggagtcggatgtcatggatcagtcactttcaagtggagaccacaaagtataggagaagaacgttaccgagggcaagaggtacacctagacgtaccacgtagaacagaactacaaacgaacagtaacgaccttaacgttaggaaccttagggacgggtacctggaaggttctaggaaccgtaacgacccggtacccttacgttaagtttaaccttggtacggtaacgtaaccggttaattttaacgtttttacggtttaattttgggttaccggtttaggggttaggttcgttaggtttaggttacgtaacgtttgggtttacgttacccgtagtttaccgggggg

SEQ ID NO: 243601 - DNA, 647 bp, Homo sapiens
  misc_feature: GYAE6OF02GBDFB.12.79.H02.1.454.CMB.1.raw
  modified_base (343)..(343): a, c, t, g, unknown or other
  misc_feature (343)..(343): n is a, c, g, or t
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaaatctcctgcaagtcttctggttacgcactcaccgccaatggtatcagctggctgcgacaggcccctggacaaggtcttgagtggatgtcatggatcagcactttacaagtggagacaanaaagtataggagagaacttccgagggacagacgtacaccatcgaaccacgtacgaacgtagaactaacgaaaccgaactaactacgacccttaacgttggaaacgtgggacggggtcctaggtaacgggtctacggaccggaaccgacccgggtcccttacgtaatttaagttggttacgacggtaagttaacgttttaacgtttttaccggtttaagttttcggttacgtttaggggttagggtttggtaggtttcggtttacgtaagtttcggttttacgtaccgttagggttacccggggg

SEQ ID NO: 243602 - DNA, 823 bp, Homo sapiens
  misc_feature: GYAE6OF02GD7OV.12.79.H02.1.454.CMB.1.raw
tcagatacgacgtacacgaccggtgctcgatttagtgtcacacgaagggaaaggggacccaaaaaccacacccctccttgggagaatcccctagatcacagctcctcaccatggactggacctggagcatccttttctggtgacaggtagcaacaggtgtccactcccaggtgcatcgtggagcagtcgtggagctggaggtaggaaggacgccggtggggcctacgaaagtaaaatcctcgtgactaacgttcttcgttaggttacgcctactccgacccgacagtggtactacgacgtcgtggctacggacgaccgaccggtcccgtaggacgtaagggttctaggacggtggtagtcggtacgtaggtaggactcgtacggtacctttaacgtttacgaagttacgggaaccgaaacgtaaacgtaaaaggttacggtaacgggtaaaggtaaaccggtttaaaccccggttaccgggaacgggtaacgtaagggtaacccgtaacccaaccggttaacgtaaccggtaaccccttaaggaccgtaaacggtaacgttaactaacccgggaaaactaacgtacgtaaccgtacccgttaaacgttacgggaaacgtcgggtaacgggcttaagggcggttaccggaagaacccgacgggtaccccgtccttaagttaacgtttacgtggtaacggtacgttaaagtttaacttttttacgtttaccgttttaggttcgtttcgggttacggttcggttaggtttagtttacccgttagtttaaccggttggtttacccggtaggtaaccgggttccgggg

SEQ ID NO: 243603 - DNA, 736 bp, Homo sapiens
  misc_feature: GYAE6OF02JKZSG.12.79.H02.1.454.CMB.1.raw
  modified_base (348)..(348): a, c, t, g, unknown or other
  misc_feature (348)..(348): n is a, c, g, or t
  modified_base (363)..(363): a, c, t, g, unknown or other
  misc_feature (363)..(363): n is a, c, g, or t
tcagatacgacgtacacgaccggtgctcgatttagtgtcacacgaagggaaaggggacccaaaaaccaacacccctccttgggagaatcccctagatcacagctcctcaccatggactggacctggagcatccttttcttggtgacagtagcaacaggtgtccactcccaggtgcatctggagcagtctgggagctgaggtgaagggagccgtggggcctcagtaaaaatcgtcctgcaagttcttctcggttacgcacttccaccgccaatcggtatcaagtctaggctgtcgacgacggccccgtcggacgaggtcttggagtggatcgtcgatgggatcgagtcnctttacaagtggaanacaactaaaggtacagggagtaacaacgttacgagggtacaggtacgtaccgaactacgtacgacccgtaacgtcgaaacgagttaaacgtaacccaaaacggtaaacctaagttacgtaacccgttaagtttacgggaaacgttacgggaacggggtcctaaagggttcggtacccgtaagggaaccgtaccgtaccggtaccccgttatttaacgtttgttaaccggtacggacgttaaattaaaccggttttttaacgtttttaacgttgtttttaaccgggtttcggttaggggttcggttttacggtttcggtttagtttaccggtaagtttttaggtttaccctacgggttacggttaacccggggg

SEQ ID NO: 243604 - DNA, 694 bp, Homo sapiens
  misc_feature: GYAE6OF02HGHPI.12.79.H02.1.454.CMB.1.raw
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (677)..(677): a, c, t, g, unknown or other
  misc_feature (677)..(677): n is a, c, g, or t
tcagatacgacgtacacgaccggtgctcgatttagtgtcacacgaagggaaaggggacccaaaaaaccacacccctccttgggagaatcccctagatcacagctcctcaccatggactggacctggagcattccttttcttggtgacagtagcaacaggtgtccactcccaggtgcatctggagcagtcgtgggagctgaggtggaaggagccgtggggcctcgaagtaaaaatcctcctgactaagtcttcgtggttacgcactccgaccgcctaagtggtatcagtcgtggctcgcgacgacggccccgtaggactaaggtctggagtggtatgtanagtggatcgancttacttacttaaggnggaacgaacaaacgtaaagtagtagggaacgtaacgtaacgttccggagggacgaaggtacgtaaccaacgtagtaccgaaccagttacggaaactaggtaactaaccgaaaacggtaacaacgttaccgttaaccgtacgtaggaaacggtcgggaacgggtaccttgggaacggtccgtaacggaacggacccaccggtccttaagttaatttcgtgtagaccgttaaatttaactttttagttttcgtaggtttcgtttacggtgggttagtcgtttagttacgtttacttaaggtttccggttaacnggttaggtaacccgggg

SEQ ID NO: 243605 - DNA, 631 bp, Homo sapiens
  misc_feature: GYAE6OF02HXUF8.12.79.H02.1.454.CMB.1.raw
  modified_base (400)..(400): a, c, t, g, unknown or other
  misc_feature (400)..(400): n is a, c, g, or t
  modified_base (536)..(536): a, c, t, g, unknown or other
  misc_feature (536)..(536): n is a, c, g, or t
  modified_base (570)..(570): a, c, t, g, unknown or other
  misc_feature (570)..(570): n is a, c, g, or t
  modified_base (602)..(602): a, c, t, g, unknown or other
  misc_feature (602)..(602): n is a, c, g, or t
tcagatacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaggagccgtggggcctcagtaaaaatctcctgcaagtcttctggttacgcactcaccgcaatggtatcgagctggctgccgtacacggccctggaactaaggtccttagtacggtggtagtcgtcattgggactcaaggtctactttcaagtcggaacgactaaacgaagtagtacggagaaggaaacgttccgaagggntaaggactaccgaacagtacgacctatgaacaggtactacgaaacgtaactaagtacgtccgtaacttagggaaccttgggaacggggtccctagggacggtacgtagaacgaaccttacggcccttactaagttnttcggtaggactacggtaattttagtttccgttntacggtttcagggttggttattggtaacgttnttaagtcggtttcaccgttggtaccgggg

SEQ ID NO: 243606 - DNA, 655 bp, Homo sapiens
  misc_feature: GYAE6OF02IZS8Q.12.79.H02.1.454.CMB.1.raw
  modified_base (252)..(252): a, c, t, g, unknown or other
  misc_feature (252)..(252): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
  modified_base (447)..(447): a, c, t, g, unknown or other
  misc_feature (447)..(447): n is a, c, g, or t
  modified_base (605)..(605): a, c, t, g, unknown or other
  misc_feature (605)..(605): n is a, c, g, or t
  modified_base (641)..(641): a, c, t, g, unknown or other
  misc_feature (641)..(641): n is a, c, g, or t
tcagatacgacgtacacgaccggtgctcgatttagtgtcacacgaagggaaaggggacccaaaaaccacacccctccttgggagaatcccctagatcacagctcctcaccatggactggacctggagcattccttttcttggtgacagtagcaacaggtgtccactcccaggtgcatctggagcagtctggagctgaggtgaaggagccgtggggcctcaagtaaaatctctgcaagtcttctgggttaccncactcaccgccaagtggtatcgagctggctgacgacncggccccnggactaggtctaggacggtggtactggtnagtgacacganacgtacttagaagtggaanacgaataaggtatagggagaacgtaccgttacgagggacacggtactaccgaacagtccgacacgtagaaccagactaacgaacgtaaacntaacgtccttaaagtaccggaaatgggtaccgggacgttggtaacggtctaacgggaacctaacccggccgtaacccttattaacgtttaacgtcgtagaaccgggttattaaagtttttacgtttggttaagtttcgttaacgtggggtttacggtntttacgtggttttactaacgtttggttacgtacggnggttaacccggggg

SEQ ID NO: 243607 - DNA, 686 bp, Homo sapiens
  misc_feature: GYAE6OF02I2AKI.12.79.H02.1.454.CMB.1.raw
  modified_base (193)..(193): a, c, t, g, unknown or other
  misc_feature (193)..(193): n is a, c, g, or t
tcagatacgacgtacacgaccggtgctcgatttagtgtcacacgaagggaaaggggacccaaaaaaccacacccctccttgggagaatcccctagatcacagctcctcaccatggactggacctggagcatccttttcttggtgacagtagcaacaggtgtccactcccaggtgcatctggagcagtctgganctggaggtgaaggagccgtggggcctcaagtaaaaatcctctgcaagtcttctgttacgcactcaccgccaatggtatcagctggctgcgacgacgcccctggacgtaaggtcttggagtggatgcatggatcgagtctactttcaagtggaacacgaacgaaagtagtaggaagagtaacgttacgaggggtacaagtacgtacaaccgtacgtacgtaaccaccgtaggaacaggtaaccaacgaaaccgaaactaagttacgtaccccgttagttaaccggaagttacggaacggggtccctaagggtacgtcgtagaacccggaacgtacccggtccccttagtttaacgttagtttacggtacggtaaccggtttaaagttaacgtttttaacgtttttccgttaagttttggtttaccgttaggggtttggttacgtttgttacggtttattaaggtttggtttaacggtcgtttagggttaccggg

SEQ ID NO: 243608 - DNA, 248 bp, Homo sapiens
  misc_feature: GYAE6OF01AR50D.1.59.F04.1.454.CMB.1.raw
  modified_base (220)..(248): a, c, t, g, unknown or other
  misc_feature (220)..(248): n is a, c, g, or t
tcagacgagtgcgtcacgaccggtgctcgatttagtacacacacttcgcgggggactagataccaggactcctcagttcaccttctcacaatgaggctccctgctcagctcctggggctgtctaatgctctgggtcccaggaactgtggctgcaccgatctgtcttcatccttccgccatctgaacgcactcgtctgagcgggctggcaaggcgcatagnnnnnnnnnnnnnnnnnnnnnnnnnnnnn

SEQ ID NO: 243609 - DNA, 217 bp, Homo sapiens
  misc_feature: GYAE6OF01BMVKU.1.59.F04.1.454.CMB.1.raw
  modified_base (215)..(217): a, c, t, g, unknown or other
  misc_feature (215)..(217): n is a, c, g, or t
tcagacgagtgcgtcacgaccggtgctcgatttagtacacacacttcgcgggggactgatcaggactcctcagttcaccttctcacaatgaggctccttgctcagctcctggggctgctaatgctctgggtcccaggaactgtggctgcaccatctgtcttcatcttcccgccatctgaacgcactcgtctgagcgggctggcaaggcgcatagnnn

SEQ ID NO: 243610 - DNA, 220 bp, Homo sapiens
  misc_feature: GYAE6OF01AT8LV.1.59.F04.1.454.CMB.1.raw
  modified_base (164)..(220): a, c, t, g, unknown or other
  misc_feature (164)..(220): n is a, c, g, or t
tcagacgagtgcgtcacgaccggtgctcgatttagtacacacacttcggcggggggaccgaaggtggagatcaaacgaactgtggctgcaaccatcctggtcttcatcttcccaccctcctcacgcactcgtctgaggcggggtcctggtcaagggcgcatagnnnnnnnnnnnnnnnnnnnnnnnnnnnnnnnnnnnnnnnnnnnnnnnnnnnnnnnnn

SEQ ID NO: 243611 - DNA, 153 bp, Homo sapiens
  misc_feature: GYAE6OF01B22H1.1.59.F04.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacacacacttcggcgggggaccaaggtggagatcaaacgaactgtggctgcaccatctgtcttcatcttcccgccatctgaacgcactcgtctgagcgggctggcaaggcgcatagn

SEQ ID NO: 243612 - DNA, 153 bp, Homo sapiens
  misc_feature: GYAE6OF02JDPO7.1.59.F04.1.454.CMB.1.raw
  modified_base (152)..(153): a, c, t, g, unknown or other
  misc_feature (152)..(153): n is a, c, g, or t
tcagacgagtgcgtcacgaccggtgctcgatttagtacacacacttcggcggggaccaaggtggagatcaaacgaactgtggctgcaccatctgtcttcatcttcccgccatctgaacgcactcgtctgagcgggctggcaaggcgcatagnn

SEQ ID NO: 243613 - DNA, 234 bp, Homo sapiens
  misc_feature: GYAE6OF02JTM3R.1.59.F04.1.454.CMB.1.raw
  modified_base (182)..(182): a, c, t, g, unknown or other
  misc_feature (182)..(182): n is a, c, g, or t
  modified_base (215)..(217): a, c, t, g, unknown or other
  misc_feature (215)..(217): n is a, c, g, or t
  modified_base (219)..(234): a, c, t, g, unknown or other
  misc_feature (219)..(234): n is a, c, g, or t
tcagacgagtgcgtcacgaccggtgctcgatttagtacacacacttcgcgggggactgatcaggactcctcagttcaccttctcacaatgagctccctgctcagctcctgggctgctaatgctctgggtcccaggaactgtggctgcaccatctgtcttcattccttcccgccatctgaacncactcgtctgagcgggctggcaaggcgcatagnnntnnnnnnnnnnnnnnnn

SEQ ID NO: 243614 - DNA, 155 bp, Homo sapiens
  misc_feature: GYAE6OF02GCGEC.1.59.F04.1.454.CMB.1.raw
  modified_base (153)..(155): a, c, t, g, unknown or other
  misc_feature (153)..(155): n is a, c, g, or t
tcagacgagtgcgtcacgaccggtgctcgatttagtacacacacttcggcgggggaccaaggtggagatcaaacgaactgtggctgcaccatctgtcttcatcttcccgccatctgaacgcactcgtctgagcgggctggcaaggcgcatagnnn

SEQ ID NO: 243615 - DNA, 895 bp, Homo sapiens
  misc_feature: GYAE6OF02FH400.1.59.F04.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacacacacttagggattgggggaggaactgctcagttaggacccagacggaaccatggaagccccagcgcagcttctcctcctcctgcctactctggcctccagactaccactgganaaatagtgatgacgcagtctccagccaccctgtctgtcgtctccgaggggaaacacgcccaccctctcctgccgacgggccaacggttcacggtacgtcggttaaaccaggtcctaaaccgtttacggcccgttacgggttaacccacgaccgaacggtaaacccctgggaccctaacgggtccctaccccgagggtccctcccgttactaacgtttcccgttaacgttgggtacgtacctaactttaccgaaccggtacgggcccctaacgttcgggttaacctccccgaacggtccgtaacggggttttaccaacgggtttcggaccgtacggttccgggggtaccttacgggggacttaacggacggtttctaacccttctaccgacctaactccaacgtccgacgtccgtaacggacgttacgttaccgtacggttaacgttacgttttaacggtactttaaaccgttttaacgtttaccgttaacggttaaccttaaaaccggtaccggtttaaacttttaaccggtaaacccggtttaacccccggtttaacgttacccgggttaaccggtttacccggggaaccggttaaccggggtaaacccgttacggggtaccggtaacggttaaacccgtaacccgggtaacggtaccggttaccggtacccgtacgtaaccccgtaccgttaccgttccggttaccgttttacccggttaccttaccgtttaaccccccg

SEQ ID NO: 243616 - DNA, 482 bp, Homo sapiens
  misc_feature: GYAE6OF01ELF7Z.11.11.A11.1.454.CMB.1.raw
  modified_base (443)..(443): a, c, t, g, unknown or other
  misc_feature (443)..(443): n is a, c, g, or t
tcagcgagagataccacgaccggtgctcgatttagctacgactgcagggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggctagtttattactgtcagcagtattgtgaagctccgctcactttcggcggagggaccgnggtggagatcgagacgaactgtgctgcacatctgtcttc

SEQ ID NO: 243617 - DNA, 482 bp, Homo sapiens
  misc_feature: GYAE6OF01DJ9DZ.11.11.A11.1.454.CMB.1.raw
  modified_base (423)..(423): a, c, t, g, unknown or other
  misc_feature (423)..(423): n is a, c, g, or t
  modified_base (466)..(466): a, c, t, g, unknown or other
  misc_feature (466)..(466): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattccagtggcagcgggtctgggacagacttcactctcaccatcagcaacctgcaggctgaagatgtggctagttttatactgtcagcagtattgtgaagctccgntcactttcggcggagggaccgcggtggagatcgagacgactgngctgcacatctgtctc

SEQ ID NO: 243618 - DNA, 488 bp, Homo sapiens
  misc_feature: GYAE6OF01BOT8F.11.11.A11.1.454.CMB.1.raw
  modified_base (255)..(255): a, c, t, g, unknown or other
  misc_feature (255)..(255): n is a, c, g, or t
  modified_base (471)..(471): a, c, t, g, unknown or other
  misc_feature (471)..(471): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggacagcctcctaaactgctcatctcctgggcatctacccgggcacccggagtccctgaccgattcagtggcagcgggtctgggacagacttcactctcaccatcagcaacctgcaggctgaagatgtggctagtttattactgtcagcagttattgtgaagctccgcttcactttcgggcggagggaccgcgggtggagatcgaggacgaactgnggctgcacatctgtctc

SEQ ID NO: 243619 - DNA, 567 bp, Homo sapiens
  misc_feature: GYAE6OF01DJO51.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaaccaggacagcctacctaaactgctcatctcctgggcatcctacccgggcacccggatcccctgaccgattcagtgcaggcgggtctgggacagacttcactctcaccatcagcaacctgcaggctagaagatggtggctagtttatactgtcagtctagtattgtagaacgtcctcccgtcttcgtaccgttttccggggacgggtacggggacccgggtcgggttagggaacgtagtaccgaacgggtaaccgtaaacggttggtacgggcctacgggtccaaccctagtttcccgttggttccctttaccg

SEQ ID NO: 243620 - DNA, 482 bp, Homo sapiens
  misc_feature: GYAE6OF01CYF46.11.11.A11.1.454.CMB.1.raw
  modified_base (255)..(255): a, c, t, g, unknown or other
  misc_feature (255)..(255): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccngacagcctcctaaactgctcatctcctgggcatcctacccgggcacccggagtcccctgaccgattcgagtggcaggcgggtctgggacagacttcactctcaccatcagcaacctgcagctagaagatgtgctagtttatactgtcagctagtatgtgaanctccgntcacgttcggcggagggccnggtgagatcgaagacgatggtgctcgcacatctgtctac

SEQ ID NO: 243621 - DNA, 516 bp, Homo sapiens
  misc_feature: GYAE6OF01EIZ9O.11.11.A11.1.454.CMB.1.raw
tcagcgagagataccacgaccggtgctcgatttagctacgactgcaggggcgagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcggtctgggacagacttcactctcaccatcagcaacctgcaggctgaagatgtgcagtttatactgtcagcagtattgtagaagtctaccgctcgtacgtttcgggcggtagggacccgcgggttggagtacgtcgaggacggaacgttggtcggcctcggtccaacctattcttgttccttaccg

SEQ ID NO: 243622 - DNA, 488 bp, Homo sapiens
  misc_feature: GYAE6OF01C3EQS.11.11.A11.1.454.CMB.1.raw
  modified_base (356)..(356): a, c, t, g, unknown or other
  misc_feature (356)..(356): n is a, c, g, or t
  modified_base (480)..(480): a, c, t, g, unknown or other
  misc_feature (480)..(480): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatcctacccgggcacccggagtccctgaccgattcagtggcagcgggtctgggacagacttcactcncacatcagcaacctgcaggctagaagatgtggctagtttatactgtcagcagtattgtgaagctccgctctactttcgggcggagggaccgcggtggagatcgagacgaacgtgtggctgcacntctgtctc

SEQ ID NO: 243623 - DNA, 518 bp, Homo sapiens
  misc_feature: GYAE6OF01CVHIS.11.11.A11.1.454.CMB.1.raw
  modified_base (380)..(380): a, c, t, g, unknown or other
  misc_feature (380)..(380): n is a, c, g, or t
  modified_base (452)..(452): a, c, t, g, unknown or other
  misc_feature (452)..(452): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagacaaaaaccaggacagcctacctaaactgctcatctcctggcatcctacccgggcacccggagtcccctgaccgattcagtggcagcgggtctgggacagacttcactctcacatcagcaactgcaggctgaagntgtgctagtttatactgtcagctagtattgtgaagcctccgctcgtacgtttcggacgggacgggacccggngggtaggagatcgaacggacgaacgtggtacgggctcgaccacccgtattccgtgttcctttaccg

SEQ ID NO: 243624 - DNA, 486 bp, Homo sapiens
  misc_feature: GYAE6OF01EH7R8.11.11.A11.1.454.CMB.1.raw
  modified_base (255)..(255): a, c, t, g, unknown or other
  misc_feature (255)..(255): n is a, c, g, or t
  modified_base (449)..(449): a, c, t, g, unknown or other
  misc_feature (449)..(449): n is a, c, g, or t
  modified_base (470)..(470): a, c, t, g, unknown or other
  misc_feature (470)..(470): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggacagcctcctaaactgctcatctcctgggcatctacccgggcacccggagtccctgaccgattcagtggcagcgggtctgggacagacttcactctcaccatcagcaacctgcaggctgaagatgtggctagtttattactgtcagctagttattgtgaagcctccgctctacgtttcggcggacgggccgnggtggagatcgagacgactgngctgcacatctgtctc

SEQ ID NO: 243625 - DNA, 497 bp, Homo sapiens
  misc_feature: GYAE6OF01CEGZ1.11.11.A11.1.454.CMB.1.raw
  modified_base (383)..(383): a, c, t, g, unknown or other
  misc_feature (383)..(383): n is a, c, g, or t
  modified_base (452)..(452): a, c, t, g, unknown or other
  misc_feature (452)..(452): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaactgctcatctcctgggcatcctacccgggcacccggagtcccctgaccgattcagtggcagcgggtctgggacagacttcactctcaccatcagcaacctgcaggctgaagntgtggctagtttatactgtcagctagtattgtgaagcctccgctcgtacgtttcgggcggtagggccgnggtggagatcgagacgaacgtggtcggctcgcaccatctgtcttc

SEQ ID NO: 243626 - DNA, 486 bp, Homo sapiens
  misc_feature: GYAE6OF01A6Q6B.11.11.A11.1.454.CMB.1.raw
  modified_base (447)..(447): a, c, t, g, unknown or other
  misc_feature (447)..(447): n is a, c, g, or t
  modified_base (469)..(469): a, c, t, g, unknown or other
  misc_feature (469)..(469): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaactgctcatctcctgggcatctacccgggcacccggagtccctgaccgattcagtggcagcgggtctgggacagacttcactctcaccatcagcaacctgcaggctagaagatgtggctagtttattactgtcagctagtattgtgaagctccgctctacgtttcggcggaggccgnggtgagagtcgagacgacgtgngctgcacatctgtcttc

SEQ ID NO: 243627 - DNA, 555 bp, Homo sapiens
  misc_feature: GYAE6OF01DN6JD.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatcctacccgggcacccggagtccctgaccgattcagtcggcaggcgggtctgggacagacttcactctcaccatcagcaactgcaggctagaagatgtggtactagtttatacgtgtcagtctagtattgagtaagcctccggcttccgtacgtttccgggacgggacgggaccgcgggttaggacgtagtaccgaaggtaaccgtaacgttgggtcgggaccttacggacccctaaacctagtttccgtggttccctttacccg

SEQ ID NO: 243628 - DNA, 493 bp, Homo sapiens
  misc_feature: GYAE6OF01A8YDT.11.11.A11.1.454.CMB.1.raw
  modified_base (449)..(449): a, c, t, g, unknown or other
  misc_feature (449)..(449): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtcccctgaccgattcagtggcagcgggtctgggacagacttcactctcaccatcagcaacctgcaggctgaagatgtggctagtttattactgtcagcagtattgtgaacgctccgctcctactttcgggcggagggaccgnggtggacgatacgacgacgaactgtggctgcacatctgtcgttc

SEQ ID NO: 243629 - DNA, 578 bp, Homo sapiens
  misc_feature: GYAE6OF01AZBQV.11.11.A11.1.454.CMB.1.raw
  modified_base (211)..(211): a, c, t, g, unknown or other
  misc_feature (211)..(211): n is a, c, g, or t
  modified_base (261)..(261): a, c, t, g, unknown or other
  misc_feature (261)..(261): n is a, c, g, or t
  modified_base (499)..(499): a, c, t, g, unknown or other
  misc_feature (499)..(499): n is a, c, g, or t
tcagcgagagataccacgaccggtgctcgatttagctacgactgcaggggcagcaagatggtgttgcagacccaggtcgttccatttctctgttgcgtctggatctctggtgcctgtggggacatcctgatgacccagtccccagatatccctgcctgtgtctctgggcagaggccaccatcgagtgcaagtccagcgagacttcttttanatagtgtacaacgataaggactatttagcttggtatcagtacaaaaaccnggacagcctacctaaactgctacatctccgtgggcactccgaccggcacccggagtccccgtgaccgattcgagtcggcaggcggtcgtgggacaggtacttcacgtctacacctatccagacctaacctggtaggccttagaacgtagttggtacggtacttagttttaataccttgtctagactagtacttgtagaacgtccgtccgtctccgtacgtttcggacggtagggccgngggtaggagtagtccgaaggtaccgtaacgtcggtaggccctggaccctacctagtaccgttcttccgttccgtacccg

SEQ ID NO: 243630 - DNA, 574 bp, Homo sapiens
  misc_feature: GYAE6OF01AY8TG.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatccgtacccgggcacccggagtcccctgaccgattcagtcggcagcgggtctgggacagtactcactctacaccatcagcaacctgcaggctagaagatggtgactagtttacttacgtgtacagctagttattgtgaacgtcctccgctaccgtaccgtttcgggaccgggtacggggacccggtcgggtaggacggtacgttaccggaacggtaaccggtaacggttgggttacgggtccgtcggaccctaacccgtagttcccgttggttccctttacccg

SEQ ID NO: 243631 - DNA, 503 bp, Homo sapiens
  misc_feature: GYAE6OF01CMNBF.11.11.A11.1.454.CMB.1.raw
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
  modified_base (400)..(400): a, c, t, g, unknown or other
  misc_feature (400)..(400): n is a, c, g, or t
  modified_base (450)..(450): a, c, t, g, unknown or other
  misc_feature (450)..(450): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctggcatcctacccgggcacccggagtcccctgaccgtattcagtggcagcgggtctgggacagacttcactctcaccatcagcacctgcaggctagagntgtgntagtttatactntcagcagttatgtgacgtctccgcttcgacgtttcgggcggagggaccgnggtggagactcgaagacgtaacgtggtggctcgacacctatctgttcttaccg

SEQ ID NO: 243632 - DNA, 800 bp, Homo sapiens
  misc_feature: GYAE6OF01CFDKL.11.11.A11.1.454.CMB.1.raw
  modified_base (266)..(266): a, c, t, g, unknown or other
  misc_feature (266)..(266): n is a, c, g, or t
tcagcgagagataccacgaccggtgctcgatttagctacgactgcagggggcaggcaacgatggtgttgacaggacccgaggttcttctagtttctctgttgctctggatctcgtggtgcctggtggggacagttccgtgatacgtaccccgttacgttcccccgagacttacttccgtggtcccttggtggttcgtcgtggggccgagacgggcctaccgagtcggagtgggacgaacgtccgagcgacgtacgttacgttttanagtaggtgttacgaacgtagttaaagggaccttaagttttacggtcgtttagggtaacttacaacggtaaccaaaaaacccgagggtaaccacggtacccttaccctaaaacgttcggacctacctaacggttcccgtcccggttacggggaccctaacggttacccggtacccccgggggaccggaaccccgggtacggtaccccgttagggaccccggtatttaccggtaagggtttcgggaccgacgggttccggggtaccgttagggggaactaggtaaccttcgactccgtacgaccctagtccgaaggcctaaccgtgaccgaggtcctaagaagacgttacgtacggacgttaagtttacttaacgtttggtacctagtccgtaagttgttacggagtaacgtccgtaccgacgtacgttaccggttacgggacgggtacgggaccggtaggttagggacgttaacgtcggaaacggagtaacgtgggacgcgtacggactacgtagttccggttgtccgtttaccg

SEQ ID NO: 243633 - DNA, 548 bp, Homo sapiens
  misc_feature: GYAE6OF01D5BL4.11.11.A11.1.454.CMB.1.raw
  modified_base (388)..(388): a, c, t, g, unknown or other
  misc_feature (388)..(388): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctactaaactgctcatctcctgggcatccgtacccgggcacccggagtccctgaccgattcagtggcaggcgggtctgggacagacttcactctcaccatcagacaacctgacaggctagaagtntggtggctagtttatacgtgtcagtcagttattgtagaacgcctccgcttactacgtttcgggacgggacgggtaccggcggtagggacgagtcgaacggaacgtaacgttggtacgggtcctaggtaccccaacctagttccgttcgttcctttacccg

SEQ ID NO: 243634 - DNA, 585 bp, Homo sapiens
  misc_feature: GYAE6OF01C4S61.11.11.A11.1.454.CMB.1.raw
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatccgtaccccgggccacccggacgtcccctgacccgtattcgagtggcaggcgggtctgggacagacttcactctcacatcancacctgcagctagaagatgngtctagtttatactgtacagtctagttattgtagaacgtccttacccgcttccgttaccgtttccggggaccgggtacggggacccgggccgggttagggaacgtacgtaccggaaacggtaaccggtaacgttcgggtacgggccttacggaccctaaacccgtagtttccgttcggtttccctttacccg

SEQ ID NO: 243635 - DNA, 514 bp, Homo sapiens
  misc_feature: GYAE6OF01A2KS5.11.11.A11.1.454.CMB.1.raw
  modified_base (382)..(382): a, c, t, g, unknown or other
  misc_feature (382)..(382): n is a, c, g, or t
  modified_base (501)..(501): a, c, t, g, unknown or other
  misc_feature (501)..(501): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaactgctcatctcctggcatccgtacccgggcacccggagtccctgaccgattcgagtggcaggcggtctgggacagactcactctcacatcagcaacctgcaggctagaagntgtgctagtttatactgtcagtctagttattgtacgaagtcctccgctcgtacgtttcgggacggtacgggaccgtgggtggagtactcgaggacgtaacgtggtacgcgtacgccacnttcgtgtcttacc

SEQ ID NO: 243636 - DNA, 547 bp, Homo sapiens
  misc_feature: GYAE6OF01CW6VP.11.11.A11.1.454.CMB.1.raw
  modified_base (386)..(386): a, c, t, g, unknown or other
  misc_feature (386)..(386): n is a, c, g, or t
  modified_base (461)..(461): a, c, t, g, unknown or other
  misc_feature (461)..(461): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggagggccaccatcgagtgcaagtccagcgagactctttatatagtgtacaacgataaggactatttagcttggtatcagacaaaaaccaggacagcctacctaaactgctcaatctcctgggcatcctacccgggcacccggagtccctgaccgattcagtggcagcgggtctgggacagacttcactctacaccatcagcaacctgcaggctgaanatgtggctagtttatactgcagcagtattgtgaagtctccgactcgtaccgtttcgggaccgggaggggacccgngggtagggaacgtagtacgaagggaaccgaacgttcgggtacggccttacgggacccacccgttaatccgttcggtcctttacccg

SEQ ID NO: 243637 - DNA, 494 bp, Homo sapiens
  misc_feature: GYAE6OF01BMKGP.11.11.A11.1.454.CMB.1.raw
  modified_base (381)..(381): a, c, t, g, unknown or other
  misc_feature (381)..(381): n is a, c, g, or t
  modified_base (449)..(449): a, c, t, g, unknown or other
  misc_feature (449)..(449): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatcctacccgggcacccggagtccctgaccgattcgagtggcagcgggtctggggacagacttcactctcaccatcagcaactgcaggctgaanatgtggctagtttatactgtcagcagtatgtttgaagtctccgctcgacgtttcggcggagggaccgngggtgagatcgagacgaacgtgtcggctgcaccgatctgtcttac

SEQ ID NO: 243638 - DNA, 651 bp, Homo sapiens
  misc_feature: GYAE6OF01CQPPB.11.11.A11.1.454.CMB.1.raw
tcagcgagagataccacgaccggtgctcgatttagctacgactgcaggggcagcaagatggtgttgtagacccaggtcttcatttctctgttgctctggatctctggtgcctgtgggacatcctgatgacccagtccccagatatcctgcctgtgtctcgtgggcgagagggccaccatcgagtgcaagtccagcgagacttcttttatatagtgtacaacgataaggacttattagcttggtatcagacaaaaacgaggacagcctacctaactgctcatctccgtggcatccgtacccggcacccggtatccctgaccgattcgagtgcagcgggtctggggacacgtacttaccgacttctaccaacctataccgaacgaccaaacccgttgaccgacgggtaccgttaaggaaagtacgttggttacgggactttaacggttttaatttacgtggttacaacggtacttaagtttacgttagttaggtaacgtcccgttaccgtccttaccgtaccggttttccgggacgggtacggggacccggtacgggtagggaacgtacgtaccgtaaggtaccgtaagttcgggtcggtaccgtacgtacccgtaacccgtagttaccgtttcgttcccgttccgttacccg

SEQ ID NO: 243639 - DNA, 681 bp, Homo sapiens
  misc_feature: GYAE6OF01C0M28.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtgtctcgtgggcgagaggccaccatcgagtgacaagtccagcgagacttcttttatatagtgtacaacgataaggactattagcttggtatcagacaaaaacaggacagcctacctaaactcgctcaactcctccgtgggccacttccgtaccccgggcacccggacgtccctacggacccgtatacgacggtcggaccgacggtcggggtcgtacggggaacacggtaacttccacctcctacaaccatacaacgacctaaaccgtgaccgagggaccttaggaaacgtagttcggaggtacttaagttttactacgttgtaccgagtaccgttaagttaagtttcgggtaagtaacgtcccgtacccgttacgttaccgttaccggttttacgggggacccgggtacggggtacccggtacggggttacgggaacggtaacgtccggtaaacgggtaacccggtaaacggttgggtaccggaccttacggaccctaaccgtagttccttcgggttctttaaccccg

SEQ ID NO: 243640 - DNA, 507 bp, Homo sapiens
  misc_feature: GYAE6OF01BZ2PR.11.11.A11.1.454.CMB.1.raw
  modified_base (459)..(459): a, c, t, g, unknown or other
  misc_feature (459)..(459): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagcgcaagtccagcgagactcttttatatagtgtcaacgataaggactatttagcttggtatcagacaaaaaccaggacagcctcctaaactgctcatctcctgggcatccgtacccgggcaccccggagtcccctgaccgattcagtggcaggcgggtctgggacagacttcactctcaccatcagcaacctgcaggctagaagatgtggctagtttatactgtcagctagtattgtgaagtcctccgcttctacgtttcgggcgggacgggcccgngggtggagatcgacgacgaagtggtacggctcgcaccatcctgtcttc

SEQ ID NO: 243641 - DNA, 503 bp, Homo sapiens
  misc_feature: GYAE6OF01A54I7.11.11.A11.1.454.CMB.1.raw
  modified_base (255)..(255): a, c, t, g, unknown or other
  misc_feature (255)..(255): n is a, c, g, or t
  modified_base (381)..(381): a, c, t, g, unknown or other
  misc_feature (381)..(381): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggacagcctctaaactgctcatctcctgggcatccgtacccgggcacccggatccctgaccgattcagtggcagcggtctgggacagcttcactctcacatcagcaacctgcaggctagaagatgngctagtttatactgtcagcagtattgtgaagtctaccgctctacgtttcggacgggacgggtaccgcgggtgagagtcgaggacgaacgtggtacggctcgacaccatcgtggtccttaccg

SEQ ID NO: 243642 - DNA, 516 bp, Homo sapiens
  misc_feature: GYAE6OF01C6QAW.11.11.A11.1.454.CMB.1.raw
  modified_base (359)..(359): a, c, t, g, unknown or other
  misc_feature (359)..(359): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtacaacgataaggactatttagcttggtatcaagacaaaaaaccaggacagcctacctaaactgctcatctcctgggcatctacccgggcacccggagtccctgaccgattcagtggcaggcgggtctgggacagacttcactcncacatcagcaacctgcaggctagaagatgtggactagtttatacgtgtcagctagtattgtagaagcctccgcttctacgtttcgggacgggacgggaccgcgggtaggacgtatcgaaggacgaacgtggtggctgccacctatcctgtccttacg

SEQ ID NO: 243643 - DNA, 545 bp, Homo sapiens
  misc_feature: GYAE6OF01BHLM5.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatccgtacccgggcacccggacgtccctcgaccgattcgagtcggcaggcgggtctgggacagacttcactctcaccatcagcaacctgcaggctagaagatggtggactagtttattacgtgtacagtctagttattgtagaacgtcctccgcttccgtacgtttccgggacgggtacgggccggtgggtggacgtacgtcgaacggtacgaacgttggtcggcgtacgacctaccgtattccttcgtcttaccg

SEQ ID NO: 243644 - DNA, 613 bp, Homo sapiens
  misc_feature: GYAE6OF01C3A4O.11.11.A11.1.454.CMB.1.raw
  modified_base (593)..(593): a, c, t, g, unknown or other
  misc_feature (593)..(593): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagccctactaaactgctcatcctccgtggcatccgacccggccacccggacgtccctcgacctattccgaggtcggacacggtccgggtcgtacgggacacgtacttcacctccaccaaccatacacgacctaaccgtgacgacggctaggaacgtattgggtcgtacttagttttacttacgttcgtacgaggtactaagttagtttggtagaacgtcccgttccgtccttacgttacggtttccggggaccgggtaggggaccccggtgggtaggaacgtcgtaccggaacggaacgtaacggttgggtacggtcctacggaccctaacgtnttaccgtcgtttccttaccg

SEQ ID NO: 243645 - DNA, 533 bp, Homo sapiens
  misc_feature: GYAE6OF01CN3AO.11.11.A11.1.454.CMB.1.raw
  modified_base (382)..(382): a, c, t, g, unknown or other
  misc_feature (382)..(382): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaactgctcatctcctggcatcctacccgggcacccggagtccctgaccgattcagtggcaggcggtctgggacagacttcactctcacatcagcaacctgacaggctagaagntgtggactagtttatactgtcagtctagtattgtagaacgtcctccgtcttcgtacgtttcgggacggacgggaccgtcgggtaggagtactacgaaggtaccgaacgttggcggcgtacggaccctacgtattccgttgttcctttaccg

SEQ ID NO: 243646 - DNA, 493 bp, Homo sapiens
  misc_feature: GYAE6OF01AFYSR.11.11.A11.1.454.CMB.1.raw
  modified_base (387)..(387): a, c, t, g, unknown or other
  misc_feature (387)..(387): n is a, c, g, or t
  modified_base (417)..(417): a, c, t, g, unknown or other
  misc_feature (417)..(417): n is a, c, g, or t
  modified_base (477)..(477): a, c, t, g, unknown or other
  misc_feature (477)..(477): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcagacaaaaaccaggacagcctacctaaactgctcatctcctggcatccgtacccgggcacccggagtcccctgaccgattcagtggcaggcgggtctgggacagacttcactctcaccatcagcaacctgcaggctagaagntgtgctagtttatactgtcagcagtattgngaagcctccgctcgtacgtttcgggacggacgggccgcggtggacgatcgagacgatggngctgcacatctgtctc

SEQ ID NO: 243647 - DNA, 551 bp, Homo sapiens
  misc_feature: GYAE6OF01CLOCB.11.11.A11.1.454.CMB.1.raw
  modified_base (474)..(474): a, c, t, g, unknown or other
  misc_feature (474)..(474): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggactatttagcttggtatcagacaaaaaaccaggacagcctacctaaactgctcatctcctgggcactccgtacccgggcacccgggatcccctgacccgattcgagtggcaggcgggtctgggacagacttcactctcaccatccagccaactgcaggctagaagatgtggctagtttatacgtgtccagctagttattgtagaacgctccgctccgtacgtttccgggacggacggggtacccgnggggtggaagtacgtacgaaggaccgtaacgttgggcggtacttcggaccctaccgtattccgttcgttcttacccg

SEQ ID NO: 243648 - DNA, 677 bp, Homo sapiens
  misc_feature: GYAE6OF01EEUKN.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccacatcgagtgcaagtccagcgagtacttcttttatatagtgtacaaacgataaaggacttatttagcttggtatcagacaaaaccagacagcctactaaactgctcatctccgtggctactccgtacccgggaccacccgggtactccccgtgacccgtattcgaggtcggacgacggtccgggtcgtacggggactacggtaccttaccgacctccgtaccaaccctagtacccaacgaccctaaccgtcgaccgtacggtacgtaggaaacgtacgttcgggtaggttacgttaacggttttaactttaaccgttcgttaaccgacgttaccgttaaggtttacgtttacggtacggtaacgttcccgttacccgtccgtttacccggttaccggttttccggggaccgggtaaccggggtaccggtcgggtagggactacgtacggacgtaaccggtaagtcggtaggtctacggacctacgtattcgttgtccttaccg

SEQ ID NO: 243649 - DNA, 546 bp, Homo sapiens
  misc_feature: GYAE6OF01EP62I.11.11.A11.1.454.CMB.1.raw
  modified_base (365)..(365): a, c, t, g, unknown or other
  misc_feature (365)..(365): n is a, c, g, or t
  modified_base (412)..(412): a, c, t, g, unknown or other
  misc_feature (412)..(412): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccacatcgagtacaagtccagcgagactcttttatatagtgtcaacgataaggactatttagcttggtatcagacaaaaaccaggacagcctacctaaactgctcatctcctgggcagtcctacccgggcacccggagtccctgaccgattcagtggcagcggtctgggacagtactcactctcaccatcacncaacctgcagctagaagtatgtgctagtttattactgtcagctagtnttgtgaagcctcgctcgtacgtttcgggacgggacgggtaccgcgggtaggacgtacgtacgacggaacggtaacgtgggtcgggtccttacggacccgtaaccgtacttaccgttcgttccttccgtaacccg

SEQ ID NO: 243650 - DNA, 711 bp, Homo sapiens
  misc_feature: GYAE6OF01B3RR4.11.11.A11.1.454.CMB.1.raw
  modified_base (238)..(238): a, c, t, g, unknown or other
  misc_feature (238)..(238): n is a, c, g, or t
tcagcgagagataccacgaccggtgctcgatttagctacgactgcaggggcaggcaacgatcggtggttgtcaggaccctaggtctttcgatttctctgttgctactgggatctactggtcgcctggtgggggtacatcctgatggacccttagtccccagatattaccgtgcctgtgtctcgtgggcgagacgggccacgagtcgaggtgctaagtccagcgaggtaccttctttanatagtgtcaacgataaggcttattagcttggtattcagactaaaaaccaggacagtcctacctaaactggcctcactctccgtgggcactccgtacccgggcgacccggacgtccctggaccgtagttcgaggtggactaggcgggtctacgggactagaccttcaactccgtaccaaccgacgtccgacgacctaacccgttcgaccgaacgggtacctacggaaacgtacgtaggtaccggtaccttaaggttttaacttacgttacggtactaacggactaacggttaacgtttcggtacggaaacgtcccgtacccggtaccgtacccgttaccggttttaccggggaccgggtaaccgggggtacccgtcgggggttacgggacgggtaacgtcggaacgggtaacggtaaacggtggtacggtcgtacggtacctaccgttaagttccttggttccctttaacccgg

SEQ ID NO: 243651 - DNA, 566 bp, Homo sapiens
  misc_feature: GYAE6OF01DJK3J.11.11.A11.1.454.CMB.1.raw
  modified_base (428)..(428): a, c, t, g, unknown or other
  misc_feature (428)..(428): n is a, c, g, or t
tcagcgagagataccacgaccggtgctcgatttagctacgactgcaggggcagcaagatggtgttgtagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttatatagtgtacaacgataaggacttatttagcttggtatcagacaaaaaccaggacagcctacctaaactgctcatctccgtggcactccgtaccccggccacccggactcccgtgaccgattccgaggtcgcgaggcggtctgggacagtacttcactctcacatcagaccaactgcagctagaagatgtagtctaagtttatactgtcagtctaagtnttagtagaacgtccgtaccgccttacgtaccgtttccgggacgggtacgggaccggtcgggtaggagactacgaaggtaaccgtaagtcggtcggtctacggacctaaccgtacttcgttacgttccttcgttacccg

SEQ ID NO: 243652 - DNA, 481 bp, Homo sapiens
  misc_feature: GYAE6OF01CM42C.11.11.A11.1.454.CMB.1.raw
  modified_base (378)..(378): a, c, t, g, unknown or other
  misc_feature (378)..(378): n is a, c, g, or t
  modified_base (444)..(444): a, c, t, g, unknown or other
  misc_feature (444)..(444): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcaagacaaaaaccaggacagccttctaaactgctcatctcctggcatctacccggcacccggatccctgaccgattcagtggcagcgggtctgggacagacttcactctcacatcagcaacctgcaggctgaagntgtgactagtttatactgtcagctagtatgtgaagtctccgctcacgtttcgggcggagggaccgnggtggagtncgagacgaatgngctgcacntctgtctc

SEQ ID NO: 243653 - DNA, 592 bp, Homo sapiens
  misc_feature: GYAE6OF01C4LIB.11.11.A11.1.454.CMB.1.raw
tcagcgagagataccacgaccggtgctcgatttagctacgactgcaggggcagcaagatggtgttgtagacccaggtcttcatttctctgttgctctggatctctggtgcctggtggggacatcctgatgacccagtccccagatatcctgcctgtgtctctgggcgagagggccaccatcgagtgcaagtccagcgagactcttttatatagtgtcaaacgataaggacttatttagctttggtatacagacaaaaaccaggacagacctacctaaactgctcactctccgtggacatccgtacccgggccacccggacgtccctcgaccgattcgagtcggcaggcggtcgtgggacagtacttcactctaccacctatacacgaccaccgtcgacgaggacttagaacgtagttggtacggtacttaagttttacttacgtggtacaacgtctaagttattggtagaacgtcctaccgtcctacgttaccgttcgggacggtacggggccgtagggtaggacgtacgtacgaacggaacggtaacgtggtcggcgtcgaccaacctatccgttacgttccttctacccg

SEQ ID NO: 243654 - DNA, 524 bp, Homo sapiens
  misc_feature: GYAE6OF01C36P6.11.11.A11.1.454.CMB.1.raw
  modified_base (333)..(333): a, c, t, g, unknown or other
  misc_feature (333)..(333): n is a, c, g, or t
  modified_base (359)..(359): a, c, t, g, unknown or other
  misc_feature (359)..(359): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcaagacaaaaaccaggacagcctactaaactgctcatctcctgggcatccgtacccggcacccggactccctgaccgattcgagtggcnggcgggtctgggacagacttcactcncacatcagcaacngcagctagaanatggtgtactagtttactactgtacagctagtattggtagaatcctccgctcgtaccggtttcgggacgggacgggaccgcgggtagagtatacggacgaacgtaacgtggnggtcngaccacctattcgtgttcttaccg

SEQ ID NO: 243655 - DNA, 732 bp, Homo sapiens
  misc_feature: GYAE6OF01C5PGS.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccagtccccagatatcctgcctgtgtctcgtgggcgagacgggccaccatcgagtgacaagtccagcgagtacttcttttatatagtgtacaacgataaggacttatttagcttaggtatacagacaaaaaccaggacacgacctacctaaactgctcatcctccgtggcacgtccgtaccccgggaccacccggacgtcccctacgacccgtattaccgaggtcggccgaacggtccggggtacgtacggggaacctacggtaccttaccaacttcctaccaaccctaataccgaacgacccgtaaacctcggacgacggtccgtagaaaggtagtggttacgggaccgtttaagttttaacgttaccgttaggtaccgtagtaccgtaaggtttacgtttaagggtaccggtaaacgtcccgttacccggtacccgttaccgttaacccgggttttccgggggaccggggtaaccgggggttaacccggcgggggttaggaaaccggtacgtaaccggaacggtaaccggtaaacggttgggtacgggcccttacggaccctaaccgtaccgtttaccttcggttcccttttacccg

SEQ ID NO: 243656 - DNA, 520 bp, Homo sapiens
  misc_feature: GYAE6OF01B1RW7.11.11.A11.1.454.CMB.1.raw
tcagcgagagataccacgaccggtgctcgatttagctacgactgcaggggcagcaagatggtgttgcggacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctggcatcctacccggcacccggagtcccctgaccgattcagtggcaggcggtctgggacagacttcactctcaccatcagcaacctgcaggctgaagatgtggctagtttattactgtcagctagttattgtagaagtcctccgtctcgtacgtttcgggacgggtacgggccgcggttggagagtacgaggtacgaagtgtggcctggacctaccgtattactcgttctctaccg

SEQ ID NO: 243657 - DNA, 513 bp, Homo sapiens
  misc_feature: GYAE6OF01CZNJD.11.11.A11.1.454.CMB.1.raw
  modified_base (210)..(210): a, c, t, g, unknown or other
  misc_feature (210)..(210): n is a, c, g, or t
  modified_base (377)..(377): a, c, t, g, unknown or other
  misc_feature (377)..(377): n is a, c, g, or t
  modified_base (423)..(423): a, c, t, g, unknown or other
  misc_feature (423)..(423): n is a, c, g, or t
  modified_base (455)..(455): a, c, t, g, unknown or other
  misc_feature (455)..(455): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagtactcttttanatagtgtcaacgataaggactatttagcttggtatcagacaaaaacaggacagcctctaaactgctcatctctggcatcctacccgggcacccggagtccctgaccgtattcgagtggcaggcggtctgggacagacttcactctcacatcagcactgcagctaganagtgtgctagtttatactgtcagctagttattgacgaagtcctccncgtacctacggtttcggacggacgggaccggnggtaggacgagtcgaaggacgaactggtacggcttcgaccactatcgtgttcttaccg

SEQ ID NO: 243658 - DNA, 622 bp, Homo sapiens
  misc_feature: GYAE6OF01ED5LW.11.11.A11.1.454.CMB.1.raw
  modified_base (405)..(405): a, c, t, g, unknown or other
  misc_feature (405)..(405): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggagggccaccatcgagtgcaagtccagcgagacttcttttaatatagtgtacaacgataaggactatttagcttggtatcagacaaaaccaggacagcctactaaactgctcactctccgtgggctactccgtacccgggcacccggctcccgtagaccgtatcgaggtcgcgacggcgggtcaggggacagtacttcactctaccacatcacgacaacctgacaggctagaagtntggtacgtacttaagtttacttacgtgtacgtagtacgtagttagttagtacggtaacgtccgttccgactttaccgtacggtttccggggaccgggacgggtacccggtgggtaggtaacggacgttacggtaacgggtaacggttaaccgttgggtaccgggtaccgtaccgggtaacccctaccgtaacgtttccggttcgttcctttaccccg

SEQ ID NO: 243659 - DNA, 687 bp, Homo sapiens
  misc_feature: GYAE6OF01D4AO3.11.11.A11.1.454.CMB.1.raw
  modified_base (207)..(207): a, c, t, g, unknown or other
  misc_feature (207)..(207): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtgtctcgtgggcgagaggccacatcgagtgcaagtccagcgagacttcttttanatagtgtacaacgataaggactattagcttggtatcaagacaaaaaccaggacacgacctacctaaactcgctactaactcctacctgggactacgtcccgtaccccgggaccgtaaccccgggacgttcccctacggaccggtattaccggaggtcgggaccacggtccgggggttctacgggggaacctaggtacccttaccaacttcctaccaacctataccgacgacctaaccgtgaccggtacgtcgtagaagtacgtggtacggtactaagttttacgtacgtgtacctagacgttaagtattagtacgaacgtccgtcccgtacttaccgtaccggttttcggggacgggtaaccggggacccggtggggttaagggacgtaacggttccggaaacggtaacggtaaccggttcgggtaccggtacgtacccgtaccgaacccgttatttccggttgttcccgtttaacccgg

SEQ ID NO: 243660 - DNA, 533 bp, Homo sapiens
  misc_feature: GYAE6OF01BY7KD.11.11.A11.1.454.CMB.1.raw
  modified_base (257)..(257): a, c, t, g, unknown or other
  misc_feature (257)..(257): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcaagacaaaaaccnggacagcctcctaaactgctcatctcctgggcatccgtacccgggcacccggagtcccctgacccgattcagtcggcaggcgggtctgggacagacttcactctcaccatcagcaacctgcgagctgaagatgtggctagtttattactgtcagctagtattgtgaagtcctccgcttacgtacgtttccgggacgggtacgggaccggcgggtaggagtagtccgaaggtaccgaacggtggtggcctggacccaccgattccgttgtccttccg

SEQ ID NO: 243661 - DNA, 574 bp, Homo sapiens
  misc_feature: GYAE6OF01DRHYU.11.11.A11.1.454.CMB.1.raw
  modified_base (404)..(404): a, c, t, g, unknown or other
  misc_feature (404)..(404): n is a, c, g, or t
tcagcgagagataccacgaccggtgctcgatttagctacgactgcaggggcagcaagatggtgttgtagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagccctacctaaactgctcatcctccgtgggctactccgtacccgggccaccccggacgtcccctaggacccgtattccgaggtcggcaggcggtctgggacagacttcactctcaccatcagacaacctgcaggctagaagtntggtgactagtttacttacgtgtcgagcgtaagttagttgtagaacgtcctccgtcttaccgtacggtttccgggcgggtaacgggtaccgcgggtggaagacgtacgaaggaccgtaacgtggtcggcttacggaccctaaccgtattcccgttcgtccttcgtacccg

SEQ ID NO: 243662 - DNA, 533 bp, Homo sapiens
  misc_feature: GYAE6OF01A7F0H.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatcgtacccgggcacccggagtccctgaccgattcgagtggcagcgggtcgtgggacagacttcactctcaccatcagcaacctgcaggctagaagatggtggctagtttattactgtacagcagttattgtgaagtcctaccgtcttcgtacgtttcgggcgggtacgggaccggcgggtggacgtatcgaaggtacgaacggttggtacgggcgtcggacctaccgattcgttcgttcttaccg

SEQ ID NO: 243663 - DNA, 522 bp, Homo sapiens
  misc_feature: GYAE6OF01AVK8A.11.11.A11.1.454.CMB.1.raw
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggacttatttagcttggtatcaagacaaaaaccaggacagcctacctaaactgctcactctccgtgggcatccgtacccgggcacccggagtcccctagaccgattcaggtcggcaggcgggtctgggacagacttcactctcaccatcacgcaacctgacaggctagaagatgtggactagtttatacgtgtacagctagttattgtagaacgtcctccgacttcgtaccgtttcgggacgggacggccgngggtgagntacgagacgagtggtcgctcgacacattcgtgttctc

SEQ ID NO: 243664 - DNA, 624 bp, Homo sapiens
  misc_feature: GYAE6OF01D6AW8.11.11.A11.1.454.CMB.1.raw
  modified_base (314)..(314): a, c, t, g, unknown or other
  misc_feature (314)..(314): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtacaacgataaggactatttagcttggtatcagacaaaaaccaggacagcctacctaaactgctcatctccgtgggctactccgtacccgggcacccggngtcccctgacctattcgagtggcagcgggtctgggacagacttcactctcaccatcagaccaacctgacgacgggctaggaaagtacgttaggtggtacttaaggttttaactttacgtggtacagtcctagttattggtagaacggtccttcccgtcttaccgtaccggttttccggggaccggggtacggggacccggtacggggttacgggacggtaacgttaccggaacgggtaacccggttaacggttgggttcgggaccgttacggacccgtaaccctacgtttccgttcgttcccttaacccg

SEQ ID NO: 243665 - DNA, 514 bp, Homo sapiens
  misc_feature: GYAE6OF01EA28O.11.11.A11.1.454.CMB.1.raw
  modified_base (382)..(382): a, c, t, g, unknown or other
  misc_feature (382)..(382): n is a, c, g, or t
tcagcgagagataccacgaccggtgctcgatttagctacgactgcagggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctacctaaactgctcatctcctgggcatctacccgggcacccggagtccctgaccgattcagtggcagcgggtctgggacagacttcactctcaccatcagcaactgcaggctgaagatgnggctagtttattactgtcagcagttattgtgaagtctaccgctcacgtttcggcggagggccgcggtggagacgttcgaggaaccgtaaacgttggacggcttcgacctaaccaattccgtgttcgtttacc

SEQ ID NO: 243666 - DNA, 499 bp, Homo sapiens
  misc_feature: GYAE6OF01A2ZJS.11.11.A11.1.454.CMB.1.raw
  modified_base (255)..(255): a, c, t, g, unknown or other
  misc_feature (255)..(255): n is a, c, g, or t
  modified_base (380)..(380): a, c, t, g, unknown or other
  misc_feature (380)..(380): n is a, c, g, or t
  modified_base (448)..(448): a, c, t, g, unknown or other
  misc_feature (448)..(448): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggacagcctcctaaactgctcatcgtcctgggcatctacccgggcacccggagtccctgaccgattcagtggcagcgggtctgggcagacttcactctcaccatcagcaactgcagctgagatgnggcagtttatactgtcagcagtattgtagaagtctaccgtctcgtactttcggcggtacgggacccgnggtggagagtcgacgtacgaacgtcggtggctgtacaccatctgtcgttac

SEQ ID NO: 243667 - DNA, 620 bp, Homo sapiens
  misc_feature: GYAE6OF01CCWVQ.11.11.A11.1.454.CMB.1.raw
  modified_base (213)..(213): a, c, t, g, unknown or other
  misc_feature (213)..(213): n is a, c, g, or t
  modified_base (334)..(334): a, c, t, g, unknown or other
  misc_feature (334)..(334): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgaggagggccaccatcgagtgacaagtccagcgagacttcttttanatagtgtacaacgataaggacttatttagcttaggtatacaagacaaaaaccgaggacacgaccctacctaaactcgctacatctccgtggcactccgtacccgggcacccggagtccccngaccgtattcgaggtggcaggcgggtctagggacagtactcactctacacatcagccaacgtgacgaggtctaggaaagtacgttggtaggaccttaaggtttaacttacgtgtacgagacgtaagttagttaggagaacgtccgtcccggtcgttaccgttaccggtttccggggaacggggtaccggggtacccggtggggtacggacgtacgtacggaacgggtaacgtaaccggttgggtacggcgttacgacctaaccgtagttccgttgttcccttaccg

SEQ ID NO: 243668 - DNA, 554 bp, Homo sapiens
  misc_feature: GYAE6OF01EUAJD.11.11.A11.1.454.CMB.1.raw
  modified_base (257)..(257): a, c, t, g, unknown or other
  misc_feature (257)..(257): n is a, c, g, or t
  modified_base (393)..(393): a, c, t, g, unknown or other
  misc_feature (393)..(393): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttctttatatagtgtacaacgataaggacttatttagcttggtatcagacaaaaaccnggacagcctcctaaactgctcatctcctgggcacgtccgtacccgggccaccccggacgtcccctagaccgacttcgagtcggcagcgggtctgggacagacttcactctcaccatcagccaactgcagctgaagntgtgctagtttatactgtcagtctagttatgtagaacgtctcccgcttacctaccgtttcgggaccgggtacgggacccggtgggtacggagtactacggaacggtaacgaacggttggacggtccttacggcccaacctatttccttcggttccttaccg

SEQ ID NO: 243669 - DNA, 939 bp, Homo sapiens
  misc_feature: GYAE6OF01DHAHJ.11.11.A11.1.454.CMB.1.raw
tcagcgagagataccacgaccggtgctcgatttagctacgactgcgaggggcagcaagatggtgttgcagacccaggtctttcatttctctgttgctctggactctcgtcggtcgccggtgtcgggactatccttggacctaggtacccccagtaccctagtacctgtccctgtccgtcgtcgtcggtcgagggacggaccgaccggacctaccgtagtcggacgacgtaccaaggaccgtaggtaccttacgtttacttacgttttaatagttacgtaacgtaacttaaacgggtacttaaagttacgtttactttaggtacttacgtaacgacgaaaaccgtaacgaaaccaacgtaccctagtaccctactacgtacctacctacggtacctcgtaccggcgtaccgtaccgggtaccccggtacccggacccggtacccggttacctccgtacggtaccgtacggtacggtcggtaccggccgggtacgtacggggtacctaacgggtacccttaccgaacccttaccgttacccaacccgttaaaccgtaaccctacggtacccaaacccggtaccggtaaccgtaacgggtaaccgttaacgggtaacgtacggtttaacggtttacggttaaccgttaacggtttttaacgtttaaaccgtaccgggtttaacgtaacggtaccgttaacggttaacgtttacggttaaccggtttaacggtacccgtttaacccggtacggttaccccgggttaccgggtttaaccgggtacccgggggttaaacggggtaacccgggcccggggttaagggtaaccgggttaaccggttaccggaaacggttaaccgtacggttaaccggtccgttaccggtacggtacccgtacccgttacgttaccgttacccgttccttacccgtccgtttaccccg

SEQ ID NO: 243670 - DNA, 548 bp, Homo sapiens
  misc_feature: GYAE6OF01CZX9V.11.11.A11.1.454.CMB.1.raw
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctacctaaactgctcatctcctgggcatcctacccgggcacccggngtcccctgaccgattcagtggcagcggtctgggacngacttcactctcaccatcancaacctgcaggctagaagatggtggacttagtttactactgtcagctagttattgtagaagtccttccgctcgtacgtttcggggacggtacgggaccggtcgggtaggagtatccgaaggtaacccgtaacgttcgggtacggtaccttggaccctaaccgtatttcgtcgttcttttacccg

SEQ ID NO: 243671 - DNA, 696 bp, Homo sapiens
  misc_feature: GYAE6OF01CYI27.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagatactcctgcctgtgtctcgtgggcgaggacgggccaccatcgagtgacaacgtccagcgagtactttacttttatatagtgtacaacgtagtaaggtacttagttagtcttaggtatacgaagaacgaaaaaccgaggaacacgacctacctaactcgctactactcctaccgtcggccacgtacccggtacccgggaccgtacccgggacgtcccgtacgtaaccgtacttacgaggtcggacgacggtccgggtacgtacgggacacgtaccttaccgactccaccacctactacgacgaccaaccgtgacgaggtctaaggaacgtgtcggtacgtacgtttagtttactcgtagtacgagtactaaggttagttacgacgtaaccgtccgtacccgtacgttacccggttacgggttacggggaccgggtaccggggtacccggtagggttacgggacgtaacgtaccggaaacgggtaaccggttacggtcgggtacggtaccgtcgtaccctaacgttagttcccgttcgttacccgttacccg

SEQ ID NO: 243672 - DNA, 596 bp, Homo sapiens
  misc_feature: GYAE6OF01BJHEB.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggagggccaccatcgagtgcaagtccagcgagacttcttttatatagtgtacaacgataaggacttatttagcttggtatcaagacaaaaaccaggacacgcctacctaaactgctcactctccgtggcactccgtacccgggcacccggctccctgaccgtattcagtggcaggcgggtcgtgggacagacttcactctacacatcacgaccaaccgtgacgacggtctaggaagtattggtcggtacttaaggttttatacgttagtcgtagtacgtaagttatttaggaggaaccgtcctcccggtccttaccgttaccgggtttcgggaccggggtacggggtacccggtgggtagggtacacgtacgaacggtacgtaacgttggtcggccttacggacctacgtattcgttcgttcctaccg

SEQ ID NO: 243673 - DNA, 641 bp, Homo sapiens
  misc_feature: GYAE6OF01AENV1.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggacttatttagcttaggtatacagaaccaaaaaccgaggacacgcctacctaaactcgctcactcctccgtgggcacgtccgtacccgggccgacccggtcgtccctagaccgtacttcgaggtcggcgacggcgggtcgtgggacagtactcctactcaccaccactcacgacctaaccgtcgacgaggacgtaggaagtagtggtggtacttaaggtttacttacgttcgtacgagtcgtaaggttattggtagaacgtcccgtcccgtaccttaccggttaccggtttccggggaccggggtacggggacccgggtcgggtacgggtacgacgttaccggaacggtaacggtaacggttgggtacgtccgtaccgacccgttactacgttccgttcgttcccgtttacccg

SEQ ID NO: 243674 - DNA, 560 bp, Homo sapiens
  misc_feature: GYAE6OF01ECLXQ.11.11.A11.1.454.CMB.1.raw
  modified_base (256)..(256): a, c, t, g, unknown or other
  misc_feature (256)..(256): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccnggacagcctactaaactgctcatctcctgggcatcctacccgggcacccggacgtccctgaccgtattcagtggcaggcgggtctgggacagacttcactctcaccatcagcaacctgacaggctagaagatggtgtactagtttatacgtgtcagctagttattgtagaacgtctccgtctcgtaccgtttcgggacgggtacgggaccggtcgggtagacgtacgtaccgaaacggtaaccggtaacgtcgggtacgggtcctacggaccctaacccgtagttccgttcggttcctttaccg

SEQ ID NO: 243675 - DNA, 549 bp, Homo sapiens
  misc_feature: GYAE6OF01BR7BH.11.11.A11.1.454.CMB.1.raw
  modified_base (256)..(256): a, c, t, g, unknown or other
  misc_feature (256)..(256): n is a, c, g, or t
  modified_base (537)..(537): a, c, t, g, unknown or other
  misc_feature (537)..(537): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtgtctctgggcgagagggccaccatcgagtgcaagtccagcgagacttcttttatatagtgtcaacgataaggactatttagcttggtatcagacaaaaaccnggacagcctacctaaactgctcatctcctgggcatccgtacccggcaccggagtccctgaccgattcagtggcagcggtctgggacagacttcgactctcaccatcagcaactgcaggctgaagactgtgacgtagtttatacgtgtcagtctagtattgcgaagtccgtccgtcgttccgaacgttttcgggacggacggggtaccggcgggtaggagtaacgtcgaagggtaccaacggtttcgggacggtcgtacggcctaacccgatttacgggttntcccgtttaacg

SEQ ID NO: 243676 - DNA, 738 bp, Homo sapiens
  misc_feature: GYAE6OF01C7J4T.11.11.A11.1.454.CMB.1.raw
  modified_base (208)..(208): a, c, t, g, unknown or other
  misc_feature (208)..(208): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagacaaaaaccaggacagcctacctaaaatcgctacactcctccgtcgggcactccgtacccgggcaaccccggagtccccgtaggacccgtacttcgaaggttcggaccgacggtcggggtccttaggggaaccacgggtaacctttaccgaaccgttcctaccaaccctaattcccgaaacggcccaaaacccgttcggacccgaaggggtaccccgttagggaaaacggtaagttgggttaacggtaccgttaaggttttaacgtttaaccgtggtttacccgaaggtaccttaaggttacgtttagggtaagggtaaaccgtcccggttacccggtaccgttaccgtttaaaccgggttttcggggaacccggggtaacgggggtacccggtcggggtacgggaagtaccgttaacggaacggtaaccgggtaacgttgggtacggtccgtacggaacctaccgtaaccttcgttcggtacctttacccg

SEQ ID NO: 243677 - DNA, 526 bp, Homo sapiens
  misc_feature: GYAE6OF01DHKE2.11.11.A11.1.454.CMB.1.raw
  modified_base (207)..(207): a, c, t, g, unknown or other
  misc_feature (207)..(207): n is a, c, g, or t
  modified_base (491)..(491): a, c, t, g, unknown or other
  misc_feature (491)..(491): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagaggccaccatcgagtgcaagtccagcgagactcttttanatagtgtcaacgataaggctatttagcttggtatcagcaaaaaccaggacagcctactaaactgctcatctcctgggcatctacccggcacccggatccctgaccgattcagtgcaggcggtctgggacagacttcactctcaccatcagcaacctgcagctgaagatgtgctagtttactacgtgtcagacagttagttgtagaacgccttccggctacgttaccgttcgggacgggacgggtacgcgggtaggacgagttacgaacgtacggaacgttgggnggtaccgcgtaccacgtactcgttgttccttaccg

SEQ ID NO: 243678 - DNA, 598 bp, Homo sapiens
  misc_feature: GYAE6OF01CI2OP.11.11.A11.1.454.CMB.1.raw
  modified_base (207)..(207): a, c, t, g, unknown or other
  misc_feature (207)..(207): n is a, c, g, or t
  modified_base (396)..(396): a, c, t, g, unknown or other
  misc_feature (396)..(396): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagaggccaccatcgagtgcaagtccagcgagactcttttanatagtgtcaacgataaggactatttagcttggtatcagacaaaaaccaggacagcctcctaaactgctcatctcctgggcactccgtacccggcacccggacgtccctcgaccgattcaggtggcaggcgggtcgtgggacaggtacttcactctcaccatcagcaacctgaccgaggcctagaaacgngttagtggtaccttaaggttttattaaccgtgttacaggtactaagtttattagggtacgaaagtccgtacccgtccgtaccgtaccggttttcgggacgggtacggggaacccggtggggttacgggaaagtacgtacgtaacggaacccgtaacggttggtcggcgtacgtccaacccgatttccgttcgttcttacccg

SEQ ID NO: 243679 - DNA, 548 bp, Homo sapiens
  misc_feature: GYAE6OF01BJ8MK.11.11.A11.1.454.CMB.1.raw
  modified_base (207)..(207): a, c, t, g, unknown or other
  misc_feature (207)..(207): n is a, c, g, or t
  modified_base (255)..(255): a, c, t, g, unknown or other
  misc_feature (255)..(255): n is a, c, g, or t
  modified_base (274)..(274): a, c, t, g, unknown or other
  misc_feature (274)..(274): n is a, c, g, or t
  modified_base (349)..(349): a, c, t, g, unknown or other
  misc_feature (349)..(349): n is a, c, g, or t
  modified_base (432)..(432): a, c, t, g, unknown or other
  misc_feature (432)..(432): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagaggccaccatcgagtgcaagtccagcgagacttcttttanatagtgtcaacgataaggactatttagcttggtatcagacaaaaaccnggacagcctacctaaactnctcatcctccgtgggcactccgtacccggcacccggactccctgaccgtattcagtcggcaggcggtctgggacngtacttcactctcaccatccagcaacctgacaggtctagaaactgtgtagcttaagtttatactgtacagctagttattcganaacgctaccgcttcgtacggttcgggacgggacggaccgtggtagacgtagtcgaaggtacgaacgttcgggcgtaccgtcgtacccgaacccttgtacgtccgttccgttacccg

SEQ ID NO: 243680 - DNA, 645 bp, Homo sapiens
  misc_feature: GYAE6OF01ASTYF.11.11.A11.1.454.CMB.1.raw
  modified_base (263)..(263): a, c, t, g, unknown or other
  misc_feature (263)..(263): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgcctcgtgggcgagacgggccaccatcgagtgcaagtccaggcgagtacttcttttatatagtgtacaacgataaggactatttagcttggtatcaagacaaaaaccnggacagcctacctaaatcgactcatcctccgtggcactccgacccgggccaccccgggtacgtcccctaggaccgtattcgaggtcggaccgaggtccgggtcgtgggaactagtaccgttcaacctctaccacctatcacggtacctaaccgtgacgtacggctagaagtagtcggtagtactaagtttacttacgtcggtacaggtactaggttagtgtaacgtacgtccttccgcgttacgtacccggtttacgggacgggtaaccgggtacccggtcgggtacgtaacggtaccgttacggaacggtaccggtaacgttcgggttaccgcgtaacccggtaccctaccgttaacgttccgttcggttcccttacccgg

SEQ ID NO: 243681 - DNA, 568 bp, Homo sapiens
  misc_feature: GYAE6OF01C6PAQ.11.11.A11.1.454.CMB.1.raw
  modified_base (144)..(144): a, c, t, g, unknown or other
  misc_feature (144)..(144): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (326)..(326): a, c, t, g, unknown or other
  misc_feature (326)..(326): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
  modified_base (402)..(402): a, c, t, g, unknown or other
  misc_feature (402)..(402): n is a, c, g, or t
  modified_base (540)..(540): a, c, t, g, unknown or other
  misc_feature (540)..(540): n is a, c, g, or t
tcagcgagagataccacgaccggtgctcgatttagctacgactgcaggggcagcaagatggtgttgcagacccaggtcttcatttctctgttgctctggatctctggtgcctggtgggacatcctgatcgaccagtcccagatntcctgcctgtgtctcgtgggcgaggcggccacctatcgagtgacaacgtccagcganacttntttanatgtntacaagataggatattagcttgatcagaacaaaacngacancctactaactnctacgtactccnccgtggcaacgttcccgaacccgggcaaccggctcccgtgaacctntccgagtgcgtcggtcggtcacgggaactctaacttccnctctacactnacgacactacgngacgacgagagtagngtagtagtactttagtactcgtgtacgagttacgttaggttctaggtacgtacgtccgttcgtacgttacggttaccggtcgggaccggtacggtaccggtaggtagacgtcgacggtacgtaggtcggtcgcgtacncgtactacgtacttcgtaccttcgtacc

SEQ ID NO: 243682 - DNA, 520 bp, Homo sapiens
  misc_feature: GYAE6OF01BNA2A.11.11.A11.1.454.CMB.1.raw
  modified_base (498)..(498): a, c, t, g, unknown or other
  misc_feature (498)..(498): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtacaacgataaggactatttagcttggtatcagacaaaaaccaggacagcctacctaaactgctcatctcctgggcactccgtacccgggcacccggagtccccgtagaccgattcagtcggcaggcgggtctgggacagacttcactctcaccatcagcaacctgcaggctagaagtatggtggactagtttattacgtgtacagctaagttattgtagaacgtctccgtctcgtacgtttcgggacgggacggccggtggtgagtatcgaggtacgagtggngtctgccactatctgtcttacc

SEQ ID NO: 243683 - DNA, 543 bp, Homo sapiens
  misc_feature: GYAE6OF01DK70T.11.11.A11.1.454.CMB.1.raw
  modified_base (362)..(362): a, c, t, g, unknown or other
  misc_feature (362)..(362): n is a, c, g, or t
  modified_base (392)..(392): a, c, t, g, unknown or other
  misc_feature (392)..(392): n is a, c, g, or t
  modified_base (425)..(425): a, c, t, g, unknown or other
  misc_feature (425)..(425): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcagacaaaaaccaggacagcctacctaaactgctcatctcctggcatccgtacccgggccacccgggagtcccctgaccgattcgagtggcaggcgggtctgggacagacttcactcncaccatcagaccaacctgcaggctagaagntgtggactagtttatactgtcagtcagtattgngaatcctccgtctcgtacgtttcgggacggtacgggaccggcgggttaggacgtagtacgacggaaccgtaagttcggacggtcctacggacctaccctagtttcctgttccttaccg

SEQ ID NO: 243684 - DNA, 656 bp, Homo sapiens
  misc_feature: GYAE6OF01EETW3.11.11.A11.1.454.CMB.1.raw
  modified_base (210)..(210): a, c, t, g, unknown or other
  misc_feature (210)..(210): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtgtctcgtgggcgagacgggccacatcgagtgcaagtccagcgagtacttcttttanatcgtgtacaagataaggtactatttagcttggtatcaagacaaaaaccaggactagaccttctaaaactgctactactcgtccgtggactactaccgtaccccgggacacccggtacgtccctacgaccgtattacgagtacggcacggtcgggtctgggacagtactcacctcgtcacaatcacgacctaactgaccaggtctagaagtacgtggtacggacttaacgtttattactcggtactacgtactaggttacttaggtacgtaacggccttccggaccgttacgttaaccggtttcgggggaacccgggtaacgggggtacccggtacggggtaggaaaccgtaggttaccggaaacggtaaccggttaaccggttggtacggtacccgtacggaccccgtaaaccgtttagtcccgtttgggtaccctttaacccgg

SEQ ID NO: 243685 - DNA, 542 bp, Homo sapiens
  misc_feature: GYAE6OF01DIHBB.11.11.A11.1.454.CMB.1.raw
  modified_base (389)..(389): a, c, t, g, unknown or other
  misc_feature (389)..(389): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcaagacaaaaaccaggacagcctacctaaactgctcatcctcctgggcatccgtaccccgggcacccggagtccctgaccgattcagtggcaggcgggtctgggacagacttcactctcaccatcagcaacctgcaggctagaagntgtgactagtttatactgtacagctagtattgtagaacgcctcccgcttcgtacgtttcgggacgggtacgggaccggcgggtaggacgtactacgaaggaaccgtaacgttgggtacggctacggaccaacctagttcctcgttccttaccg

SEQ ID NO: 243686 - DNA, 719 bp, Homo sapiens
  misc_feature: GYAE6OF01A4V0L.11.11.A11.1.454.CMB.1.raw
tcagcgagagataccacgaccggtgctcgatttagctacgactgcaggggcaggcaagatggtgttgcagacccaggtcttcatttctctgttgctctggatctctggtgcctgtggggacatcctgatgaccaggtcccagatatccttgtcctgtgttcttcgtagggcgagagggccaccagtcgagtgtcgaagtccaagcgaggtacgtcttttatatagtgtcgaacgataaggacttatttagcttggtatcagacgaaaaaccaggactagcctaccttaaactgctcatctccgtcggcactccgtaccgggccgacccggtacgtcccgtagtaccgacttacgagtcgacaggcgggtcgtaggggactaggtactttacacttctcaacctatacgacggacctaaccgtgtacgacggtctacggaacggtacgttaggtacggtaccttaaggttttaacgtttacgttacggtaaccttaaggtacctttaaggttaacgtttaggtaacggtaaaccgtacccgttaccgtacccgtttacgttaacccgggttttaccggggaccggggtaaccggggtacccgggtccggggttagggtacggtaaccgttacggtaacggttaaccggtacggtttcggggttacgtacgttccgggtaacctacccggtaaccgtttcgttccggttccgttaccccgg

SEQ ID NO: 243687 - DNA, 629 bp, Homo sapiens
  misc_feature: GYAE6OF01BR2KO.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaaccaggacagcctacctaaactgctcatctccgtgggcactcctaccccggggccacccgggacgtcccctggaccgattccagtcggcaggcgggtctgggacagtacttcactctcaccatcacgacaaccgtgccgaggctaggaaacgtagtggtcggtcttaaggttttacttacgttgtacagtactagttacttggtacgaagtccgttcccgcttaccgttaccgtttccggggcgggtaaccgggggacccggtaccggggtgggaacggtacgtaccggaacggtaacccggtaaacggttgggttacgggtcccgttacggtcccgtaaaccccgtagtttcccggttcgttaccctttaccccg

SEQ ID NO: 243688 - DNA, 503 bp, Homo sapiens
  misc_feature: GYAE6OF01AYQSO.11.11.A11.1.454.CMB.1.raw
  modified_base (208)..(208): a, c, t, g, unknown or other
  misc_feature (208)..(208): n is a, c, g, or t
  modified_base (381)..(381): a, c, t, g, unknown or other
  misc_feature (381)..(381): n is a, c, g, or t
  modified_base (406)..(406): a, c, t, g, unknown or other
  misc_feature (406)..(406): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtacaagtccagcgagactcttttanatagtgtcaacgataaggactatttagcttggtatcagcaaaaaccaggacagcctcctaaactgctcatctcctgggcatcctacccgggcacccggagtccctgaccgattcagtggcagcggtctgggacagtactcactctcaccatcagcaacctgcaggctagaagntgtggctagtttatactgtcaactntattgtgagctcgctcacgttcggcggacggacggcggtggagtacgtcgaggacgtacgtggtggtcgtcgcgactactctagtcttctcttcccg

SEQ ID NO: 243689 - DNA, 528 bp, Homo sapiens
  misc_feature: GYAE6OF01BA5CB.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaaactgctcatcctcctgggcatccgtacccgggcaccccggagtcccctgaccgattcgagtggcaggcgggtctgggacagacttcactctcaccatcacgccaacctgacaggctagaaagagtgtcggactagtttactactgtcagtctagttattggtagacgctccgcttacgtacgtttcgggcgggacggccggtcggtggagtagtcgagacgacgtggcggctcggaccacgtatcgttgtcttaccg

SEQ ID NO: 243690 - DNA, 726 bp, Homo sapiens
  misc_feature: GYAE6OF01EKWGP.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtcgcctcgtgggcgagacgggccaccatcgagtgcaagtccagcgagtacttcttttaatatagtgtacaaacgataaggacttagtttagcttggtatcagacaaaaccaggacagcctacctaatcgctcatctccgtggactagtccgtacccgggcacccggacgtcccctaggtaccgtattccgaaggtcggaccgaggtccgggtcgtacggggacacgtaccttccgtaactcctacccaccgtactaccgaacgtacccgtaaaccgtcggaccgtacgggtaccgtaacggtaaagtagttacgggtacgggtaactttaaggtttttactttaaccggtgttaccgacgttaaccgtagtttacgttcggttaacgggaaaccgttcccggttacccggtacccgttaccgttaaccgggttttaccggggaccggggtaccggggtaccggtcggggttacggaaccgtaacggttaccggaacggtaaccggtaaacggttcggtacgggtaccttacggtaccctacggttaactttccgttacgttcccgttaacccg

SEQ ID NO: 243691 - DNA, 622 bp, Homo sapiens
  misc_feature: GYAE6OF01B65JI.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtgtctcgtgggcgagacgggccaccatcgagtgcaagtccagcgagacttctttatatagtgtacaacgataaggacttattagcttggtatcagacaaaaacaggacacgcctactaaactgctcactctccgtgggcacgtcccgtacccgggaccacccgggtacgtcccctacggacccgtattcgaggtcggcgtacggtcgggtcgtaggggacctacgtaccttccaccttcctaccaacctactcgaacgaccaaccgtggaacggtctaggaacgtagtcggtagtacttagttttacttacgtgtacagtactagttattggtagtaacgtccgtaccgtacttcgttacggttccgggacgggtacgggaccggtgggtaggaacgtacgtacgaacgggtacgtaacgtgggtacggcctacgacccgtactacgttccgttcgttcctcgtacccg

SEQ ID NO: 243692 - DNA, 544 bp, Homo sapiens
  misc_feature: GYAE6OF01DV25C.11.11.A11.1.454.CMB.1.raw
  modified_base (391)..(391): a, c, t, g, unknown or other
  misc_feature (391)..(391): n is a, c, g, or t
  modified_base (411)..(411): a, c, t, g, unknown or other
  misc_feature (411)..(411): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtacaacgataaggactatttagcttggtatcagacaaaaaccaggacagcctcctaaactgctcatctcctgggcactccgtacccgggcacccggacgtcccctgaccgtattcagtggcaggcgggtctgggacagacttcactctcacatcacgcaacctgacaggctagaagntgtgctagtttatctgtcancgtagttattgtagaacgtcctccgcttcgtacgtttcgggacggacgggccgtgggtaggacgtagtaccgaaggtaacgtaacgtgggtacggcgtacgaccctaaccctatttccgtgttccgtttaccg

SEQ ID NO: 243693 - DNA, 587 bp, Homo sapiens
  misc_feature: GYAE6OF01DQ983.11.11.A11.1.454.CMB.1.raw
  modified_base (255)..(255): a, c, t, g, unknown or other
  misc_feature (255)..(255): n is a, c, g, or t
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (387)..(387): a, c, t, g, unknown or other
  misc_feature (387)..(387): n is a, c, g, or t
tcagcgagagataccacgaccggtgctcgatttagctacgactgcagggcagcaagatggtgttgcagacccaggtcttcatttctctgttgctctggatctctggtgcctgtgggacatcctgatgacccagtccccagatatcctgcctgtgtctcgtgggcgagaggccaccatcgagtgcaagtccagcgagacttcttttatatagtgtcaacgataaggactatttagcttggtatcaagcaaaaaccnggacagcctactaaactgctcatctcctggcatcctacccggcaccggntcccngaccgtnttcagtcgcaggcggtntgggacagtacttcactctacacatcagacctaacgtgacacggatagaaacgnttggtacgtacgttaggttttaactacgtgttaccagtcctaagttattggacgaacgtccgtacccgtacttaccgtaaccggtttcgggacgggtacggggtacccggtcggggtaggacgtacgttacgaacggaaccgtaaccggttggtacgggtctacggtaccctaacgtactttcgtcggttccttaacccg

SEQ ID NO: 243694 - DNA, 597 bp, Homo sapiens
  misc_feature: GYAE6OF01B1PS8.11.11.A11.1.454.CMB.1.raw
  modified_base (256)..(256): a, c, t, g, unknown or other
  misc_feature (256)..(256): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccnggacagcctacctaaactgctcactctccgtgggcactccgtaccccgggcacccggagtcccctgaccgtattcaggtggcaggcgggtctggggacagacttcactcctaccacatcacgccaacctgacaggctagaagtgtggtagtctaagttttacttacgttcgtcaagtcgtaagttattaggtagaacgtcctcccgtcttacgtacgttttccggggacgggtacgggacccggtcgggtagggacgtaacgtaccgaaggtaaccgtaacggttgggtacggacccgtacggtacccgaacccgttacgttcgttccgttcgtttacccg

SEQ ID NO: 243695 - DNA, 529 bp, Homo sapiens
  misc_feature: GYAE6OF01DYWBF.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaactgctcatctcctgggcatcgtacccgggcacccggagtccctgaccgattcagtggcagcgggtctgggacagacttcactctcaccatcagccaactgcaggctagaagatgtggctagtttatactgtcagtctagtattgtgaagtcctccgctctacgtttccgggacgggacgggacccggtgggtaggacgtagtccgaacggtacggtaacgtggtacggcttcggaccaccagttcttggttcttaccg

SEQ ID NO: 243696 - DNA, 570 bp, Homo sapiens
  misc_feature: GYAE6OF01BOAKZ.11.11.A11.1.454.CMB.1.raw
  modified_base (261)..(261): a, c, t, g, unknown or other
  misc_feature (261)..(261): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttatatagtgtacaaacgataaggacttatttagcttggtatcagacaaaaaccnggacagcctacctaaactgctcatctccgtgggcactccgtacccgggccacccggacgtcccctgaccgtattccgaggtcgcgaggcgggtctggggacagacttcactctcaccatcagcaacctgcaggctagaagatgtggacttagtttattactgtacgagtctagttagttgtagaacgtccttccgcttaccgttaccgtttccgggacgggtacgggaccggtcgggtacggagtacgtacgaacggaacggtaacgtgggtcggtctacgacccgactattcgttcggttcttacccg

SEQ ID NO: 243697 - DNA, 652 bp, Homo sapiens
  misc_feature: GYAE6OF01E3OR2.11.11.A11.1.454.CMB.1.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatcgacccagtccccagatatcctgcctgtgtctcgtggcgagagggccaccatcgagtgcaagtccagcgagactctttanatagtntacaacgataaggacttatttagctttggtatcaagacaaaaaccagacagcctacctaaactcgctcatcctaccgtgggaccactccgtaccccgggccacccggtagtcccagaccgtatcgagtgcacggcgggtctgggacagtactcactctacgacctatcacgacctaactcgactagggcctaggaaacgtagtggtacggtaccttaagttttacttacgtacgtaccgaagtacctaaggtttactacggtaggaacgttcccgtaccgttaccgtaccgttaccggtttaccggggaccgggtaacggggtccccgggtgggttaacggggacgtaacgtaccgtaacggtaaccgggttaacgttggggtaccggtcctacccggtacctaacccgttacttccgtttacggttccttaaccccg

SEQ ID NO: 243698 - DNA, 630 bp, Homo sapiens
  misc_feature: GYAE6OF01DWJEL.11.11.A11.1.454.CMB.1.raw
  modified_base (424)..(424): a, c, t, g, unknown or other
  misc_feature (424)..(424): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttgtatcagacaaaaaccaggacagcctacctaaactgctcatctccgtgggcactccgtacccgggccaacccggacgtccccgtgaaccgtattaccgagtcggcgaggtcggggtctaggggacaggtaccttcgaccttctcaccatacagaccaaccgtgaccgaggtacctaggaaacgtntgggtacggtacttaagtttttacttacgttcgttacgagtcgttaacggttatttggtagtaacgtcccgttaacccggtccttaccggttaaccggtttccggggaccggggtacggggacccggtacgggtagggtacgactacggaacggtaacgtacggtggtaccggcaccgtaccaactagttccttggttccttaccg

SEQ ID NO: 243699 - DNA, 731 bp, Homo sapiens
  misc_feature: GYAE6OF01DZQL8.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtgggacatcctgatcgacccacgtcccagatactcctgcctgtgtctcgtgggcgaggacggccacagtcgagtcgacaacgtcagcgagtacttctttatatagtgtacaacgtataaaggtacttatttagcgttaggtatacgaagaaccaaaaaccgagaccacgtacctacctaaactcgctactactccgtccgtcggtacctacgtacccggtaccccgggaccgtaaccccgggtaccgttacccgtacgtaccgtacgttacgacgggtcggacgtacgggtccgggtcgtacgggactacgtccgttacctactaccacaaccgtactaccgacgaccaaccgtcgacgtacggtaccgtaagacggtagtcgggttacgtaacctttaagggttttaccttacgtccggttaactaagggttaccttaaggttttacggttagggtaacggtaccgtacccgttcccggttaccgttaccgggtttacgggtacccgggacggggtaaccggggtcggtacggggtagaacgtacgtaccggaaacgtacggtacgttcgggtcgtacgaccgtacctaacgttacctttgtccgttccttacccg

SEQ ID NO: 243700 - DNA, 775 bp, Homo sapiens
  misc_feature: GYAE6OF01C31NN.11.11.A11.1.454.CMB.1.raw
  modified_base (212)..(212): a, c, t, g, unknown or other
  misc_feature (212)..(212): n is a, c, g, or t
  modified_base (261)..(261): a, c, t, g, unknown or other
  misc_feature (261)..(261): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatcgacccagtccccagatatcctgcctgtgtctcgtgggcgagacgggccaccatcgagtgcaagtccagcgagacttcttttanatagtgtacaacgataaggacttatttagcttggtatcagacaaaaacnggacagcctacctaaactgctcactctcctgggcactccgtacccgggcaccccggactccccgtagaccgtattcgaggtcggcgaggtccgggtcgtacggggacctaggaccgtttaccaccttcctaccaaccctataccgaacgtaccaacccgtcggaccgtagggccttaagggaaagtcgttcgggtacggtaccgttaagttttaaccgttaacgttcggtaccgtaagtccgttaaggtttacgttacggttaacggaaaccggttcccgttaccccggtacccgtttacccggttaaacccgggttttaccgggggacccgggggtaaccgggggtacccccggggttacggggggttaaccggggtaaacggtaaccggtttacccggaaaacggggttaaccccgggttaaaccggttcgggggttaccgggtccgttacccgggtaacccgtaaccccgtttaacggttccccggtttccggttacccttttaaccccgg

SEQ ID NO: 243701 - DNA, 535 bp, Homo sapiens
  misc_feature: GYAE6OF01BTKQ8.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctactaaactgctcatctcctggcactcgtacccgggcacccggacgtccctgaccgatcagtggcagcgggtctgggacagggacttcactctcacatcagcaacctgcaggctagaagatgtggctagtttattactgtcagctagttattggtagaagcctaccgtctaccgtacgtttccgggacgggtacgggaccggtcgggtaggagtacgtcgaagtaccggtaagtcggtacggctacgacctaccgtatcgttgttcttacg

SEQ ID NO: 243702 - DNA, 597 bp, Homo sapiens
  misc_feature: GYAE6OF01C7C2H.11.11.A11.1.454.CMB.1.raw
  modified_base (321)..(321): a, c, t, g, unknown or other
  misc_feature (321)..(321): n is a, c, g, or t
  modified_base (401)..(401): a, c, t, g, unknown or other
  misc_feature (401)..(401): n is a, c, g, or t
  modified_base (443)..(443): a, c, t, g, unknown or other
  misc_feature (443)..(443): n is a, c, g, or t
  modified_base (506)..(506): a, c, t, g, unknown or other
  misc_feature (506)..(506): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggactatttagcttgtatcagacaaaaaccaggacagcctctaaactgctcatctccgtggcatccgtacccgggcacccggcgtccctgaccgnttcgagtggcaggcgggtctcggggacagtacttcacttccgtaccaccatcacgccaaccgtgaccaggctaggaagtntggtggtactaggttttacttacgtcgtacaggtctaagttnttaggtcgtaacgtccgtccccgtcttccgtacgttttccgggaccgggtacggggtacccgnggggtacggagtacgttacgaacggaaccggtaacgttcgggtacggtaccgttacggaccctacgtacgtttctcggtttccgttacccg

SEQ ID NO: 243703 - DNA, 643 bp, Homo sapiens
  misc_feature: GYAE6OF01A9KXN.11.11.A11.1.454.CMB.1.raw
tcagcgagagataccacgaccggtgctcgatttagctacgactgcagggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagtacttcttttatacgtagtgtacaaacgataaggtacttagtttagcgtttaggtactacacgaacaaaaaccgaggaacacggtaccttacctaaacgtcgctcaactccgtcgtggctactccgtacccgggccaccggtactcccgagaccgtattacgagtcggacgtacggcgggttcgacgggactacgacctttcgacttaccacaccactcgacgacctaccgtgcgacggtcgaagtaacggtatcgggtacggttacttaagttttactacgttggtaacgtagtaccgtagttagttagtacgtaacgtccttcccgtacttaccggttaccggtttcgggacgggtaccgggtaccggtgggtacgtagacggtacgaccggtacgaagtcgtacggactaccgacttaacctgttacctcgttacttacccg

SEQ ID NO: 243704 - DNA, 720 bp, Homo sapiens
  misc_feature: GYAE6OF01C3AVA.11.11.A11.1.454.CMB.1.raw
  modified_base (54)..(54): a, c, t, g, unknown or other
  misc_feature (54)..(54): n is a, c, g, or t
  modified_base (261)..(261): a, c, t, g, unknown or other
  misc_feature (261)..(261): n is a, c, g, or t
tcagcgagagataccacgaccggtgctcgatttagctacgactgcaggggcagnaagatggtgttgcagacccaggtcttcatttctctgttgctctggatctctggtgcctggtggggacatcctgatgacccagtccccagatatcctgcctgtgtctcgtgggcgagacgggccaccatcgagtgcaagtccagcgagacttctttatatagtgtacaacgataaggactatttagcttggtatcaagacaaaaaccnggaacacgaccttacctaaaactgacctcattccgtccgtgggcctagtacccggtaaccccgggccaacccgggtactcccccgtacggaaccgtacttcgacggtggaccgtaggtccgggtcgtaggggaacctacggtaccttaccacttcctaccgaacctactaccaacggtacccaaccgtcgaccgaacggtaccgttaaggaaacgtagttcgggttacggtaaccgtttaaggttttaacttacgttcgtaaccgagtaccgttaagtttagtttagtaacgggtaactcccgttacccgtcgttacccgttacggtttcccggggaaccgggtcggggaacccggtcgggtaacgggacgtaacgttccggaaacggttaaccggtacggttagggtcccggttcgaccggtacctaaaccgttcgttacgtccgtttacgtttcccg

SEQ ID NO: 243705 - DNA, 515 bp, Homo sapiens
  misc_feature: GYAE6OF01EK4AQ.11.11.A11.1.454.CMB.1.raw
  modified_base (391)..(391): a, c, t, g, unknown or other
  misc_feature (391)..(391): n is a, c, g, or t
  modified_base (468)..(468): a, c, t, g, unknown or other
  misc_feature (468)..(468): n is a, c, g, or t
  modified_base (493)..(493): a, c, t, g, unknown or other
  misc_feature (493)..(493): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatccgtacccgggcaccccggagtcccctgaccgattcgagtggcaggcgggtcgtagggacagacttcactctcaccatcagccaactgcaggctagaagntggtgctagttttattactgtacagctagttattgtgaacgctccgcttctaccgtttcgggacgggacgggaccgngggtggagatcgaagacgacttggnggctcgcaccatctgtccttac

SEQ ID NO: 243706 - DNA, 699 bp, Homo sapiens
  misc_feature: GYAE6OF01AMBCX.11.11.A11.1.454.CMB.1.raw
  modified_base (213)..(213): a, c, t, g, unknown or other
  misc_feature (213)..(213): n is a, c, g, or t
  modified_base (264)..(264): a, c, t, g, unknown or other
  misc_feature (264)..(264): n is a, c, g, or t
  modified_base (324)..(324): a, c, t, g, unknown or other
  misc_feature (324)..(324): n is a, c, g, or t
  modified_base (381)..(381): a, c, t, g, unknown or other
  misc_feature (381)..(381): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggacgggccaccatcgagtgacaagtccagcgagacttcttttanatagtgtcaaacgtataaggactatttagcttggtatcagaccaaaaacgnggacagcctacctaaatcgctcatcctcgtggcactccgacccgggcacccggactcccngaccgattcgagtcggcaggtccggtactggggacagtcttccactcctacaccgtntccaacgccctaaaccgtggtccgaagggtcctaaggtaacgtagttacgggtacgtacttaaacgggttttctttaacgtacgtccgtaagtacccgtaaggtttacggttcgaaacggtaccgtcccgtttacccggtaccttttaccggaaccgttttcccggggggaacgggtaaccgggggttcccgggcgggttaacggggtaccgtaacgggttacccggtaagggaaacccgggttaacccgttggggtaacccggcggttaaccgacccgtacccgttaagttaccgtttccggtccgtttaaaccccg

SEQ ID NO: 243707 - DNA, 555 bp, Homo sapiens
  misc_feature: GYAE6OF01DAXKT.11.11.A11.1.454.CMB.1.raw
  modified_base (208)..(208): a, c, t, g, unknown or other
  misc_feature (208)..(208): n is a, c, g, or t
  modified_base (260)..(260): a, c, t, g, unknown or other
  misc_feature (260)..(260): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtacaacgataaggactatttagcttaggtatcaagacaaaaaaccnggacagacctcctaaaactgactcatctcctgggcatcctacccgggcacccggagtccctgaccgattcagtgcaggcggtctgggactagacttcactctcaccatcagtccaactgacaggctagaagactggtcgtactagttttacttacgtagtacagactagttattgtgtaagtcctccgcttactacgtttcgggacggtacggggaccgcgggttaggacgtatccggaaggtacgaacgtttgggcggtactcggaacccaccgtattccgtagttcttacccg

SEQ ID NO: 243708 - DNA, 682 bp, Homo sapiens
  misc_feature: GYAE6OF01C5Y9X.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagatatcctgcctgtgtctcgtgggcgaggacggccaccagtcgagtgcaagtccagcgagtacttctttatatagtgtacaacgataaggtacttatttagcttggtatacagacaaaaccgaggacacgcctacctaaactcgctactactccgtccgtgggactacgtacccgtaccccgggaccgtaccccggacgtcccctaggacccgtattacgaggtcggcgacggtccggggtacgtcgggaacctaggtaccttacgaccttacctacccgacctacgtaccaacgaccctaaccgtcgacgtacgggacgtagaagtacgttggtacggtacttaagtttacttacgtgtacgtagtacgtaacgttagtaggtacggtaacgtcccgttaccgtacgttaccgtaccggtttcgggacgggtacgggaccggtcgggtacggacgtacgtaccggtaacggtaacggtaacggtgggtccggtacgtaccgtacccgaaacgttcgttccttcggttcccttaaccg

SEQ ID NO: 243709 - DNA, 579 bp, Homo sapiens
  misc_feature: GYAE6OF01BBWZ5.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttatatagtgtacaacgataaggactatttagcttggtatcagacaaaaaccagacagcctactaaactgctcatctcctggcatctacgtcggcacccggagtccctgaccgtattcagtggcacggcgggtcgtgggacacggacttcgactcgtcaccatcacgcaacctgcgaggctagaagagtggtaggcttaagttttagttactggtcaggtactagtattggtagaacgtccgtcccgtcttaccttacgtttccggggacggtacggggtacccggcgggtacgggaagtacgtacgtacgggaacggtaaccggttgggtcggtaccgtcggtaccgacccttagttcccgttgtttacccg

SEQ ID NO: 243710 - DNA, 582 bp, Homo sapiens
  misc_feature: GYAE6OF01ER71I.11.11.A11.1.454.CMB.1.raw
  modified_base (387)..(387): a, c, t, g, unknown or other
  misc_feature (387)..(387): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcagacaaaaaccaggacagcctacctaaactgctcatctcctgggcatcctacccgggcacccggagtccctgaccgattcagtggcaggcgggtctggggacagacttcactctcaccatcagcaacctgccaggctagaanagtgtagctagttttatacgtgtcagtctagttattggtagaagtccgttacccgcgttaccgtacggtttccggggaccgggtacggggacccggcgggttagggaacgtagtaccgaagggaacccgttaacgttgggttaggccctttacggaccctaaccccgtagtttcccgttggttcctttaaccccg

SEQ ID NO: 243711 - DNA, 588 bp, Homo sapiens
  misc_feature: GYAE6OF01DOFMT.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtgtctcgtgggcgaggaggccacatcgagtgacaagtccagcgagtacttcttttatatagtgtacaacgataaggacttatttagcttaggtatacaagaacaaaaacgagacagcctactaactgctctactctccgtgggcctacgtccgtacccgggaccacccggacgtccctacgaccgtatcgagtgacgcggcgggtcgacggacacgtactcactctaccacatacgacacctaacgtgacgaggactagaagtgtaggtacgtcttaagtttactacgtcgtacagtactaagttagttgtacggacgtccgtaccgtacttaccggtaccgttcggggacgggacgggtaccgtggtaggaccgtagtacggacgaacggtagtcgggtcgactccggactacctagttccgttcgtccttacg

SEQ ID NO: 243712 - DNA, 610 bp, Homo sapiens
  misc_feature: GYAE6OF01CEZI4.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtacaacgataaggactatttagcttggtatcagacaaaaccaggacagcctacctaaactgctcactcctcgtggcactccgtacccgggcacccggtacgtcccctagaccgtactcgaggtggaccgacggcgggtcgtcggggaacaggtatttccactcctcaacatcagctagtcctgacagacgtagaagtgtcggtagggttactttattacgttgtacaacgtattacttcttagtttcggttttaccgttttaacggttcgggacgggtacgggtaaccgtaagggtaggtaagtacgtaacgtaaaccggtagttacgtacggtcgtacgacctaacgttacctagttccgttaccttactaccgtttcccgttcccgcttaaccg

SEQ ID NO: 243713 - DNA, 585 bp, Homo sapiens
  misc_feature: GYAE6OF01CCOIW.11.11.A11.1.454.CMB.1.raw
  modified_base (469)..(469): a, c, t, g, unknown or other
  misc_feature (469)..(469): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactattagcttggtatcagacaaaaaaccaggaacagacctacctaaactgctcatctccgtgggcagtccgtaccccgggccacccgggacgtcccctagaccgtattcgagtggcgaggcgggtctgggacagcttcactctcacatcagcaacctgcaggctagaaagattggtaggacttaagttttattacctggtacaagtcgtaagttagtttaggtaggtaacgtccttcccgnttaccgtacgtttccggggacgggacgggtccggcggggttaggacgtagtacgaacggaaccggtaacgttgggacggtctacgacctaccctagttccttgggttcccttaccg

SEQ ID NO: 243714 - DNA, 557 bp, Homo sapiens
  misc_feature: GYAE6OF01B4M6F.11.11.A11.1.454.CMB.1.raw
  modified_base (257)..(257): a, c, t, g, unknown or other
  misc_feature (257)..(257): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcagcaaaaaaccnggacagcctacctaaactgctcatctcctgggcatctacccgggcacccggcgtccctgaccgattcgagtcggcagcgggtctgggacagacttcactctcaccatccagcaacctgacaggctgaagatggtagtctagtttattacgtgtcagtctagttattgtagaacgtcctccggacttaccgtacgttttcgggacgggtacggggtccgagggtcggagagtcgaacggtacggaacgttgggtccgggccgttacggaccctaacccgtagttcgttcggtcctttaccg

SEQ ID NO: 243715 - DNA, 638 bp, Homo sapiens
  misc_feature: GYAE6OF01CJSWG.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggagggccaccatcgagtgcaagtccagcgagacttcttttatatagtgtacaacgataaggactatttagcttggtatcagacaaaaacaggacagcctacctaaactgctcactctccgtgggcactccgtaccccgggccgacccggacgtccccgtaggacccgtattccgaggtcggacgacggccggggtcgtagggacagtaccttacacctctaccaccatcacaccaaccgtgacgaggccttaggaaacgtagtggtacggtacgttagttttacttacgttcggtaacacgtactagtttagttggtagtaaccgtccgttcccgtaccttaccgttaccggtttccgggggaacgggtacggggacccggtgggtacggaacgtacgtaccgaacgggtaaccgtaacggttcggtcgggtcttacgacctaaccgtattccgttgttcctttacccg

SEQ ID NO: 243716 - DNA, 889 bp, Homo sapiens
  misc_feature: GYAE6OF01CA9XU.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacattcctgatcgaccctcgtccccagatattcctgcctgtgtctcgtgggcgaggacgggcccaccagtcggaggtgacaagtccagcgagtactttacttttaatattaggtcgttacaaacggtaagtaaacggtacttaagttttacgtcgtttaggttaactcgaaacgaaccaaaaaaaccgagggaacctacggtacccttaaccctaaaaccgttcgacctacctaacttcccgttacccggtcggggacctaaccgttaccccggtacccccggggacccggtaaccccggggtaccgttcccccgtacgggtaaccccgttacgttaccgaacgggttcgggaccgtacgggtccgggggttccgtacgggggtaacctagtacctttaccgaccgttccttacccgaacctaacgttaccgacgtaacctacccgtacgaccgttacgggaccgtaaaggaaacggttagttacgggtacgggtaaccctttaaaggtttttaccttacggttactacggtaacgtacggtaagtttaacggttcggtaacgtaaccggttcccgttacccggtacgtttaccgtacccggggttttacgggaccggggttaccgggtaacccgggttaggggtaacgggtaacggttacgaaccggtaaccgggtaaacggttacggttcgggggtaccgttccggttaccgtaaccccggaaccgttttacgggttaccgtttcccggtttcccgtttaacccccgg

SEQ ID NO: 243717 - DNA, 721 bp, Homo sapiens
  misc_feature: GYAE6OF01E09OE.11.11.A11.1.454.CMB.1.raw
  modified_base (209)..(209): a, c, t, g, unknown or other
  misc_feature (209)..(209): n is a, c, g, or t
  modified_base (680)..(680): a, c, t, g, unknown or other
  misc_feature (680)..(680): n is a, c, g, or t
tcagcgagagataccacgaccggtgctcgatttagctacgactgcaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagatttattttanacagcctcgacagtaagaactacttatcttggttaccaacaagaaaccaggacacgcctacctaaattctactatttactccatatctatcggccgggtcccgtcccggggtccccacgtattcgagtggcgaggcgggtcgtagggactagtacttcacttctacaactaatccagcacgcctagacaaggactaggaagtgttgggttacgggttacttttagtttaactcgtaacctaaaactaatttacctttcgtttacgttttacggttttaaccggtttttaacgtttacccgggggcggggtaaacgggtaaccggttaaaggggttcggtaaaggtaacttaaaccggaaaaccggttacgtagggttaccggaccgttaacggtaacccaaccgttagtttacccggtttaccgtttaccgttttaacccctaaccggttttcccccgttaaccccccgtntttaaccttaccgggtaacgttaacgtttaaccggttcccc

SEQ ID NO: 243718 - DNA, 644 bp, Homo sapiens
  misc_feature: GYAE6OF01D80Y1.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccacatcgagtgcaagtccagcgagacttcttttatatagtgtacaacgataaggacttatttagcttggtatcagacaaaaaccgagacagcctactaactgctctatcctccgtgggcactccgtaccccgggccacccggactcccgtcgaccgtattcgaggtcggcaggcgggtcgtagggacagtaactttccgacttcctacaactaactccagcacgtcctgacaagactaggtaacgagtcggttaggttacgttttaattagttcgtaaccaaacgttaatttactttacccttacgttttacggttttacccgttttaaggtttccgggacgggtaacgggtaacgttaaggggtacggaagttaacgtaccgtaaaaccggtacgttcgggtcggtccgttacgacctaacccttgttactacgttacttacctaacctttccccgtccccgcgttaacg

SEQ ID NO: 243719 - DNA, 881 bp, Homo sapiens
  misc_feature: GYAE6OF01E5DIT.11.11.A11.1.454.CMB.1.raw
  modified_base (500)..(500): a, c, t, g, unknown or other
  misc_feature (500)..(500): n is a, c, g, or t
tcagcgagagataccacgaccggtgctcgatttagctacgactgcaggggcagcaagatggtgttgcagacccaggtcttcatttctctgttgctctggatctccgtggtcgtcgtgggtacggactactcgtagtagtacccgacccgtacccgtacccgaagtaattccttccgtccgtccgttggttcgttccgttcgggtcggggacggaacggggacccggacccaactacggtacgggtacggtcgaacgtaccgtaccgacggacggtaacttacctttttagtttaatagttagttacgaacgaaacgtaaaggtaacgtacttttaagtacgttcggttagtactacgaaaccgtaaaaacccgaaaacggacgaaccgtccgtacccttaaaccgtaacgtccgtacctactacttccgtcgggtacacgtaccgtacccgggtcccggaacccggtacccggttaccgtccgtacgtacttagtacggngggtacgacggtacgggtcggtggtacggtacgacgttacctcaccttacacctacgtacacgaccgtacctacgtacggacgtacgtacgtaagagttggtcggtacgtacgttttaagtttacctgtacgtacgacgttacgttagttacggtttacgaacggtcgttaacccggtcccgttacgttacccgggtttacggggtacccgggggaccggggtaacccggggtacccgggtacggggtaaggttaaccgtacggtaacccggggtaaccgttaacccgggttaacgggttcgggtaaccggtaccccgtaaccggtaaccccgtttacgtttacccgtttccggttttaccgtttcccggttaaaccccgg

SEQ ID NO: 243720 - DNA, 611 bp, Homo sapiens
  misc_feature: GYAE6OF01AVTUX.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggacgggccaccatcgagtgacaagtccagcgagacttcttttatatagtgtacaacgataaggacttattagcttaggtatcagacaaaaccgaggacagacctactaaactcgctcactctccgtggcactccgtacccggacacccggtactcccgtcgaccgtattcgaggtcggacgacggccgggtacgtacgggactacggtaccttcactcctaccgacctacgtcacgactaaccgtgacgacggctaggaacgtagtggtacgacttagtttactacgtgtacagtactaagttgtagtcgaacgtccgttaccgtacttaccgtacggtttccgggaccggggacgggtaccggtacggggtacggacgtacgtacggaacggtacggtaacgtggtacggtctacgacctacctagtcgttcgtcttaccg

SEQ ID NO: 243721 - DNA, 626 bp, Homo sapiens
  misc_feature: GYAE6OF01DQZPK.11.11.A11.1.454.CMB.1.raw
  modified_base (256)..(256): a, c, t, g, unknown or other
  misc_feature (256)..(256): n is a, c, g, or t
tcagcgagagataccacgaccggtgctcgatttagctacgactgcgaggggcagcaagataggtgttgcagacccaggtcttcatttctctgttgctctggatctctggtgcctgtggggacatcctgatgacccagtcccagatatcctgcctgtgtctctggcgagaggccaccatcgagtgcaagtccagcgagactcgttttatatagtgtacaacgataaggactatttagcttggtatcagacaaaaacnggacagcctacctaaactgctcatacctctgggcactccgtaccccgggctacccggacgtccctcggacccgtattccgagtggactagcgggtacgtcgggacagtacttcgacctctacaccactcaagtacaacctgaccaggactaggaaagtacgttagtacggtactaagtttttaacttacgttacgtactacgtacgtacgttaagtttacggttagtaaaccgtcctcccggtacgtacgttaccggttttccgggaccgggttaccgggacccggtacgggtaggaacgtacgtacgaacggtaaccgtaaacgttcggtacggactcgacctaaccctaattcgttcgttcgttaccc

SEQ ID NO: 243722 - DNA, 643 bp, Homo sapiens
  misc_feature: GYAE6OF01CBW3W.11.11.A11.1.454.CMB.1.raw
  modified_base (387)..(387): a, c, t, g, unknown or other
  misc_feature (387)..(387): n is a, c, g, or t
tcagcgagagataccacgaccggtgctcgatttagctacgactgcaggggcagcaagatggtgttgcagacccagttcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggactattagcttgtatcagacaaaaacaggacagcctacctaaactgctcatcctccgtgggttcacgtccgtacccggggccaccccgggacgtccccgtacgaccgtatttcgacggtcggccgaggccgggtcgtggggaccagtacttccacttcnccaccatacacgaccaactcgactacggacgtaggaaacgtagtggtacggaccgttagttttaacttacgttcgtacgtacgtacgtaagtttattaggtacgtaacgtccgtacccggtaccgttccgttaccggttttccgggaccggggtacggggacccgggtcgggtaggacgtagtaccggaacggaaccggtaacggtgggtcggacgtacggaccgtaaccgttatccgtttcgttccgtttacccg

SEQ ID NO: 243723 - DNA, 604 bp, Homo sapiens
  misc_feature: GYAE6OF01CYGZM.11.11.A11.1.454.CMB.1.raw
  modified_base (207)..(207): a, c, t, g, unknown or other
  misc_feature (207)..(207): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcagtccagcgagactcttttanatagtgtcaacgataaggactatttagcttggtatcagacaaaaaccaggacagcctcctaaactgctcatctccgtggcactccgtacccgggccacccggcgtccctgaccgattcgagtcggcaggccgggtcgtgggacagactcactctcacatcacgcacctgcaggcagaagatggtgacttaggttttactacgtgtacagtcgtagttagtttcgtagaagtcccgttcccgtcgttacgttaccggtttccggggaccgggggtacggggtacccggcggggttacgggaacggtagttaccggaaacggtaccgggttaaaccgttgggacgggtacccgtcggaccccgtaaccgtagtttcccgttgtttccccgttttacccg

SEQ ID NO: 243724 - DNA, 719 bp, Homo sapiens
  misc_feature: GYAE6OF01DH7LJ.11.11.A11.1.454.CMB.1.raw
  modified_base (217)..(217): a, c, t, g, unknown or other
  misc_feature (217)..(217): n is a, c, g, or t
tcagcgagagataccacgaccggtgctcgatttagctacgactgcgtagggggcagcaagatggtgttgcagacccaggtcttcatttcctctgttgctctggatctctggtgcctgtggggacatcctgatgacccagtcccagatatcctgcctgtcgtctctcgggcgagtgggccaccgagtcgagtcgccaacgtccagcgagctcttttanatagtgtacaacgataacggtactatttagcttaggtatacagacaaaacgaggacagcctacctaactgctcactctccgtgggaccacgtccggtacccgggccgacccggacgttcccctacggacccgtacttaccgaggttacggcgacgggtcgggttacgtacggggacacggtaccttcacgtacctaccacccgtactccgacgaccctaaccgttcgaccgacgggtccgttaggaaacgttagtttacgggttacggttaacgtttaagtttttacgtacgttacgtacgtaacggaccttaaggtttacgttacggttacggaaccgtccgtttaccccgtacttcccggttaaccgggtttccgggaccggggtaccggggaccggttacgggtacggaaccgtacgttacggaacggttaaccgaacggttcggtaccgggtccttacggaacccttaccgtagtttccgttcgttcctttaccccgg

SEQ ID NO: 243725 - DNA, 594 bp, Homo sapiens
  misc_feature: GYAE6OF01ASPA0.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtcccccagatatcctgcctgtgtctctgggcgagagggccaccatcgagtgcaagtccagcgagacttcttttatatagtgtcaacgataaggactatttagcttggtatcagacaaaaaccaggacagcctacctaaactgctcatctccgtggcactcgtacccgggcacccggagtcccctcggacctattccgagtcggcgacggcgggtcgtgggacagtaccttcacctctaccacctatccagaccaaccgtgacgaggctagaagtatggtagcttagtttacttacgtgtacagtactagtagttgagtaacgccgtccgtcgtaccgtaccggtttcgggaccggggtaacgggtacccggagggtaggaacgtacgtacgaacggtacggaaacgttcgggaacggtccgtacggtccctaaccgtattcccgttgttccttaccccg

SEQ ID NO: 243726 - DNA, 594 bp, Homo sapiens
  misc_feature: GYAE6OF01EPLMU.11.11.A11.1.454.CMB.1.raw
  modified_base (258)..(258): a, c, t, g, unknown or other
  misc_feature (258)..(258): n is a, c, g, or t
  modified_base (343)..(343): a, c, t, g, unknown or other
  misc_feature (343)..(343): n is a, c, g, or t
  modified_base (388)..(388): a, c, t, g, unknown or other
  misc_feature (388)..(388): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagtacttcttttatatagtgtcaacgataaggactatttagcttggtatcagacaaaaaccnggacagcctacctaaactgctcatctccgtgggcatccgtacccgggcacccggagtccctgaccgattcagtggcaggcggtcngggacagtactcactctcacatcagcaacctgcaggctagaagtntggtgactagtttatacgtgtcagtctaagttacttaggtacgaagccttcccgcttaccgttacgtttccggggaccgggtacggggtcccggtagggttagggacgtaaccgtacggaaacggtaaccgggtaaacgttcggggtacggtacccgtacggtaaccctaacccgttacgtttccgttcggttcccgtttaacccg

SEQ ID NO: 243727 - DNA, 657 bp, Homo sapiens
  misc_feature: GYAE6OF01CGYUM.11.11.A11.1.454.CMB.1.raw
  modified_base (216)..(216): a, c, t, g, unknown or other
  misc_feature (216)..(216): n is a, c, g, or t
  modified_base (435)..(435): a, c, t, g, unknown or other
  misc_feature (435)..(435): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatccctgcctgtgtctcgtgggcgagacgggccaccagtcgagtgaccaagtccgagcgagtacttcttttanagtagtgtacaacgataaggactatttagcttggtatcgagacaaaaaccaggacacgacctactaaactgtctcactcctacgtgggaccaatccgtacccgggcgaccccggtacgtcccctagaccgtattacgacgtggccgtaggccggtcgtagggacacgtacgtcacttcaccacatcgacgtacacctgacgagtacgtagaagcgtagnggtaacctagtttacttagcgttacgagtctaagttacgttaggtacgaactcccggttacccgtaccgtaccgttaaccgtttccggggaacgggccggggtaacccggtcggggtaaggacgtaaacgtaccggtaaacggtaccggtaaacggttcggtaccggtcgttaccgggaccttaaaccgttattcccgttaacgggtttccctttaacccgg

SEQ ID NO: 243728 - DNA, 653 bp, Homo sapiens
  misc_feature: GYAE6OF01B5BL9.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtacaacgataaggacttattagcttggtatcagaacaaaaaccgagacagtcctacctaaactgctcatctcgtggctacgtccgtacccggccacccggacgtcccctcgacccgtacttacgaggtcggacgacggccgggtacgtacggggaacctacggtacccttccgtaccttaccctaccgaaccctactaccgaaccggtaccaaacccgttcggaccgaacggtcgtaaggaagtagtggtcggtacttaagtttacttacgttgtaccagtacgtaagtttacgtgtagtaacgtcctccgtacgtccgtacggtttccgggacgggtaccgggaccggtcgggtacggaagtaccgtacggtaacggacggtaacggttcggccggtacgcgtaccgacccgttagttccttacggttcccttaaccg
